United States Patent 10,233,495 (METHODS AND COMPOSITIONS FOR SCREENING AND TREATING DEVELOPMENTAL DISORDERS) - sequence listing, part 156

SEQ ID NO: 829 - DNA, 4538890 bp, Homo sapiens (residues 3,025,929-4,538,890 of 4,538,890)
  misc_feature (958203)..(1008202): n is a, c, g, or t
  misc_feature (1689175)..(1869174): n is a, c, g, or t
  misc_feature (4240901)..(4290900): n is a, c, g, or t
cagatagaaaccaagtttctatgttggttatacaaggcaatgtgccatgggatcataagaagattactggacttaggatctagatggaaccatcaggagatatgttcaaaacagcagatagggtaacactaaccgaaggaaaagaactcagggaaagttgctaaggcattattacagcagggaccactaccatgcagccccatggtcttcagtatcaactagccctgggtttgcatctttgatctgagtagtagccatatgatgacaggaaagttcatcaatttttctgagactcagttttcccaattttaaaaataagaattgtagcacttacgttgaaagcttgttgagattaataaataaatgagaaaacatgaagtactaattaccttataagtggattgtgagtgtatatatgtgtatatatatatatatatatatatatatgtataatttgcaaagtaaaaaccataattttaaagaaatttatttctacaaacatccataattctggtcctgcgttttcaggtgtgatatcattttcttacaaaataaatttagttaaaaagcaaaaggtgtaaaaaatggcagactaggaagctctaagccctcatactcccacaaaaacacccaaaaaaacccctaaatttgtaggagctcttgaaaacagtgaaagatttacagctaccaagctaacatcaaattaagaaaaaaacatttttgaaaggatagaaatgtcttttggtacttttcacccctgctccatcccctcttcagtatggcagtggtcttaccttaagcaggcagcaccctggttcccagttacacccccacttaaaaggagggaatagggcatgtcttatttgcaaattgtatgtgtgtgtgttcacatctgtctgggagatatctgaagcactgatgcaaggcactcatgtgttttgaccctcttggaattaacatcagtccttctcaagctcttccataaagctgaagagaaagaaacacttcctaactcattctatgaggctgatacaaatagagacaaagacacaacaaggaaagaaaactacaaactaatatctcttataaattgtcttagtccatttagtattgctataagggaacacctgaggcttggtaatttataaagaaaagaagtttatttggctcacagttctgcaggctatacaagaagcatggaaccagcatctagttttggtgagggctgcagattgcttccactcatggtggaaggccaaggggaaccagcatatacagagatcacatggcaagagagggaaaaagagagaagggaggaaggtgccagcctcttttaacaaccagctctcatgagaaatacaagagtgagaactcactcaccccgaccccaaccaagagcattaatctgttcatgagggatccgccttcatgacccaagcacctcctattaggtcccacctccaaaattggggatcaaatttcaacatgaggtttggagggataaacatacagaaattctcaaaaaaaacactagtaaaccaatttcagcagcttgttaaaaggattatacactgtgaccatgtgggatttgttcccagaataaaaggatggttgaacatacaaaaatatattaatgtaatataccacattaatagcatgaagaaatggaaccacatgatcatctgaattaatacagaaaaaaagcatttgaaaaacattcaacactctttcatgataaaaacactcaacaccctttcatgataaaaacactcaataaactggaaatagaaggagacctcctcaacaaggtaaagactatttgtgaaaagcccacagctaacatcacattcaatggtgaaagactgaaagctcttcctttaagataggaacaagataagaacgcctggttaatccacctctattcaacatagtactggaaattctagctacagcaattaggtaagacaaacaaaaacaattcaaatttgaaaggaagaagtaaaattatctccctgcatagaaaacacaatattatgtgttaaaaaccctgaagattccacaaaataagattccaactaataaaccaatacaacaaagttggagcatacaaaaatcatttacatttccatagactaacaatgggaaaaaataaagaaatcaagaaaacacttcaatttacaataacatcaaaaagagtaaaatgcttaagaacaaatttaactgaggagtcaaaagacatacacaggagcagagtaagaatagaagcctccactgatcattcctcccttccacaggaacaccaaattttaacaagcaactatacacacaaaaaaagcaccattataagaaccaaaaataaggtgagcaatcacagtacctgattttaacttcacatcactgaaagaggcactgaagagggtaaggaagacaatcttgaattgcttatgccacccctcccccatcccccagcaggagccatttcacatggagagagaatctgtgcacttggaggagggacagcacagcaactgggggacttgatattgaactcagtgctgccctgtcacagtggagagcaaagctgtgctgagctcagctggcatccacccatgaagggagcatttggaccaccctagccagagaggggaatcgcccatcccagtggtgggaacttgagtttctcagcaagccttgccactgcaggctaaagtcagagtcctcatgaatgggattagtgcccttataaaagaggccccagagagatgtgtttcctcttccaccatgtgaagacacagtgagaaggctgtatttatgaaccagtaaatgggccctcaccagacactaaatctggcagcatcttaatcttggaatttccagcttccagaactgtgagacgttgatatctattgtttataagcttcctggtttatggcattttgttatagcagaattaaaatatggactaagacaaaaaatggtaccaagaaatggaggtgctgctctaacaagtacttaaaatatggaagcaccttcagaactgggtaacaggtagagactggaaaatttttgaggtagatgctaggaaaagcctacattgccataaaagggccttaaatggtgacgctggtgaggtctctgaagaataggagagctgtagagaaagcctcagtcttcttagagaatatctaagtggtcgtgaacaaaatgttggtcgaaatatggatggtaaaggccattctgatgagactcagatggaaatgagtaacatactgttggaaactgaaggaaaggtgatccttgttataaaggggggaaggatgtggctaaattttattcctgtcctagtgtttgttagaaagtagaccttacaagcaatgaaatagaatatttggctgatgaaatttctgagttaagtattggtggtttggtatgtcttctcttgaatgcttgaacatcatgagaacatcaatgtgtgtggccaaccaactatttgataaggagattagtatggatcagcctggtgctattcatcaagataatggaagaatgaccccaaaggcatttcagagatgtgctggccctcccttcacaggcccatagttctagggccttgcaggcagtaagattttgaagaaggagctgaggcatccatgggccttagtgcttgctgcccaacactgcctcaaggatctgctctctgcattctggctcagtgcaccttggtcatcccaggtgtggctccagtggatccaggtacagtatgggctacagtggccactcctccagagggcataggcagtaactcctggtggcacccacttggtgccatctttgctggcatacagtataattgagctgtgggggtatgattgcctgcaaatggatttcaaaggatggagccacctggaagttagagcatacaacccaggcagaaggctgctgtgaggtcagggccactgcagacagtccccaccaggacaatgcctagtggagttgaggaggtgaggcccccactctgatctcagactagtagagctaccagcttgtgattacagcctgggagagctgcaggcaccctactctaacctgtgagagctgcagtgtaggctacacattgcaaagctgtgggggtggggctgctcaaactcctgggggcagggatgccctgaacattgaaggcccaattcatgccagcaagtctgtggaggtgggacccccaacccagtgggcctggaggacagaccctcaagtcaaagatagagtactaaggttttagacttacttggggttcattagctctttgtttttcctatttctcccttttacaataggaatatctatcccatgcctatcctacgattgtattttggaagcacataacttgtttgattttataggctgacagctggagagcaatttgccttgggattaattgaacctttaatctcacccatatctgatttagacaatatttaggaaagattttggatattttgagttgttactggaatgagttaagactttgggagctattgaggtgtaatgaatgtattttacatgtgagaatgacatgaatttggcagggacagggattgaatgctatgatctcaatgtttgtattttcccaaaattcatatgttcaaaacctaatcaccaatgtgatattagaagatggggctgttgggaggtgattagccctcattagtgggatttgtaacctaataaaagagctcccagaaggttgtcttgcccctttgccatgtgagagcatagcaagatggttgtgtccaccaggtagcaggccctcactagacactgaatctgtctgtgccttgctcttgaactttgcagcctccagaactgtgagaaataattttttgttgtttataatatgcctgttattgcatcctgagcatactaagacaattactaaaatatatgccaatgttttatactttgataagacaaaaagtaatataccaacaaaaccacaacttggtaagaagagagaaagaagaaagcataagtatgctacttaacttatttttcacaaagaatacatggacaccatcaaaagttgaaatgcacctttaagaatgaaaaacatcagccttttattgtttttctactttaaagggacttttttagaaactaaaatataatattttgaggaaaagaaagaagccatacctttatgtccaaacaataaaaatctttctgtataaagaatcacataaatttggataatattttatctttctgcataatttagaatatgaaagtacataattgctttcaaaaagttacccattttatactcttcttattcctttgacagcatcaatttaatttttgttaagtatcacatgcactttagttatatttatatgtggcaaaattattattttaaaaataagagcaccaaagctatggcattcaattttgccagtgattgtatttttttataaaagcttaatttgtggaataacaatgtttaaatcacattaaatatccactttaaacttattactggcctgtagaatatttttacacagtttaagagctgtatgtagaatgatatctctgtgcttactttcttcacatattaggcttttcctcaaactttttggagaacaagaagttccagaagaggatgctagactttacacagcaaaactccaaatttcttaacacagaatacattacagtgatccaaaaaattagctgttatgatatttatgattatcaatgatatttagaaaatattatattgtctaggtattcctaacaattaggaattatattttgattccaatactctgttcaaaaagtggctttccctttacctaatttctgacatggctgggcgaagatggagttccagaaaaagagacctatatattttagatgagatttctgatttcaagcaagtatcaagacaaatgttaatggttcttaatttgatgagattgggcatgttcagggtggtacagcccttgacgagggttcttaatttgataaccaaaaaactactgtgtgaaacaaaacacatatccacaatattttgaggagattgttcaggtgtccttatagcttgagaagtctgtaatagctggttatcaaaaaagctaactcacccattggaatgtagtatttgaaatcgatatctagacagtcctgtgactaataataatattaaatttgtagtttaaaatcttcataaaaataaatctctaaacagagatggcttcactgacaaattctacaaaatatataaagaaataacatttttacataatcaattcaagaaaatagaagtggagtgaacattttcaacctcattttaacaacacagaattaccctgatacaaaactagacaaagatattacaaagtaagaaaactatgagccgttttccttcaggaacatagatgcaaatttcctcaaaaatattataaaatagaatccatcaatatctaaaaatagtgatgcactgtaatcaactaggattcagatattcaaggctgcttcaatatcagaaactcaatcaatgtaatccatattaacagaataaagaagaaaaattacatgattagatcaattgatgcagacaaaactttcgacaaaatgaaacacctattcatcatgaataatggtcatcagtaaacaataaatggaagggaatttcctcagcctgataaatagcatatacaaaaacctataggtgacttcatacttaataatggaatgcttatacttttcctctaaaatcagtaacaaagaaatgatgtcctcattcactactcctatttaacatagtactggaagtcctaggcagagcaatatggtaaaaaaaaaaagaaagaaagaaaaaaaagaaaattaaagacatacataacaaaaaaaaaaacttccgatagtgaaagattacaaggttttctactgaaaactatcaaagaatcttatttaagtctttaatttttatcgattcaaggagtacaggtgcaggtttgttacatagacatatatgtattaggctgttcttcaactgctatacagaaatacccgatactgggtaatttaaaagaaaagaggtttaattggcccatggttctgcaggttgtacaggaagcatagtagcatctgcttctgaggaggcctcaggaagctttcaatcatggcagaaggaaaacaggaagcaggcacatcacatggcaagaacaagagaaagagagagacagttggcaggggaggttccacacacttttaaatgaccagatcctgtgtgaactaacagcaagagctcatttattaccaagggaatggctcaagccattcatgagggatttgcctcatgatccaaagacttcccaccaggccccacctccaacactggggattacatttcaacgtgagatttggatggggacatccgaactatatcagtgaacactgtacccaacagataatttttcaaccctcctccccacttccccgtttcggagtccccagcgtctattatttccctctgtatgtttgtgtgtacctgttgattagctcccacttataagtgagaatatacagtaactgatttttgtttctgagttatttcacttaggataatgcctccagctccatccatgttgctgcaaaagacaatattttattcttttttatggatgcatagtattccatggtgtatatataccacattttctgtatgcaatcaactgttgatggacacttaggttgattctatgactttgctatggtggacagtgctgcagtatgagtgcaggtgtctctttgaggcatttattttcttttggatatatgcccagtagtgggattgctaggtcaataatagttctatttttagtccaaaggatccttttttaaaaagctgctacaattaataagtgaggttaccagggtgatacaagtagccctgtggccgccaccactaggactgtgctgggtcagacctgaagccagcacagcactgggtcttgcccaaggcctgctgtaaccactccctggctactgcctttgtttgctcaaggctctggggctctacagtcagcaggtagcaaagccagccagacctgtgttcttccctttagggcagtgaattcccccaggcctcaggcaggtccagaggtgccatctgggagccagggacaagagccaaaatccttagaaatctatctggtgatctattgtgctgcagctgagctggcactcaaaccacaagatgcagttcttcccactcttcctcccttttccaaaggcagaacagcctcactctgtggccaccaccaccacaggcccacagagagtagtgccagactatcgctggtgttcccttaaggcccaagggctctccattcagcttgtggtgaatgttgcctggcctggaactcaccgttcagaccagtgggttcccctctggccaagggcaggtccagaaatgctgcccaagagccaagtcctgcaatcagggatgtcaagagcttgcttagtgctctatcccactgtggccaagctggtacctaaggcgtaagacaaagttccctttacttttctctccacttttctcaagcaggagttttgccccatagctaccacagctaagaatgtgttgagtctcacctgaagccagaaagtctcagagtctcactcaaggcccatggcatactatctgggcatcactgctgcttattcagggcccaagggctcttcagttagcaggtgatgcgttctgccaggactagattcttcccttcaaggcagtgggttcccttctggcccagggtgtgcctagaaatgttgtcttggagctagggcctggaatgggggcctcacaactctgactggtgccctatcatgctgtggccgagctggtatccaaggtgcaagacaacgtcctccccactcttctctctcctctcctcaggtggaaggaaggggtctcttttggatctgggagctatgcagcctgcctttaggagaggggtggtgccagaactcccttagccaccctggctggtgtctcagtaggtcacatgcccagccccagaatactggctctgggcccagtacaaaactaggacttgactaggagttgcagtccttgtggcctagactctttcaagtttacttaggaccctgctgtaggggttggggggtcctttaatccgttttggtgaggcttgtgggaattcaagttctgactgccgggttcattgattcccctctagctagggctggtttaaatgctccctccgtgagtggacatcagcaagtttggtcccgttttgctttctgctataacagggcagcattgagttcattgcctcacaactgttgcacaccccctctcctcagtgcacagaaatactctccacacgacactgccactgctgggggacaggagtgggtggcactggtgtttcaagactgtttttctacctcttcagtgtctcttttagcaatatgaagttgaaaccaggtactgtgagtgatcacctgatttttggttttgctgaaggtgtttctttgtgtagataattgttaaattagtgtccttgtagcgggggatgatcattggggccttctattctgtcatcttgctccacttcccatgatcacttttgtcagcaggcagtgaatcctgccaggactgagtctgtctcaccagggtaatggattcccttctggcccagggtggatctagaaatgccacctaggagtaaagacctataaccaggggcttcaggaatctgccttgcactttattgtactatgactaagttaacacccaagttgcaagacaaagttttctttactattccctctcttcccccaagcagaaagagtctctcctgcagctgcattacctggagatggggaagtacccaagtactcccttgcctgtcacaggcgatgtcactctgagttacaccccaagtctactgcctcagtgaagcaccagggcttgctcaaggactatagtacttgtggcctgacagccactcaaatttgttcctggccccaggctacttcagtcatccagcagtacagccaatgagacttttctcccactggggcagggaatttccctctgtcttaggactggtctaaatgctccctctttgggcaccaacagcactctgccctatattgtgttccactgtgccagggtagcactgagtttcaatgcaaagtcccgaactcactttaactttccctcctccaagcacacagattcttactccatgctgtgctgcctagggttgggggaggggtgatatgggcaatgcaagactgtctttcctacccaattcaatgcctctttccttgatattatacttaaaacaggtactgtgattgctcacctgatttcttggttcttgtgaaggtgccttcttgcatggatagttgttcaatgtggtgtttctttgggatgatgagcactgaagggttcaatttggccatcttgttctgcccaagttcctaaaatttgatgtctttttagcaaaaggaagaagcttctcatccccagtggtagcagcgttcctaccctcatccacagtggtagtggcctttctatctctgtctcaagagtttaattctgcattgcctgaggaaacagtaatggcctcccctgaaggagttgacaggctgattcttctgaggatccacctttaccacccctttttgcttctagatctataactagattcaagtctcatcaggcccctaaaggtgagacacaaagtgtgacccatgaggaggtgtgctacactccacaataactacttcagttttctgatttatacaggcagaaatctggggaacatatgcaggaatggacattaagggtgtagcataatggtggaaaaaacatgaagttggatcaggtcaaatttgttaatatgggcccactaaccagagattatgcatttaatgttgcagcttgagacattaaaaaagagtgctaatactttggcttgttggctaaaatgcagctgaaaagatggcctattatgagtgagctggaaatgccagatctcccttgatttatggtagaggaagggattcaaaggcttggagattggaatgctagaatggatttgtcacataagacctactcacccaaacttggagggtccagatgatatacttttcactaaagtgaaaatagatttgtaaggggagcaccagcatctttgaagaactctgtgattgctcttctctgtataccagacatcacagtatgaactgctgtaactcaattggaaacctaaatgcaatgagaataactggacccctgccaactgacagcactcaaccaccaaaggcaaggtggacatggttatcgtaatggacagcagaggcaaagcaataatcagaatagtctgactcatgtagatctatggtgttggctagttaatcatgatgttcctagaagtgaaatagatagaaagcctactacattcttatgtgatctgtagaagcagaaacttccaggtcaagtgaacaaaagtctaacttgaatcataaagcagagaatcatgaccccaaatcaatttccagacttgagccaatttacaaaccaagaacttgaacaaaggggaggtcagctccccttgtggaaggaccccagtatattatcaaaaatttatattttgttcatctttgttccatttttgcccaaagaccttttaccaaggtaactatgcattggggaaagggaaataatcagacctttgggaactgccagacactggttctgaactgaaattgattccaggagacctgaaacatcattgttgccctctagttagagtaggagcttatggagatcaggtgattaatggagttttagctcaggtctgacttgcaatgtgtccagtgggtccccaaacccattttgtggttatttccgtagttccagaatgcataattaaatagacatgcttagtatctggcagaatccccacattggtcccctaacctgtggggtgagagttaatatggtgggaaaagctaaatggaagccattagagttgcttctacctagaaaaatagtaaatcaaaaacactactgcatctctggagggactgcagagattaatgccaccatcgaggacttgaacgatggaggggtggtaattcccaccacatccctattcaactctcctatttggcttgtgcagaagacagatggatgttggagaatgacagttaattatcataatacttcatcaagtggtgattccaattgcagccgctgtaccagatgtttcattacttgagcaaattaacacaccttctgctacctggtatacagctattgatcgggctttgagtcctgctaccagcctgtctggttcttcagcttgcagactacctatcgtgggacttcaccacttctgtgattgtggtagcagattccccctaataaatttccttccatacattctactggttctgtctctctggagaactctgagtaatacaatatccattcttttgcatgtgaatatccagttgtccctgcatcatttttgaaaacactatcttttcccccacaaaattatcttggcccctttgacaaatttacttcttcctttactttatcaaagagtttgtgaaggattgatattaattcatatttaaatgttaattaggattcaccagtaaatccatctagacctgggtgtttttgtgtggcggcggggggggggggggtttgaaattactaatttaatctttttatttgttataggtttattcagattttctatttcttcttgtgctagtattggtaatttgtgtcttggtaggaatttatctatttaagttatataatttgttggcatatacttgtttataggtttccttatgatactattaatttatataagtttgtttgtgttatcttctctttcagtcctaatgttactaatttatgtcttccttttttgttggtcattctagccaaaggcttgtcaatttgttgatcagatttaagaaataacttttggttttgttattttctatttagtttatttgaagtctaatgttcattttttctttccttctgtttgcttttggtttagtttgctcttcttttcctactttattaaggttaaaggttgggttactgatttgagaacttttttagcattttatagaaattattttccttccaaacacgcttaaggtgcatcacataagtttggtatgtttttttattttcattcatctcaacatcttttctaatttcccttttgatttattctaaaacccactggttgtttaggagcacattaatttccacatatttttgaatttacaaattttccttttactactgatttctaatctcactctactgtggttgaaggacatatgtatataatttcaataattctaagtttattgtgggttattttaaggccttgcttatatactctcctagagaatgtttcatacatgcacttaggaagagtgtatattcttctattgtgctgtaaattgatttacagatatgtgttaagtttagttggtttatattattattattcaagttttctatacctccgttcttttgcctagatattttattcattattcaatgtgtgatattggaattctcaactatttttttaaatcatatatttatttcttcaattatgtcatttcttttgcctcatgtattttgggattcttctgttatatgcatgcacatttataattgttatattttcccaatggattgatattttatcattataaaatatctctttttatcgctatcaacatttttgaccaaaaaactattttgtctgatattagcatagcccctccagatctcttatggctgttttcgcacaacatcggtttccgcctttttagtttcaacctatttgtatctttgaaagcaaagtatgtcttttgtagacaccataagtaggattggatcttgtttttctatcagacaatctctgccttttgattggatagtttaattgattcacatttaatattattattgatatgctttgatttatgtttacaattgtgcttttggtttctatatattttgtgtcttttgtgttcctctagtccttttttctgtcttatattaagtagttattttctagagtaactttttcatttctttaatggttttcactacattttttagcaattttcctggttgttgctttgacttatggattatatgtcaagttaaactacttcaaataattccaataagatagaaaatcttagttcctttatagcttctgtacctcccaccccctttgcgatattgtatatactacatctattcatattacaaaaaacaatatagtattacaattattgctttacataattgtgtgtcttttaaagaaggtaagagaataaaggagaaaaaaatatatttataccatttttatattaaccttatttaccatttctgtctttgtgtatttctcctgatgaagtcaggttattgtgtggtgatatctctttactccaatatatttcatgtctgacctccttttttgttctgttattgtcaaatatattgtatttctatatgtaatatgtcaagtatataattttatagatttttatgcaatatgttcttttttttttttttttgacggagtctcactctgtcaccaggctggagtgcagtggtgcaatctcggcttactgcaacctccacttcccaggttcaagcaattctcctgcctcagcctcccgaatagctgggactacaggcaagcgtcaccacgcccagctaatttttgtattttaagtagagacagggtttcaccatgttggccaggatggtcttgatctcctgacctcgtgatctgcctgcctcggcctcccaaagtgctgagattacaggcatgaaccaccacgcctggccgcgatatgttcttaactcagtttacaaacaaggaatgatacaatcttttatacttatctacataattatttttaataggattctttgttttgatgtttagatttaaattattctatagtgtccctttctttcagcctgaagaactttctctagtatttcctgtgaataggaaatactagcagcacagctctgctagtatgttagtttcctatggcttctgtaacaaattatcacaaacttagtggcttaaaacaacacaaatgtattatcttattgttctggaagtcagaagtccattcatcttactatgccaaaatcaaaatgttagtagggctgtactgtctttggaggctctacaggaaaacttgctttgttgcctttccagcttcgaaacatcacctgcattccttggctcatgaccccttctaaccttcctcaagtccatcactccaacctctgtaatcataggttactgggattaggacatggacatctttggtggaccatattctgtctaccacagatggcaatgaaattatctcagcttttttgttgttgtttttcagggtatgtattttgccttcacttttgaaaaataattttgttgtatataagactattagttgctttttttccttaaacactttgaatatgtcattccactgccttctgtcttccatgatttgtgatgaaaagtcacctattattcttattgcaggataccttatatatgatcttcttctcttgcaaatatcaagagtttatcatgtgtcccatatttctctgatgctcttttatctttattcttgtttctgtctgttcttcagattgcaaaatctattgttatatctttaagtttactgattctttcttctgccagctctgatctgctgttgagcacctcttgtgagtttttatttaagtgtacttttttagtttaaaaaaaaaaaaaggatgctggtgaggtggtggagaaaaaggaatgcttatacactgttggtgggagtgtaaatcagttcaaccattgtggaaattcctcagagacctaaagacagaaataccatttgacccagcaatcccattactgggtatatacccaaaggaatataaattattctattataaagacacatgcacatgtatgttcattgcagcattgttcacaatagcaaagacatggaatcaacctaaatgcccatcaatgatagactggataaagaaaatgtggtacatatataccatggaatactatgcatccagtataaagaacgagatcatgtcccttgcagggacatggatggaactggagaccattattcttggcaatccaaaacaggaacagaagaccaaataccacgtgttctcacttataagtgggagctaaatgatgaaaacacatggacacatagaggggaacaacacacagaggggcctattggagggtagacgatggagggtggaagaagggagaggatcaggaaaaataacaaatgggtactaggcttaatagctgggtgataaaataatctgtaaaacaaacccccaggacacaagtttacctatgtaacaaacctgcacatgtacccctaaactttaaataaaagtttaaagaaattctcactccttcagggattatgtaaagagtttttggcattcatttaagaaatcaacagttgatctagttataaaccaattgaaagaagttgtaaaataagttgatgatggaattccattgtatcaggagaatatcaccaatgctttttacaaatgcctttatgcagccatgatgcaaaatgaaatcaataaaatatcaattattgcaaagttaaaaatagtgtactttttgactaatttttgaccaaaaagaaaactctgttaaatatttcaataagtttattctgagccaatgtgtcaccatggcccagggaacagtctcaggaggtcctgagaaagtacacctgaggcagtcaggttatggtttggttttatacattttagagagacagaagttacaggcaaagacataaggtatacattggtttagcccagaaaagcaggacatctcaaactgagggggacagcttacaggtcataaatggattcaaagattttctgatcggcagttggttgaaagagttaagctgaagacttgacatcagtaaaaaaaaaaaaaaaagaaaagaaagaaatgattgagttaagataaggggagttgtggaaaccaaggttcttattatgtatatgaagtccccaggtagcaggcttcagagggaatagatggtaaatgtctcttttcaaaccttaaaataggtgtcagactcttaatctttcctagattcaggaaaggcctagctgtattaatggggattctctacacatgcaaaatttcctccaccaaagatggctttgcagggccatttcaaaacatgtcaaaaaaaaacattttagggtaaaatatttttattttcttcagggtctactatctttcatgtgacgctataccagagtcaggttgatatttggtatcttattgccaaagagtctgttctgtcagtcttaatatctctattttattaattctggccggttttgcctaaactccaaaagggaggggttataatgaggcatgtctgacctcccttcccatcatggcctgtaatttagtttttcaggttgctctggggtccccttggccaagaggtttatttctggtttaaacttcagattgcaaaatctgttacatctaagtttgctgattcttctgccagctcagatctactattcagcaccactcgtgagttcattttaatacaggagttattggccgagcatggtggctcatgcctgtaatcccagcactttgggaggccaaggcgggcggttcacttgaggtcaggagttcaagaccagcctggccaacatggtgaaaccccatctctactaaaaacacaaaaattagctgggtgtggtggcatgcatctgtaatcccagctactagggagactgaggcaggagaattgactgaacctgggaggtgaaggttgcagtgagccgagattgcaccactgcactccagtctgggcgacagagcaaagctctgtctcaaaaaaaaaaaaaaatacgggtgttattaagaaatagttttaggcagatagagagggttaaaggagttctcggtaaggctttttcttttaatagaaacagctcctgaaacacttcttttctaacagaaaggcgacttgcaaaaaccaggccagcaagcactgacatgcgaatgctggtgattagaaactaggtccaaccaatatggccattcccgccctcttctccttgtcaccacatgtgccaagtgtcatggccacctccagataactctgcatgtacaggctatcatggccgcccacatttgcatattaaaagactatggtgggagggccaggtttttcacgggctacataaatgacacacctggtcaaaccaatcccctgggccctatgcaaatcaaacaccacctcctctagtctcccaatataaccaagtacttttccgccacacatggggttttctctttccgtttggagcccccctccctctgtctctgtatggtggagcttcttccttctttcctgcctattaaactctctactctttaaaaccactccacgtgtgtccatttatctacatcagcgtgagaccaaggaccctggcgttcctacattcattgaggtagtatcattttggtgtattgggcaagaattcatttatcggagtggtgagtatggagtgaacctcaacctcaaatctgtcctttaatctcaaggctcttttcctgctatcccgtcaccaaactttccttctttctctatccagggtctcttactgtctctgtgtgtcaaatgtgcaggaatttttacagttcagggaaacaggtctgttaggaaagatcagcagctctggtgagctcatggtatttctaagccaacatcaccacctagtgaaaatagaaatcctcttcatgaggcacattttttacagtaacactgagcttccttttgcaccactagaaatcaggctctcagctacttctgtgaacaggaaagttctgcctttagcagctaagaagtaaaatgtcttctatagtcaaattttagtcttgatattgtcccataagcaggaaaatggccattcgtttcctatattcctttaagggacctattctgtctctgattcagaccgtacttaattagtaaggggattttaagtttggaagtaaaccagaactatttttctgaaggtaaatgctttagcatggaccataatagcaggcaatctagcacgttgcctccgttaaaggagacttgcccaaagatgacacagtctctccagagatccatttttcagggagccaggcagatcacacaggtttaggaagtcaaaggggatcacacaaggtggataagctaaggttgcatgggtaaagcgtggttagtcccatcacttagttcatctggtctcatggcttggaggaccacacctacaaccatgggtggcacgtttaacagggtgccaggacccaggaaccatggagggaaaataggaggatgctccacgtcttctccaccctgggtcatacagaaaggaaggaaactaaaaggacacttttattctcgcctctctttctagatgggtaacagattatcttcagcttgcacccctctggaatgcactctgaagcactggaacttccttaacctcgggactttgaagagaaaagcgactcattttcttttgcacaaaggcatggcatttttactaaacctttgcaagggttttaaggtcaaccaagcccttttagcaatcatatcaggcaggcccaaagagaatagttccccaaagttagagaagcaatttccaggggaactacctgaggatcccccttatttggggccccttcaagttcccttctcattataggaccttaggcaaataaagggaaacttaggctgattttctgacgacgctgataggtatatagaagctttccaaaatttaattcaggtgtttgacctcacatggagggatgttatgttgctcctaaaccagaccctcatggcagctgaaaagcaagcacctctgcaagaagcagagaatttcggaaatgagcaaaatatcgcctataatacaccaaaaaggaagaaggcagatagatagggaaagtgaagaaataacagaaacactattcccaatcgggagggaagcagttcccagtacacaaccctgattgggaccccaataactcaggagatgaatggaaaaagaagcactttttaaggtgtatattagagggcctacagaaaaccagggccaaacctctcaattactctaaactgtctatgatagaccaaaagccagatgagaatcctgtagcctttatggaaaggctgagagaggcactaataaaacacacctcctatcccctgattcagtcgagggacacctcattctaaaggacaagtttattacacaggcagctcccgatatcagaagggagctacagaagcaatttataggaccaaatagcaccttagaaaacctcctgagaatagccacttcagtcttttacaacagggaccaagaggaggcccaaaagcaagagaaaaagctcaggagaaggacagaggctctggtagcagatttgcaggcttgcaaagtccagcatccccaaggtgcatccgctagttgctatcggtgtggcaggctagagcattttaggaaggaatgcccaggcagcaagatgaagccatctcaaccctgtccagcctgtggcggaaaccactggagatggaactgcccccagagatggaagtcactgggttcaggaccagtctcacagatgatccagcaggactgatgggtcctggggctcaaatctcagctccagcggttcaaactgccattatagcacaagagccctgggtgattctggaaaataaaggaaggaaagtagacctcctttaaacactagatcctcttttctctctcttttatcctctctaatctaggcctcccctcttcccataacatgaccgtaaggggcatctcaggaaaaactctaatccaatgtttttctcaaccttagttgtagttaggaggacctatttacacaggcttccaaaccattgttatgacagctctactaaattaatcctaggaaataatttaagtgtttacactccacatgtggcaggatcactgtcctctagggggagctcttagctagtaaacagccagtaaagcaagaagtacataaggcaggataagtagtagtagctctaaataacgtctctccccagacacaagcactcaattagctgagctaatagctcttacaagagcacttgaattaagcaagggaaagacagctaacatttacactgattccaagtatgctttcctggttctccatgctcatgctgccatttaaaaggacagacattttcttaccactcatggatctactataaaaatatcaccaggaaattaggttattatcctcagtttttcttccacgagaaatagcagggatgcattgtaaggaacatcaaaaggaaacaaataaggtagtcaaaggagatagattagctgaccaagcagctaaatcagaggcaaggaagcctcaaggcatcaacacacttcaagcccctcctaatctaggaaggctccataagaaaaactaaacctcagtattcccctgcagagatagaataggccacttgtcgagtgcatgcttttcatccctcaggatggctagagtcagaggatggcaaactccatttgccagcttccagccaatgaaaagtccttaaaatccttcaccacgcttttcacttaggaaagtattaagacttattaatgtattcaaagattattttcaggcaggaaaacctctaaattggttaagcacgtaacctctcgagctcacttccaacaagaattaacacaactagcagaagcccaaccccaggaaatagaaccacctttatttaacccaggaaatttggtattaatgaaaactctcatctctgtctccttccctaagccaagctgggaaaggccctacactcttctttcaactcaaccccctcggcagtaaaggttacaggaatcaactcttggatacatcacagtcaagtcaaagcctaaagagctgagggagcaacccctgacagtccagaggaacgtcctgaatatcaatgtggagaaatagactatcttaagctgaaaatcacaaaagataagtaactgagtgagggctactcatcttactcagtccccctcctacctcaccagatactgtttattatttctcccctttcctctcaaaatttgccaccaaatattagaacttctttttaatgcatatttgcaaggaaattttaattatacatgggattgcatttgtaactttgtagatccccaaaggaaaatgttatatcttggcaagtaaaattttaaacagaaattatttactatgccactcctgtgggaattgttatagtcacgctactatttgcagtagaactgtacactgtggcacccacaatgtggaattctggttgtaaaattctaattgctgtaatattttgcctgattctcatccttataacaggattaataattgcaggaaagatctagtcaaggttgctttgcttatagcaggagtagtagttatggataagaagcaagcatggaagttttactatcattaagtttaataggactttttactgaaggttggtgataggatgcactctaagctatgaaaaggatatgaaaaacagagattttacataaggaaggatcttgtatggtaaattcttgtcctaaaaggaagtgactggttgtttaaagaaagcatgtttagaacaagtcagaaagtttaagtatgttgtaagagagtatgtgaaagtcatgaaaaaattttaataattaaaggaaaggattgtcaagattaacactaaaattattttagccacccagtaatatatttctccaaattttattgcaagttataaaaatggtctaagcctaaagttattctctaatggcaagttaagggggaaaatgtatgctcttctcaaggaaaacgttagctttatatgaacgtttctggtaatgtacggcgacatctagtggagacaaatgggtattgcaatccattcacttatcaaactcagtaatggtctataggacccccactaacggtggtaatcctaatactcatattctaacactatattttaaaccatcttgtaaaatttatctcttttcacctagaagcaatcaaactccaaatggtgctagcagaaccacacatggacaggccattcttctgagaacccgtagctcaacctcatgagaaggtccaattgcttttcccccacatgatgccccttttcagcaggaagtagccaggaagaatcatcgtctaacaccccttaacaacagttaggtttacttctcttgaggggggaataataaagttattaaggaataattttaggcagatagagaaggtaaaaggagttatcagtgaggctttttttttttaaaaatagaaacagctcctgaaacatttcttaacagaaaggcggcttgaaaaaaccaggcagacaagtattgatatgcaaatgcaggcgattataaactaggtccatccaatatggcaattcccaccctcatccccatgtcaccaagtgtcatggccgcctccagataactccgcgtgtgcaggacatcttggcggcccacatttgcatattaaaaggctagggtgggaaggccaggtttttcttgggctatgtaaatgacacatctggtcaaaccaatcccctgggccttatgcaaatcagacaccgcctcctccagcctcccaatataaccggctacttttctgctgcacaaggggttttctctctctgcttggagtccccctccatctgtctttgtatgggggagcttcttccttctttcttgcctattaaactctccgctccttaaaaccactccacgtgtgcccctgtcatttatttacatcagcacaagaccaaggaccctgctgttcctccatttcttggagccatgtcaatttaagatattgtactttttaactttaggttttgtatttgattctttttatagaattcctatttattgattgatactttctattcagtgattcactgtcattatactttcctatgatttttaaaacatagtttccttcagttctctgaacatattcataatagatatagtatttacctgctaacatctgtcccactcaaagacatcttctattgtctgttttcttccctgtatatgagtcatacttttcctgtttctttgcatatctcttaactttttgtttaaaaattgacattttacaggaaacaacaggtgctggagaggatgtggagaaataagaacagtttttacactgttggtgggactgtaaactagttcaaccattgtggaagtcagtgtggcaattcctcagggatctagaactagaaataccatttgacccagccatcccattactgggtatatacccaaaggattataaaacatgctgctataaagacacatgcacacgtatgtttattgcagtactattcacaatagcaaagacttggaaccaacccaaatgtccaacaatgatagactggattaagaaaatgtggtacatatacaccatggaatactatgcagccataaaaaatgatgagttcatgtcctttgtagggacatggatgaagctggaaaccatcattctcagcaaactatcgcaaggacaaaaaaccaaacaccacatgttctcactcgtaggcgggaattgaacaatgagaacacatggacacaggaaggggaacatcatacaccggggcctgtcgtggggtggggggaggggggaggtatagcattaggagatatacctaatgttaaatgacgagttaatgggtgcagcacaccaacgtggcatatgtatacatatgtaacaaacctgcacgttgtgcacatgtaccctaaaagtataataaaaaaaattgacattttagataatataataacttgatattgaactccttctggggctggttgttattgtttatttgtctagtaacttgggtggactaattctgtgcagtctatttcttctgcacagtacagctctagtgtctcctgttcagatttttcttttatttatttttttaattgtaagccttgctgactagcagttgtccctgggtcagcatagcttagtagtcagccgctgattggccagaagttatgcttaaggtctctgagccagtgtgtggtttggagaccgccttcacagcttatgaattagcccctcaatcagccaggaggttgtagctcctagctcgtaagttctcattctagtcatttccaagaatgtgctgactcaggcaggtgccctgtctggtatgagtgtgatttggcagggtcctctttggctatttctatcaccgaactcccttttagatttcaggctgatctgcctctattggtatcacattctgattgttagctgattgctctattgtattaggccattcatgttttgctttaaatacctgagactgggtaacttaaaaagaaaagaggtttaactggcttatggttctgcaggctacacaagcatggtgccggcatctgcttggcttctgggaacgcctcaggaagcttttattcatggtagaaggtgaagcaggagcggttaagcaatatggccagagtagtagcaagaaagagagagtggaaggtgccacacacttttaaacaaccagatctcacatgaactcactcatcaccagggggatgttgctaagccattcctgaaggatacatcgccatgatctaaacaccatccaccaggccccacctccaacattgtggatgacacttcaacatgagatttggtggggacgtatatccaaactatattatctattgtgttcaaaagtgccctggaccctccaagctctgattcaaataacgttaaccccctcaggaaggaccagcaatacttcttggcgtacccccctctccctgggcaaaaccttttcattatggagtggaaggtgggggtgagtgtgtaggctagtgtggctacttggctcccaccacttgcccagtgtagattttccacaagtatgaaagtaaatgcaaatccaaaaagtggagaaaattaaacttttcatggcacaaaaagggaaagagaccccctccatccctttccttagagcatatactttagacgacgtttagttatgaatcctttttctgctccttcaagagatatgtaaatattttttaagctgttaaaaattacaggaagccattgttttggactgagctcctgcactaggttccaacattcaagaaaaaaacaaaatagagtctctcgtgttaaatgccacatcatcaaactaaaactttaacgaagcaaacagattctaaaacagaccagtttttcctgaaaacaggagattctagtctacctgtgtcagcataataataaggaagtatcctctgctttaacccttttaaaaaattaacccaaagtaacctgttgttaacccatccagtttttttctattgttctacttccttgttcccacccttcaatacctactgttctgccatcgcccagtgggagatctcattatttgtagaatggatgcttcccaaattcatgaatcgcagataaaagcaaattagacctataactaaatttgtcgtaattttgtcttttaataaagctagataagccttttgccagctttaaaacacagaaatgtctttctcaagaacctgggtgacatctctttgaaatgtaaatatcaaagaatatagcatccctatctccttgggagtttaatgtaggtgtctggcttcaaattacagccacctatgtgtcatggaattatgagaagttttacaatttctttgggtaaaggcaattagcaaaggcaaatggccacccccaattaccaggtgaatttaaaatgaactatgtgtaacaaacggtgctattaagtcctctcatatgaagactagtctatcttgggaacatgtatgtaataggttgtatctgcctgggctatataaaaagatgatatttctttctatctttccaatctctttagcagattgcttgtgatgcacatcacattctggtttaatgcctattcaataataaaactgttttccttcttttctacttttgtgggcaggttttctgggttggcagattttgtctgtaattatgttttcccaacacaggcacctggagacattgagtactgccaatggactgctgaaccaaacgaagagcttttctgcaacattcatgttgcagaggagatgggaactgccactcagctgctgccactcagctactaaatctgaaatagttattcagcaatacaaaaatggtattgcggggttctggggcagcccctttggctcaaatgccagagctttctgctatacctactgagtttcagtagattttattgaataaaagtttctcaattcattacaagcccttcgatcaatctccaaagactttgtctagtttcaaatatgtttttctaggggaaaggatttgccaagctcctcacactaccattccagaagtcctaaccctgaactatgtttgcaacttcttgtgaatcctaaattattttaaaataaagagtataagaaataaaaatttagtggtgcctagcatgatccaggcagtgtccttgatgctggatttacaaagaccaatgaaacctggttcttttccttcaggatcttatagtcaggtgtgggagacagacgtgtattggaaaagcacagaaaagtgctataggtgctaaattagcaatctgtgcaaatagcatggaggaagggacgaagaaaacaaaagtagttagtaaaatagaaacaggaatgaccaacaaattaaaaagaaaattcaggaaaactatgtccttgtgagtatgaaatcactcacctatacttgacaatgcaactggtcattgggttcacatccttggctcttcccaggtaatagtgaatgatatcccttctcaaaataaaataattcagacaggcttctattcattcaactacgcatccaaacaaataccatttttatgggacttatccatacatcaatcactgtttatcagagaaaccctcagtgaattatctaatgcagttttttttttttttttttttttgagaaggagtctctctctgtcaccaggctggagtgcagtggcgcgatctcagctcactgcaacctctgcctcccgggttcaagcgattctcctgcctcagcctcctgagtagctgggactacaggcgcctgccaccacgcccggctaatttttgtatttttagtagagacggggtttcaccatgttggccaggctggtcttgatctcttgacctcatgatccacccgcctcagcctcccaaagtgctaatgcagttttactgtaagatcagatctgaaggaaaaggagtaacagattgaccaaagttctttatgaagccaagaagtcaggaatagaaacttccaaaaatgggaacatggagtaaagaatataaaaatctcaagtgaagagaatttctaatacagatgtgtcctatgtcaattcattgttcacatatattttccaataagggcaaaactgacacaatgatagcaatactttattgagcaagtagcaaatgtaataattcattcaataaatactgggcactgtgttaggttctggggatacagagatgactcaagctgggcttcaggcctcaaagacttcgtgttctagtggacggacagacagacctgtagatagaaagattctgcctacatgtagaattgcgcctacatgaaattgtgaggagagctatgacagaaataagcatggaggaccttgggaaatagatgagggccccttaatctaggtagccatgaaagaattctcagaggagataatgcttatgaactaggtactattatgatcctcaacattagattagaaaactgcagatcagggaggtaaggtaacttggctgagatcacatggatagtaaatggttgagccagttttcattcatggtaatgtggactcccaaacctcattcgttttacttgactgccaccacttagattttcaatggctctgtttgcttcatatacgtttttgaaatctggtacattttatgatctatgggaaagtcagaaagatactccatatctattggtttaagtacagctcctctgagttctaactactgggccctgatgctgtatagaattctgagcacagcctagacactaaatgtttttcttttctgcagacttgtcagatgccaactgattcacttcaaccttgagtattaattaatttttattttgttacacccacttctaaaggtaattttaacttaaagccctttcaaaatccaatcaaattaacagtataatatggattttcataaagatcccagaatgtcctgctctgaaacaccatccaattgactattcatatcaatgtaaactggacttggagtgttacaaaaatcctgctcaaaagcatatactaaaccattaccattttcttgtaagtacaaatcagtttttatgagacacagtcttgctttgtcaccaaggctggagcgcagtggtgtgaccacagctcactgcagcctcgacctacagagctcaagtgatccttccacctcagcctcccaggtagctgggactataggcatgcaccaacactccaggctaattttttatttttgtagggataagagtctcactatgttgcccaggctggtctcgaactcctgggttcaagcaatcctcctgccccagcttcccaaagtgctgggattacaagtgtaagccaccacacccagccaaggtttttgtggaagacagtgtggcgattcctcaaggatctagaactagaaataccatttgacccagctatcccattactgggtatatacccaaaggattataaatcatgctgctataaagacacatgcacacacgtttattgcggcactactcacaatagcaaagacttggaaccaacccaaatgtccatcagtgatagactgaattaagaaaatgtggcacctatacaccttggaatactatgcagccataaaaaaggatgagttcatgtcctttgtagggacatggatgaagctggaaaccatcattctcagcaaactatcacaaggacgaaaagccaaacactgcatgttctcactcataggtgggaattgaacaatgagaacacttggacataggaaggggaacatcacacactggggcctgtcatggggtggggggaggggggagggatagcattaggagatatacctaatgtaaatgacgagttaatgggtgcagcacaccaacatggcacatgtgtacatatgtaacaaacctgcacgttgtgtacatgtaccctagaacttaaagtataataataaaaaaataaaaataataaaaagaccaattataaacatgccccacataagactccaaaaagttctggacttcatggcccagaaatagtagtatcctgaatgaaaacaaacaaacgaataagccaaaaaccaaaaaaactaaaactaaaacctttcctcctcctctttttgttgcctctacactagtactgaccatagtgagacacactgtgtgcgtgtgtgcgtgtgtgtgtgtgtgtgtatatcaccgaatggtatattttcaaccatttttgacctttgtttgtggaaaagctgcttaacctctctgattcttggtttccccattttacagaataggacaactacttctcagagtcagcgtgaggattagatgtcataatacatgtagacatgtttttgagaactacaaagggctgtatatgtgttatatactcccctgggaacatttggagcacacagaaattttggtgagtcacagaaaaagcaatttttataaaagcagcttctccagcccaatcccttgtatacaacagtgagtgtttaatatattttattataccaatgagtttatgcaaacttaacccattcggaagtcataataaatgatgcttgacaccacactaggaacttgagattcaaatggataaaacagggttctttccttcaaagaactcatggtctagtaggggaaccctggaaacaaataactacaaggattgtggcaggctacacagtagaagtatataccaggtacagtgtggtacacaggtaggataggcactcccaagtctttttaccctttcaggctcttgttccattgatcaccacatcttcctatgtctccatcctcttcctgtctactggctcctccccataatcaaataagccatgtcaccctcttggtcacaatcacagtttagtgagtgagtcagataagtactttaggcaactgcaggattcacagtggattttcatcttaaagttaaacaggaaggtatggcaatagagtattgatatagtgagatgtgtctttagttactgccatgttctgagtaacttggtgaatgacaattcaccaaggaccccaggaggagggaaagtattaggagtgggaggctttgcaaggtcacaggttcagatttagatgaataaataattacaatgtttaatgcttcatacttggcatgaaatgggacaagataattgtggaataagaaaactaagttaaaatcctggctctgttgtacatgagctctatgaccttgggaaattttctatgtgttgaagagtccattcacccaacattattgataagattaaaaaacaacagtaaaatttataacatagcacaatggttgagaacacagcctctggagttggattgcttggatttgaaacagtgctaccctttatttgctgtaggagagtgaggaaattttagcttcttagttttcttatctataaaatggcatattaaatagtagttctgacctcacggggcttttatgacaattcagttgcttaatatattaaatagtagagtagagtacctggtatatagcaactgctaaatgtttgctaaatatattaggaatacctatttcagagttcactgcaaatttcacaagatatgaaaattgttaattagttgtaactatgccactatagtctcttccaaaatcctgattttggaagccatggcatgtcgtctagcttcgaattatctttaaagtgaaactgcactgttgaatcctacagctccttgaagtacttgtctgactctccaactaaacagtgacagtagcagagatggtagcacggcctaattggaacagctaatctttaggtatctgatcattcaatgtagtcctcaacaagggtcagtcagtttcctgcagccaggggagtgcagcagaagcttcagagcactggaaccacagattgtcctgttgaggatgtggccccgacactgaaagtcatgataagacctaatagctccaagtttgttctcctttccttcaggacttctccctatatacccccatcgacattgctctccatctcattgcccattggcatcagacacatacacataccattcactggcaattaggactaatcatgagacaaactttgaatatgtggattgtgagcttctttaagtaagaagagtataaaatccaaataaacatattcaaagagaggtgtgcttttggaatggaagcagtcaagttttgtttagtttggcattgagctgtaagaaacagggtcatgttaaatagagcttctatgggtctgtagccatttatcaccacacagatgttttccagccccactcctcacctgctgtcctcttgctgtttcctcagtcagcaatttcctattctccacagagctacgtcaatactgccctcactttctcttaacctcttatattactcacactttctcacctcatactcactagataactctattacctctccaagggaaatgaatatctcaggtgtaacataccttagtttcataatacaaatctaccaaccttccttatacctatccagttttttctccttccctcctggtacagtggaaggggtaattttctaccatctaagataaattgcttcactgtgcttcacatcccaagtccttccaccctctcaggctctttttccactgattactacatcttcctataccttcaaggctttccctctgtaagggttcctccccattaacaaataaaggtgcccaagtctctgacacctagaaaaccttaaaactctccttcaatgtgacctttctctttagctaccatcctatttcttgcctctccttcaatagttaattaaattatttgaaagaattatttactcattaaatccagatccttatgtcccacttattcctcagcccactgccatctgctttaccactctgccactctattgagacagttttcatcaatgatattttctgccaccaccactataatactccatattcttcacaactccctccttaaaatattgtatatcctcaattctctttattttgaggactgcttttgataactcctttgtatgcaattctccctctgctcatcacagaaatgttttttgttaacagctttattaaggtataattacatctgaacttgcttctagacacaggtaaattaaaaaaaaatatatatatatatatagttacataccataaacttcaccagtttaatgtgtacaattcaatggctgttagagtatttacaaagttgtgcaaacatcatcataatctaattttgaacatgttcatcatcaccaaaagaaatcttgtacccattagaagtcaatcctcattcccctttcccctagccataggcaagcattactctactttctgatgctctagatctgcctatattaggtattacatataaaacaagtattacacagtatgtaatgtactgtgtctggcttctttcacttagcataatgttttcaatgttcacccatgttatagcatctatcagtatttcattcctttttattgctaaataatatcccattgtatgggtatactacattttctttatatagtcatagtctatggacatttgaattgtttccacttttggctatagtgaataacgctgctatgattattcatatacatgcctttttgtgaaacattttcatttctcttgggtggatacctcacagtagaattgttgggtcatatggtaagcttgcttaacattctaaaggactgccaaactattttccaaagtggtagcgatatcttatattctccccagtaatgtatgaggactcaggcttctccacatccttactaagtcttacttttagtctttttgattataggcattctagtgggtgataagtggtttctcgttgtggttttaatttgtatttccccagtaactaatcttttattattagttaagcatcttttcaagcgcctattgtccacttacatatttccttggaggaatctattcaaatcccttacgtagcttttaatcacattatttgccttattattgatttttaagcattttttaatattctggatacaatccaagttgctgatcattttaaagggcgaacttttaatgttgttaattttctctattgttcttctattctctatttattttcatttgaatatttagtattcctatcctgcttatcttgttttgtttgctctttttttgtggagatttaaatgaattacccagtaagtactgctttagctgcttcttgctttggtgttttgattacatccatctcgaaatattctttaatttccactgtgacttcttatttgacccacaggaatgtgttgtttaatttctacatatttgtgagtttcacatgtttctttctgtcattgatttctaaattccactttggttagagaatataatttgtatgatttcagtatttttaaatctattgatgcatgtttatggcctagcatatgatctattttgcagaaagttacatgtacttgaaggggatatatattttattgctgttgggtggagtggtctttagatgtctcttagtttaaactgttttatagtgttgttcccttgttgctactagtagcatggaaccaccaagcccctcttaattgctcaccattaagatactcactgttttcaacaatgctttcaggcattaacttctccagattttgttccccataaattcagtcccttcaggcagagatgctatgctttatgccctgcctttctacatatatagaaactctggacaagtgtacctgagctgggtgtgggtatagtagaccacttctccagtaacaccttactctattagtggacactgaggagagatggtagcctctggtcatttcagcttgccagtctccatgtagaaactttaccttacaaatacactggcacataggagattgggaacccactagtcttagcctatcacagctgaggcagaggcctcaccctacaagtaggagctagtcctctagcccagacttgcctgcctcgactaggacttctgcaaaatggcgctgtggagggataagacactggtggctttctcctcctgggtcaaactatggactaggaacttgggggatagaggcccccatcttcttggtcatatccacatgtagcacatgtagtagaggtctagagtagagcttgtcacatggggctgggggagatagaacagcttgtagctcaaatgtcacagattctaaccatttttgccaagatttagtaattttcttaaatacttcttcatttgttatatgcccttatgacaatttctaaagactttgtgtgtgtgcatgtgcatgcatgtgtgcgtatatacatagctgtcacgaaataatggtgtttctctgggaaatgggttcaccaagatcctcatataactataacaaaaatgcaggttcagacactgccatttgcagagtccaattaacaagagcaaggtctggtataaagaaagtgactttttattccaaagctagcttaggggaagaaatacaggcttcctgccatagaggtacaaattcacttttggagcagaaaattgacacttttaaaaagggacccagcatgaatggcacgcaggggaggaagcaaacaggtaggggtctgcatgctcactttggtgccttatctaccaggcagtgaactggtgcctttgtgagcagaacgagattgtaaaggtggccgaaactttccaggtgggagagagtgtcatagcaggcatactaagggttgtaaattgactgttgtccctcaaggcagtctcctggtgggagagaattctgctctggagcttctaagaacatggttagatgaacttgccctgtagggagcgtctgatgtaggggagataaaaggttataactgcatttctaaagggctacgtaagaagtggggaatggggaaattgataaaataagagaaaataataataataactcattttctttttcttagaaatatgagtatactcaattataatttcccactgtcaggttccgttttacttctatgggatttgggtgccacattcactctggctacttcctgctgagaaagggcatagtcattgtttgtcaaaatgaaactgatctacttggagttggaaatattcacaagtacccagacttacagatgatgtttgttggaacattacggtgtgaagtttgaagagtctttgggaaagcctgtcttgcatttccatacagagtgtgcaactgcagtaaactccacaacagaggaatatgcctatccctgcaatcaaggccaatgttacaagcagctttttctaccaagatggtcttgacctgaaccagaatactgaccactggtctattgacaatattatgtcagacataggtttgagttgttggtgcatgtcttgcaaagctagagacatttttcccaaattatcagggatgtatatacagcagctactcttaattatcattcaggttccccactgccaattgtaactggatataatgacaggatggctaaatatgtatttaaaaggttacaggaagagttatgaacactcatgaaggtggccataagccctgtctagtccatgagaatggattagtttagttaaatagctgtgttctatccaggaggtagcactgcagatgggctaggcctctgtatgtgatgaaggcaaacagatttttgataagaggcatgtctatggaaacagaagaaaaataaaggttaatgttgggcacaattttccagatgttagactcacagcatctttagttacagaggaggaaagttgtggcagcctgacatgtttttcttgcctgtgttacaaggaacaatgtagtagcgatttcattgagttcggatcaggaaaatggaagaaaaaattcaaagtgtttgtttagggacttgtagcccagaaagaattcagaatttagtccaaattgcagaaaataataaaaactcaaaaacaatggacaagactagaatctaacacaggtgtactatagttttttctgaaacataatttttctctctccagtccccatttttactaaagacaaatcatagtaggataaatttatttggaaaataaggtttagtcttattttgcttgtcctaattatttgcatcaagtacagcaagaataattatttgccatataagttcctttgcaacttggctttgctggaatttttatttatacggaatcttggattaaaccttttaaagcttcgagcccagccacagatttattggtgcctgcaaataactgcatggattgagtgaatccctttccttttgaagtcccaaggtaacctggggctcctgagcctgtcaaaaagtgaccttctttacttagcacaagtcaggaaaccctgtacagggactgcatggacaaggtatcaggccagtttttcccaaggggctttaattggctctataagtcaactttgatttgttgaagccatctgttcatatctgaaagtatggcaatccagttaaagccttgctaaaataaccagtgtctccagtggtgtcctgttacaaaagagaacagaatcttattgagtttatgtaaaaataactatactgctataaactaagtatacttacaaatagttttcaagttctggagaaatcaggtagagagaaatatgctccatatttttctcacacgagtgtactttacccaattgttaaaagctgtaaatagctcaaaagaaaaaaaggtttctggactctgagaaacaaaagaattagcaatgcttcaaacaaaaagtcataaaaagattagtcttccattagttcagtctatgcaattaactcccgttctgctcaatattccagaacatattagctccctatgggagtcttggaagttttttttgtccattcgagtgtcacaatccccaaagttaatagaaacctgcattcaagaatacctgtcagaatcctacagctgattataaaatggcctttgaagagaatcaaaataaaataacaattatggatgatagaagtctcagaacactcacagataaagacacaattgacaaggaaatctggtcatctctgtggcatgcaataatttaacatagcaatcttaattattactgataacatatattgagatatatcagaattatggggatcttatacaattctggaaaacataccaataacatatttacatgaatataacccaaagaaagaaagttaaacaccattttatatgtaacagtgcttcctgtatggctttaatataccaagtaagccaaatatatctcttttggacttcaggggacctaataaaagagttaaccaggtcaaaaaaaagcttaatttagaacttgactttggaaagtttatctaatatcaaagctttaaacacctgatattacaaaatagattcccaggtcactataagctatttatttaaccaagataactcaaaagttttttaaaggctaaaatctttactcattgatagagggcagactcagctttccaaacaaaacccaaaaagacagcatgaggacaactgaatctcttttctctcccttcttttttctatcattattcaaaaggcaaataaaaatctttcattatcttttaatatcacacgaaaatcctgttcaaaagagaaagccaaatttcacctttgcatttagtgtgctattaatgttaaacccaattcttaataaaaccttataaacaaatctgtccaatcttaattagtttgaccataatgtaaaatttccataagcctttcataacactttacaattttctgttaaagagcagatcaatactctaagaagaccttgtaattccaacacatgggcccagattctggccctgcatcagtgtgctttttttttaatgtttaatttttggaaaaactaaatagcctccttcaaattttagccaacttgctcatacccacggaacttcctttacaagatcaatctctcacaaatcttttacaacttgcttaagctctcagttttgtcctattattcttttagcttaggacaatccttaaaaacctctgaactagacaaaattgcatttcctttaacaaaaaccataattacatgccttcttataaccttttactaaaaatacattctaccttccttatacaccttgcacataaagctgtttcttcagtagtctcagttacttgttacaatgttaactctcagcaacttttatttttggtgaaaaacgcggtaagtaagcaattttaaccatgtatcaatcagattatggagccaaggacaaagacagagctgcagacaatgtctgactcttcccagcctagccagggaaactggctaactctatgtccccaggccttaactagagaatctaattggctgtaaacagacaagttaagtaattattaaaagtcatagaagcagcttatgaccttaaggcatctagaaaacagtatctgacctgcctaatttagaccaaacgtctaaacgttgaagacagttttcttttatcaataacctttaaaactaggcttatttaccaaagattactacagtcttgtgaactaaaaggcattacagtttttatttttctagaaaagtatttgatttaagcacttatttttaagccaattaattagagctcttttatataagcattacacatacaacacatatacatacacagacagaagcagatctggtagggagataaaatattagatacaagaggaagaaggattagacaggagtaaatgaagaatcagacagaattccattgactgagaagattttagagggcaagcaagggttttaaaacaatataggtacacatataacccaaatatcacctttaagttaatttctaactacaaagctctcaaaacatatgtatatatatttaaatcttttattaccagatttcagctaggacaaagggccaatatttctgacttttaattttttttaaataaaggtaacctcctacatgaaatcaataagccttaaccaagggtatgacttaactaaccttaggtgcatggggcattttcgaaaagatggcaagtgattttcaaaagctcagggaaagggaaatttcaagacaggaaatcagaagctgtccataaagggaaaaagaatcaataaatggccaaaagtcacacaaataacaaaccagaatggacctattccctaagcacctaggctgtcactgtgaaaggcaaagcctactgagctatgggatgggccacatgccactgacctttccagaaggacctagagcaatcatttatgagcttgcaaaggattttagcttctcacaagaattaaggctagacatgacattatcatgtaccctttttagacccaagagtcaaagctctgtcttaacagcacaaggacttaaaaagcaatacagaaagttacatgtataatctcttcaactccataatttgaattaacttttagataacttttgaattagtcaaaattatttttctcagtaatgagaggtgaagccagctggacttcctgggtcaagtggggacttggagaacttttctgtctagctaaaggtttgtgaatgcaccaatcagcactctgtaaaaacacaccaatcagcactctgtatctagctaaaggtttgtaaatgcaccaatcagcactctgtagaaacacaccaatcagcgctctgtgtctagctaaaggtttgtaaacacaccagtcagcactctgtaaaaatgcaccaatcagtgctctgtgtctaaaggtttgtaaatgcaccaatcagtacctgtaaaaatgcaccaatcagtgctctgtgtctagctaaaggtttgtaaacgcaccaatcagcactctgtaaaaacggaccaatcagcgctctgtaaaatggaccaatcagcaggtcgtggacggggccaaataagagaataaaagctggccacccgagccagcagcggcaacctgcttgggttcccttccatgctgtggaagctttgttctttcgctcttcacaacaaatcttgctgctgctcactctttgggtccgcacttcctttatgagctgtaacactcaccacaaaggtctgcagctacactcctgaagccagcaagaccacgaatccaccgggaggaacaaacaactccggacgcaccacttttaagagctgttaacactcactgcgaaggtctgcggcctcactcctgaagtcagcaagactacgaacccaccagaaggaagaaactccagacacatctgaacaccagaaggaacaaactccaggcacaccatctttaagaactgtaacactcaccgcgagggtccgcggcttcattcttggaagtcagcgagaccaagaacccaccggaaggaaccaattccagacacattttggcgacccagatgggactatcaactatcaccaagcagtgagtaccatcggacccctttcacttgctattctgtcctattttaccttagaattcgagggctaaagaccaggcacctgtcggccagttaaaagcgactagcatggccaccggactaaagacacaggtgtcagggtttctgggaaagggttctctaacaatccctgactctttggagttgggagcattggtttgcctggaaccagcttccacttttcctgtactgctgggctgagccaagggtcgacagaagaggaaagccattcagctccggggtcccaacaacaagttggttcaccctgtggccatgagcagaactctcaaagtcatgtcgcccaagtgagactcgcccatctatcctatctatcctgacccttgcctcctgggtcctaatgcttgtcagacaaacttcatctcacctctcttctccgaggctagtcccgcttctaaaaaccactccctgtgtctggtgcttttctagtttctcctgtaagaatgatttctagtataaactccaggactctgttaccttctttaggcacccaggctcaccaattagaaagacataatttttgcccaaagccccgtcggagcgggggactatcttatctggaattttaggatccctcctcagactagcaggcctaacaaaagctattcctgaagctaagatatggggagcctcagaaattgtatccttcctattcatataaatgaggacaagggctgatgcaagcctttgtcctcttccaactctggagatccctcccatccctcaggatatggccctccacttcatttttgggacataacatctttataggatggggtaaagtcccaatactaacaggagaatgcttaggactctaacaggttttcgagaatgcgtcgataagggccactaaatctgatatttctcggtcctctttgtggtctagcaggacaggcaagggtgcaggttttcgagaatgcatcggtaagggccactaaatccgaccttccttggtcctccttgtggtctaagaggaaaactagtgtttctgctgctgcgtcagtgagcacaactattctgatcagcagagtccagggaccactgtgggttcttgggaaagaggtgtttctgctgctgcatcggtgagcgcaactattcccatcagtagggtccagggactgttgcgggttcttgggcagggggagaaacaaacaaaccaaaaccgggggtggttttgtctttcagatgggaaacactcaggcatcaacaggctcacccttgaaatgcatcctaagccattgggaccaatttgacccgcaaaccctgaaaaagaggcagctaatttttttctgcactatggcctggtcccaatattctctctctgatggggaaaaatggccacctgagggaagtacaaattacaatactatcctgcagcttgaccttttctgtaagagggaaggcaaatggagtgaacttatgtccaagctttcttttcattgaaggagaatgcacaactatgcaaagcttgcaatttacatcccacaggaggacctctcagcttacccccatatcctagcctccctgtagctccccttcctattaatgagcctcctctaatctcccctgcccagaaggaaagaagcaaagaaatctccaaaggaccacaaacacccccaggctatcggttatgtccccttcaagctatagggggaggggaatttggcccaacccaggtacatgtccccttgtccctctctgatttaaagcagatcaaggcagacctggggaagctttcagatgatcctgataggtatacagatgtcctacagggtctagggcaaacctttgatctcacttggagagatgtcatgctattgttagatcaaaccctggcctttaatgaaaagaatgtggctttagctgcagcctgggagtttggagatacctggtatcttagtcaagtaaatgatagaatgacagccgaagaaagggacaaattgcctaccagtcagcaagccgtccccagtatggatccccactgggacctcgactcagatcatggggactggggtaataaacatctgctgacttgtgttctagaaggactaaggagaattaggaaaaagcccaagaattattcaatgatgtccaccataactcagggaaaggaagaaaatcctctgccttcctcaagtggctactggaggccttaagaaaatatactcctctgtcacccaactcacttgagggtcaattgttcctaaaggataagtttattacccaatcagccgtggatatcaggagaaagctccaaaagtgagccctgggccctgaacaaaatctggaggcattattaaacctggcaaccttggtgttctataatagggaccaacaggaacaggcccaaaaggaaaagcgagatcagagaaaggccgcagccttagtcacggccctcagacaaacaaaccttggtggttcagagaggacagaaaatggagcaggccaattgcccggtagggcttgttatcagtgtggtttacaaggacactttaaaaaagattgtcctatgagaaacaagtttccccctcacccatgtccactatgctgaggcaatcactggacggcacactgccccagaggacaaaggttctctgagacagaagcccccaaccagatgatccaacaacaggactgagggtgcccggggtaggcaccagctcagctcatatcatcgctctcactgagccccgggtatgtataaccgttgagggccaggaaattgacttcctcctggacactggtgtggctttctcagtgttaatctcctgtcctggacaactgtccttaaggtccgttaccactgaggaatcccgggacagcctgtaaccaagtatttctcccacctcctcagttgtaattgggagactttgctcttttcacatgcctttcttgttatgcctggatgtcccacacccttattagggagggatatattagccaaagctggagctattatctacatgaatatggggaacaagttacccatttgttgtcccctgcttgaggagggaatcaaccctgaagtctgggcattggaaggaacaaactccggacacaccatctttaagaactgtaacactcaccgcgagggtccacagcttcattcttgaagttagcgagaccaagaacccaccggaaggaaacaattctggacacaataagagcccatgttctttggtacattttatataaacctaggaagcaagaagtcctgaactgtgtatcgatattagcagtttatagatgagaacattccacaatttttggaacatgtttcccacacagcaacccctttttaattggaaatgacccagacatccaataagcatccaaaacaattctaagattttaaagtatacataagtctacttacaagcatttatgtcatttatatgtacccaattttcccatttctaacagtttatttagattacttctgaaaattgagatattacacaaaggtggtcattatttaaagttatttccctgttaaccattttaaagcctgtaaacattaggtgtttaagtaagaaccttaaacatatgggcattttgtcaataactcagatttagaagttaccactgaactaaaattagtctctgtcaaaaaaaatatacaaactcaccactttatggtgaaattcacactgctaagctattctttcatgagattggaacttgtttacatggctaaattttgtttgccccaatacataatccagtaaaagctgtgaacttaaattttggtaaagcactccctgtggtggcttttttttaaaaagaaacattttacccttttccccttcagtttcaagtgagtttccaatgtttacgttctagttagtccacaaataatgagtcctatctcagtaccagcagcttagtaacagcagatttaaagcaggcagaaaagaagagaaagatatagcctggcaggcctccacacagaagccaggttttacaagtggggcatgagaaagaaaggaggggaagaaggttttacgagtggggaatgagaaagaaaggaggtaaagtgactgaaaggaaacttgggagccttccagccatcacacagtgcagggtcactacccccaccattctcatttatcttccattaaagagagcctcagtaccccaagtgggaggctctcccagatagtcagaagggtgaaactggaggtagagagtaaagtgatcagggcccatacacaaagtcatacatttacacatggaaacaaacagcatgcttccgaatgaatcaccaatcaagggattgggtgaggtcctgaatcccccgccccagttccaaatggctccacaggcagctgagtccaagcccagcaaatggtcctttggtgttgcacatacaaacaaatgtaaatgtataaaatgatgaaatggtgtcactatcagccaagtctaaataaagcagggccccgcagcaccccaagagaggcagaaggtggtcaggtgcactctaactcactcactcaattccagagtttgctggcttcttcagaggtcactttctttgtacccgtgaaggattgaaagcagcagacatcatgctgggaggtgaaagggaggttcaccaagaacaaaagcctttctggcagctgctgtgaagttccctaatggtcctgtcacgggtctgctagccaagagcagctggcactcacaggcgaccccacgcctgacccagtgatgaaaccaggctgacaggcttggatcgcctagggcacacagaacttccccatatgggccaccaaaactgtaaccaaaatgcaggttcagttgcttgccacttgcatagtccaattaacaagagcgaggtctggtataaagaaagtgaccttttattcaaaacctagcttaggggaagaagtacagacttccttccttaaaagcaccgcttcacttttggagcagaaagtgcatgcttttaaaagggggcctagaataaatggcatgcaggggaggaagcaaacaggtgggtgtctgcgtgctcactttgttgcttcatctaccaggcagtcgagttggcttcttcatggacagaactaggttgtaaaggtggttgaagctctccaggcgggagagttttgtagcaggcatactttgggctgtaaattgactgttgtccttttggcagtctccttgtgggagagagttccacactggagcttctaagcacatagttagatgaaattgccttgtaggaagtgtctagtgaagtggaggtaaaaggttataattgaatttctaaagggctaagcaggaagtggggaacagggagaaaaggaaaaaacagaaaaggagtaaccaaaataaaaaataataactcattctctttttcttagaaatatgaaatactcagttacataaccatctggaagtccttaaatgttgatactactcaaagagatcttcactgtcctctctctacactctctactggatgatctcatttatatcctcttcacctactgcccatgcactgatgactccaaaatctacatctccggctcattcttctttcctaggctgcacatcagggtatctccggccttttgaacatctccaagttaatgccccttgggtaccagaaattcacatttataaaattaacctcacattcttctcaggcctgcatagggggaagaagtacaggattcctgacttaaaagtaccgcttcacttttggagcagaaagtaggtgcttttatatttttcctctattaggttccatctaagggaatggcacaccatcaactcagttgctccagccaaatattctaaaaatatatccatgatatccacacctctctctcaactccaacatccaattaatcaacttatactcctttaaatgccacatatttacatcttttttttttgagacaaagccttgcttggtcaccaaaactagagtgcagtgacacaatcatagctcactgcagcctcaaactcctgggcttaagcaatcctcctgcctcagcctcccaaattgttgggattacaggcatgagccactgtgcctggctcacatatttcttgaatgtatctacttctttcaacatagtcaataccctagttcaggtcaccatcatttctcacccggactattaccacagcctcttcttagccctttagcaaacaattttctactcttcggattgaggtcatgtctcctttcctcaaatccctgaacaagtcacatcagactctctataatctagatttttcttaccccatcagtttcatctccagaagatcctttcttttcttttatacccttacactacattctagacataatgaacaagttcttgttccccgaagcaccatattttatctgtcttccagaacctcacatttattcttccttctctgtggaataccctttcactacttttactggctaaatcctatttatcctttagatgtcaaattacatggcatttcctccaagaaactttttctcttcttcctagcctcatatagattagttccctgtactatgagctagcagagccgactgaatccccactatcataaaaaatacttagtacattttgttggaatgtataatgtctcctcaatacactgagagttccataaagacaggagctatttctgatttgctcaacccacataccctgaggtagcagaattcttggcctaaagttctgaatagctttatcacagctaaagcacagttgtaaggatggaggcactagatcagtgcaaatacttgactatttatctaccaggttaaacctagatggaaaaatacagcttaaataactcaaaattttactgattgaaacatgatgaaggccccttcttcatatattaagtactaagatttaattcagaattagaaaaaggtcaatgtaaatagtcttggacagcaagtgtttctgggaaaggtttccttgctctaaatcaaatgtaatagtaaacttttaaaaatagattttgtgtatatttaaggtatacatgttatgggatacatatagatagtgaaacagctactataatgaagcaaatcaacatatacatcatctcacagagttgcgctttcttttctgtttttgtggcaagagcagcattttttttttttttttttgagacagagtcttcatctgtcgcccaggctggagtgccttggctcactgcaagctccgcctcccgggttcacgccattctcctgcctcagcctccagagtagctgggactacaggcgcctgccaccacgcccggctaattttttctatttttagtagagacggggtttcaccgtgttagccaggatggtctcgatctcgtgacctcgtgatccgtcctcctcggcctcccaaagtgctgggattacaggcgtgagtgaccgcgttcgcccaagagcagccatttttaatggcagaatggcaacagcattctgcatacctggttatctaatcccaactttgttctgtattggaagcgtgacctgtatcattttacctaaccttgctgagactcaattttctcatctgaaatggagctaacagaacctcccctgcccccatgtgactttgagctcaaataatttatgtgaaaatagtgtaataaatttttctttaaaaatacattaggactgagctaactccttaaatgtccactagggtgcatcatgccaccactggaaccatctgctaagaatgactttgcagtctacctacatagtcttcttttaacacccaagaaatgaggtctaagtttgagtgagtagataaaagaaaaataattgttaccaactctgccctgagccctctatcccctcagcactagccccaaagtctaaactcccagaggtcttggcctgcttcttcacattgctgtgaagacttacacaggtcacagtgttaatggatcttcttggaccgtggatgggctttttggttctccatgtttaccatccggtataaaggaggaccactgaattcattataagctgttgtcatcatcttcatctaaagaacatgagcttttgagtaagataaaactgaatttccattcccaacccaccacattccagtcttttgattcatttcactgatttcaggtttatagccttaattctgggaatagaaatttgagacatctcaagtgctatttggagactgagttgagggaacaactttcccctctcctcaggtatgggaatatcagtgtccataatttgaaattgcagactctcagtttttggtagtggtaggggttggaggatggagggatttctctaggccatttggagtcagcgtgggtcagaggactagtctagcaacaaaacctacaaagtgtctgacccttcaagtatacactgtgcagtagttgtaaattgtattttttgtattacatttccctcacattatctggtaatcttcagtaaaatctcattaaaagtcacggcctagtctctgatggtgctgtaagaaattagggaagggtgtgggcacattatggggtaagaaggtagaagagggagagcaggattcccttttgagtccagagttatttaccacttggataccactgtgcccagaggagcagcaacttcatgagggtcagagcctgcagagaggcagtgatatggtggcttgctgagaagccagagaagacaaagacaactttctggaaaacaggtaaactaataaaaggcctacttttagccaatacactgcaattgtatgatttattacaagagcaccccctctgaattgatggcttgtccccagcctcagtgcttggtaagtaaaaagtctgtgtgggaattaggaaacaaaagcaaacacaaaacaggcctattccaccctgcactaagtcttggtgactagagcttggtctaaatttcagacccaagttttctgctatgctttttatacttatgcaaggcagaagcagtacaaattccattatggccctgcgcattagcctaaaaaattctaaggaatagcgagatgcctgtatggcatatacttaacaataaaaagatcatggattatttggaaatattctggatgaggcacacctgtgctatccttgtttgaattatatatatttgtaaatagaaagactggaaattatatatatttaaacttggttatctgtgtagaggaatcgtgtgatttttttacatgtaattatttaaatttttatttttaatttttttgagtacatagtaggtatatatatgtatggggtatatgggatattgataaaggcatacaatgtgtaataatcacatcaggataaaaggtgcatccatcaccacaagcatttatcctgtgttacatgcaatccaattatacttttagtcattttttaacgtacaatgaaattattgaccatagtcaccctgttgtgctatcaaatactagatcttattcattttttatttattattttggaattttaaaaattttctgaaattgagatgaattaattttgtagtcagaaaaaacaaattcagtgcccttttttaaaaaggtaaatagtagaatgagtgtcccaactggaacctaaacttatgtccaccactagggtttaaagttttccggtaatgtgtgacatactgaaggggataaagtcctttggcatgtagaactgggggctttgcaaggaaaaattcacactaacggaagagcagtctgcaaacaagtttagctcaagaacaaaagctaggttttcggagaggaggaatcaatctttctgggctgtggatctgtcttctgatcagccttctgcacttaagtctaggagagagggggcctacaagtaaactctgaagaatacttttttcaatttttattatggaaaatttcaaacatatacaaaagtatagagaatagtataatgaactctcaaacatccatcacacagcttcagcaattaccaatttatggccaatcttgtttcatctatgtactcaattaccccacactcagatgattttgaagcgaataccagtaacatatcatttcacctgtacatttttcagtatacttctctaaaagataatcattttttaaaacaacataaccacagtaccatatcacatcttaaaaaacaataaatcaagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatggcaaactccgtaagatttcttctaaacatctttgttattttcttaaaattgttctggaggcagctgatgcaagtcctcttttttaaaaaaaccttcactttgtgttcccctctaatagcagcctctttcctaaatgccttttctaaatgacaacaattttgccctctctcagccctctgcattctcatatgcagaaaccaggtaggatgaggagctagctgtgtgtactggaaaagggatgaaaactacagccaaatggatcagtgagagaggcaaaagaaatctagacaaactaaatggcataattaagtttggaaactgcctatgatatagcctgttggctctggcatcaaataatacagtatgttaaatctgtaaaatgaggaaacagtgtttcctcaaagagatgttaagatgacatgtaagaagtggttagggcaggcattgcaaaaaaatgtcttatatatcattttaaaatttatttttataaaaactcacaacattattttgcgtccactgtatttatttttacaattacctttatagcaagtgatagtttttgaataaaatttaagcaaatcatcaacagtacaaaaacactagagttgttacacgaaggactgattctacaaaacattaccctaggtgatggcataatcttaaaactgtgcagctactgtgtggtatgacatagaaataggagtaataattcttgtcctcaaacatcttacaactgtcttgaaatatttctgaaacacctgatacacaaaagccacacacatggtgcctagatagcatatactctactagcaccagattggaaggggaatgttttgccacacggtgattacaaaatattaattgaatcaaagaaccttcagtgatgccaaccatatttcaagtagtgtctcagatgcagaatatgcaaagagtaaggaaaaatagtctttgctctcaaagacatcatagtctaatgaaggcagacacatcaaaaaagcacaacaaaaggctataggtgctgaattaagagtctattcacgtataagagtacaacaaccagagcaagagtcagtggtatagacagggaaggagtgtcccaagatgcaggaagaaaccagatgagctgtcttcttgggaacacagaagtgctcacctgtacttgacaattccactgatcactgggttcacatcaatgtttctttcagcacaatactgaacatctttgctgttcatctggaaaaacaaaccaacacacaattagcaggcttatgttaataattcctccaactgacaaatgtaccaagagcttattatgtacatcaatcactttgcatcaagcacttcacttccacagaattatctaatgcagatgcaatcaatgagtctggatcagcaactgaggggttataagccaatgtataccatgatgtaaaaaagtcaggaaagcagcgatatcagaagttttgtaaaagaggagtgaccatttaagacataaaatatcctaaattccatgttacagactctagactcatggaaataattcaggctgattcccacccacgaaagagttttcagtccagtgaccacatggccaagaaaacagattaagtacaataaactctgcgaaccatgacacagaagagggtttcttaacccaggtggtcaggaaaggcttctcattggagatgtttgtaaagtgtctatttttactatctccaacaacagattttttttttaaactgagcgtcagatagttagataacttggcttaagtttcagtgaggaagaactggaactagatctgtctgacttcaaacccccaatgtagtttctatcacatcatgcgctcactctttttttttttttttgagacgtagtctcactctgtcgcccaggctggagtgatcttggctcactgcaacctctgcctcctggtttcacgagattgtcctgcttcaacctcccaaatagaaggtattacaggcacgtgccaccatgcctggctgatttttgtagttttacttcattaataattagaagtagagttggggtttcgccatattggccaggctggtctccaactcctgacctcaagtgatctgcccacctcgacctcccaaagtactgggattacaggtgtgagccaccatgcccagcccatgctctcttattcttataaaagtgttatgttttagcacagtcagcatagtaacttccacttcttatagtgctgtttgcccaaacatatttaaaatctgctaaataccattagtattaatagctatcttatcaagagaccactaccaggaaaatattgtttaaagtctttcagagagtacctggtggctcccccacaagggaattctagaggtgaaagctctgccaggcaaatacacattttctaactgtaaacaaattggcattcttatactaaccttctgaaatgaaatcacagaaagaatttaaaacctttacatcaattgttgcaaatgaatctatgcaaataaagcaacaaaattattttcgagtttcttccctttagtttgtttctttaaagtgtagtcaacagattttgtatctaaacacacacatacttcttgagaaaaactgtatatattatagacacagcaccaattgtttccagtatatgcatctatattaatgtttcctctttatatattcacaagaataaaacacttgaccagctgaaaatgtaagctatttataaaacatgcagaaaataaatctgattcatgtctgcaaacctcaattgtctgtgtactctttttcctttctttatcaagacagggctgtaaaatttaggtgtacatttttctgctatcacaaaagaaataatgtacaagtgaactctactactcttagaaggaaaaaaatctcaactatacatcaaattttggagcactgaagtggcagaaattttctatatactacctctgttctaaagaaatgtggtgccactgttccgaaaacaaatcttataacacatttaagtataggtaaacaaagtacaaatctcagtttttcaaaacattttctgtactaatgcttttaacttgaaactcttgacttagttttgaagagaaaaaaagaatctccttggcgctcttaactattctgatgagactaagttccagagaatattttacaaaaactacttaatttaacagtacgccttgaaaagtaacactacatattctaagtgtttctggaaaaaaaaaaagaaaaggaaaaaccacgacatatttataagctaacaattcttaagagagggttactatgaatgctgtacattaatttttactttgtcagatacataacttaagaaccaaataagatgatgcataattacttctaatgatagaaagtacgagttaagtctccaaagtaatcgtgacagtgtttcatgtggaacacatttcatctacaaaaatatccataaaatacaatctagtatacctcctaggtcaatattaatgtagaaacaagaaccttctgtaataattaggttattgaggaaaatcttaagatccattttagactgaataattaagtcaaattgtttggaatttaaaatatgtgcttcatgatgatgaaataatctgtacaacaaataaccatgacataagtttacctgcggaacaaatctgcacttgtacccctggaattaaaagttacaaaatattttttaaaatatgtggttcaaatatatatattcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggtcacctgcacctagaatagggtgtcctgtgagacaaaacaattattctctatcgttaagagagattgttcaggaatcctaatagtttgacaattctgtaccagctgaacatcactagagctaactcagttgggatgtaatcaccataaaagattccattcctgtggttactgggagtcagggaggtttaagcggaatgtcactacattcaaatatgggagggagaccactttcaaaaacgaacttaaatccagagaaccatggttcttctatggtatccagtaaggggcaatgggagttggaagttgagtatgggaaatcaaattctgtgaatacggtttttctgataagatgtgtttggctagcagatcctccgcagcatctattcaataaggttaatctacatgggaaatagccatttgaagtcagcagtgaaaaattaccacttgtgaaaattttttgaaaaccaaatgatctacatatagaaacagaaaaagaaatttctgaaaggggcaaatgagatcccatttcagaagctaaagtgactgtagagtgcagaaagagcacaacatgtaggatttcccaatttttaaaaaaattcaaaactgatcttttaaaccaactcccaccacagaaggcctccctgacaacaagggcgaacgctgtgaaggagaaaactaaaggggaaaaagaatactaaaagatgccacacaaccaagctggtcagactttaaaggcctccactaccaaacaaaccacaaggctggtatcaaaaatgcgcacgcacgctcacccacgaatatgtgtgaaatataaaagaaccaaaaacatcacagggcgcacaggcagacacacactccacacacaatccccacccacccctcgccccccacacacacctcccaaaagcagggtgaacagttaaggcacctaaaaccccaagccgcataggcttccccgaaacattttacagtgtaaccaagaagcgattttgaaagcatctgaaaaacgtgcaaactgtcttgaaaacagggcctggcaactgagacagtttgcaagcgtgattcagagggtctgccaaggaaacaaaagaagcctccctcctccccgtgagaccgcacatggcacgagaggtgctccaggcgggacgcattttaagcgaggcagacaaatagaagtctgcgcgagcgcaagcggtacatactagggatcgctatctggcgaggatggggccatggagtttccattggttggggaaccgcccagctttagtttctccagatattcggcgtgcacgggcttgtggcactggagaaccttgatggcatcttcgactttgaaccactctcgcttcctcccaatgctaaccgaatcttcccaatcctccagcagctccgtgacagtcagtacatacacgtacgttctgtgcttgcgatcctggttctgttcgaagacgcccaggagccggcctaacttccccttgactcccgcttcttcgtacacctctcggaccgccgcaccgcccggctcctcctcgggctccatgcccccgcccggcacgatccagcggtccgggtaccggctgctactcactaacaggacctcgtcctcgcgttcgctccggaagcacaggcacgccgcccgcttcttgaacccctcggggtcgtaggtccgcgtctggttgggtttgcacttcatcctcgaggcagcctcctcgaggcagcctcctctcgcctctcgctgctgtgtgggccgccgctgccgctgccgccgccggggaacagccgaggtgctgggaagagaaagggccgaggcgaggggcggggaaagagaggcgcctccgtctgcccgcgagcccggggagcggagggagagatgaagctgggcggggcgcaggcggaggcgggggcagcgaggcgcgtcagccagtcggccagtccgatgggcggccggccgaacccgggcccgccggagtggaggaggtgccgccgcccgcgagcccgcgactgtccacagaccccactcgcttgtcgggggcgcgtctccctccctccgccgccgggtagggtttgagcgaggtgaggcgcattaacggacgcgtccgcgctcccgttcacgtgcgcgttcgcggcggagggcgaggggcgggggcgggggtctcctggctcccgcagcgcgcgacgcctcgggcccactgcgcaggcgccccgcacccctgggggccgagaacgtcgttcgcgcactgtgaaatacaccgcattgtgactttggccgactgcctccacgtgtgcctttgacccaaacgcgactgtagcgcggcaggacgtttctcctctccctccccaccgcgctgcacgaaacccacacgcagccgttttacacacgacagaggcaagggcatcgtcgtcatcatcctcccccacgatgaaccattctggcttactcatgggacctgggccccggtgttgtcaaaacgacccacgggattcttggcagaatagccgcgcatccttgctgagtcacatgatgcagttttatttcttcaacaggttcccaccttgccgagcatcctggcgcagctagtaatttaacgcttttcttaaacccctgttcacaacctgcctgacccctttgtgtctcagtttcctcatgggtacacttctcgcctccttgttgcagccatttgcacttcgatgcagtacaccttaaagaccagagcaccacccatctagtattcctgcgttaaagcccaagacattctctcattctccacacactccacccttgtctttctctttgataagcaccacttgggggttgggaaaccattcacgtggagatcccctcctattccacactttgatttttatttatttttatttattttattttttatttttttatggcaagaaacatttattattattattatactttaagttttagggtacatgtgcacaatgtgcaggttagttacatatgtatacatgtgccatgctggtgcgctgcacccactaactcgtcatctagcattaggtatatctcccaatgctatccctcattaaagactcaaacgttagacctaaaaccataaaaaccctagaagaaaacctaggcattaccattcaggacataggcatgggcaaggacttcatgtctaaaacaccaaaagcaatggcaacaaaagccaaaattgacaaatggaatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaacttacaagaaaaaaacaaacaaccccatcaaaaagtgggcgaaggacatgaacagacacttctcaaaagaagacatttatgcagccaaaaaacacatgaaaacgtgctcaccatcactggccatcagagaaatgcaaatcaaaaccacaatgaggtaccatctcacaccagttagaatggcaatcattaaaaagtcaggaaacaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcccatatacaccatggaatactatgcagccataaaaaatgatgaattcatgtcctttgtagggacatggatgaaattggaaatcatcattctcagtaaactatcgcaagaacaaaaaaccaaacaccgcatgttctcactcgtaggtgggaattgaataatgagaacacatggacacaggaaggggaacatcacactctgggtacactttgatttttaaaagactcccgccgtgagactcccgcaaggtcacttgctgctctctcacctctctctctggtcctcctgtcctcttggccaggaaatggcatcccatcgccaaaaatttaacaacctggagccttctttcttcttatttattcttggtgtttcctcatctcatagtagccgtagagagaagaaccctgaggtcccctgattttggttgcacctttgtctctctcttactggcactctgttggcatcagccaaggggggatcatgaaagcctccttcgtttgttgatgaaatatttcctttatctaggggaaatggactcatatggaaatggagagtagtcgtgagacatacagtccaattttcaaataacagtttagttcactttcccaggatctgctcaactccacttatacccagaatcacaaataaaaatgatcctgttcccaagcacaagcaatatctgcactaacctagaccgtaatatgacaaaacgctgcgggtcatatattaacaaaattataaaatacagacataaaaagagtgacctcgatagagacactaccgctcctgaccatattttaaagatggatggacaatggaagagcatttgaaggaattcaacacttgggattaaaaacaaactaagaggctgggcgccgtggctcacgcctgtaatcccaacactttcggaggccaaggcgggcagatcacctgaggtcgggagttccggaccagcctgaccaacgtggagaaacccagtctctactaaaaatacaaagttagccaggcgtggtggcacatgcctgtaatcccagctactcgggaggctgaggcaggagaatcgcttgaacccgggaggcggaggttgcagtgagccgagatcgcgccattgccctccagcctgggtaacaggagcgaaactccatctcaaaaaacaaacaaacaaacaaaaaactaagaaagtatacttaacaggcaatatttctcagggttctcaaattcacaaacacacaaatgatgttaaacaactagggaaaactgcattacaatcaggagcaagacaagtctgcctactatcaaaaatgttattaagtattgtcttacaatttctttctagtggaatgagttgtaaagagaaaaaaatctgatatatgttggtaaaaacacaaagttgtcattatttgtagatgatgtggatatcttcttgggaaacagctaagaaaaaatgtaaaaataaatccctgtaaataaaaaaataaaatattatgatttaaaatatcagaagctttcatgcataccagcaataatcatgtaggaatttaaatgggaaatgatgacatccaacttggcactatcaaccaccacaaaacaaataaaataccaagggatcctaaaaaatatttaggacttggtagtacaaaatgtttgaacttctcagagctttgaaacatgatttgaataaatcacgagtcactctagcaaagctagcagactggtgtggtgtctgggggtgggaggggccaatccaggctccggccacagggcagggctgcttcacaattgccaggtactatctcctttgtctcacaagaatgaggtgccattttctagtctattccatcagtatcagttctacatcacaccgtgcctctgcaataggtcccttctgggggcatacttgtggcagggaagaggaataggacattataacatggaaagaggcacagaccgaaaccctactgggaaagtctggatatggagacccacaacttaaaacaggcttaatacaatagcaaggcaatgttttaattaccttttccccaaactttcacagctgacatagtttggatacttgtcctcgcccaaatctcatgttaaattgtaatccccaatggtggaagtgggacctggtgggagatgtttggatcatgagggcggatccctcatggcttggtgctgtctgtgtgatagtgagtgctcataagatctggtcacttaaaagtgcgtggcatcttcccctgtcttgctcatgctttcaccatgtgacgcaccttctccctctctgccttctgccaccattgtaagcttcctgaggccactccagaagctgagcagctgttggcaccatgcttcccgtaaagcctgcagaaccatgagccaattaaacctcttttctttataaattacccagtctcaggtatttctttataacaatgcaagaacagcctaataactttattattcatctataatattatagtaataggtcaagaaaagctaagacttgtaacaagagtaaaaatcctttttaagagaacagcattccactgtctggttttgcatatttaagtatttctccaatgatgaagagtgtaatttaggaatcactgtagtagtagactgttaaagtgaaactgcaatttgttcgtggaagcctatatctccttccacattgttgttgtatctggtcttggccatgtaatttgtggtgtccagtgggacaataacaaatgtgaacagaagccagcagagaattgaaaagtgctttcacactggggtgtcccctctcattttgcgcttaaaacattgtgacagcaatgtgaagaaggtggggctagctggatgatgagatacctgtggcagattcttccctttcaccccagctgacagtgaacccattgcccaacatatgggtgaggccatcctagaccattcggcccctagcagaactacttaggtcataacagggcgctagctgaagatgcataactaagcctagccatgaacagcaaaaaaaaaaaaaaaaaaaaaaaaaccactcagatgagatcagctgaaattactgacctgaagaattgttaacagaataatttactgttgtgtaaagcataaaatttgggggtgctttgttatgcattaaaaactagcagctccaaccattgacaccatccatcaaaatcaaccaaaagcaatcagagaaaaaaaaggttgttcgttgtagaaatgtaacgtctacttaaagatgctggcatttcactttctctggagtcagaaagaaagggatgaggttaagatatctaacatgtgttgagtacagtgcctgtgacagtccctgtgttattccctgcatcctatttaactgttatcccattaactcttagggagggaggcagttcatatgtccattttatagatgagaaaatgaggatttagagtggagtttgtatttgagctcaaggcttcgtgtctccataccctgcacactcacaacatcaacatgtcttataagaaggattattattatccacagctatggtttgttatggacttcattgataacattcagcattgacctattgggtaaggtattcagtagctaagagtcactgactccagtgaaaggtatcttccatcatgatgttcttcttctggacaataagtgaaaagagcatgtgagtacctctctcactcccagcaaataatatttgtgtcgcctccacatgttactttacgatttgaagctttgatttcccctgcaagataaaatgcaatgaagtgatacagaaaagaagacattctatgctgtcatcacactaggccatgatgttgatttatggatggtctgctttcttacatgcacttaatatttttgtataaacaaacctgaaaggtatcaaaatcccctttaacagattaacaggctgagatgggttaaagtgagcaagccgggaagtggtggagctgggatccacaccctggtctgtcttgagtccaagggtaatcgtcttgcattcactatggcatgtttcccttacgttaagagttgctgacatagacagtgcatgtcattccttttggtgtggccttcctcctttctagcttttttctgcctggaaaatccaggcacgcaagataatggagcttccatgtaaatttccagaatccctagaataaaagcggagaggatctaccctgaaaccaacaagtctaggatacacatttctgcctttttttcagaattaggaaggggcaggcagatgggcaattgacaggaatagtagaagcatcctcagggaagttgggtgctttacttagtgagaaagccatgccggctgacatttctaactgagtcttaagtggagtacagtcctaagagaggagctctccagaaacagctattacctggggtcaggaatgttaaagaccttctcagaggttgactctactcacagctggacccagctatcaggaaagggactgcaacatacctgagaagctttcagaatacttaaaggatgcagagccagaggaagtgattttggtagtagtccatgagaaaaaaatatggtgttttaaaatgcaaatgaactaaaatttaaatcctgctctctcagtagctatgcagccttaggcgagttaatatctttgaccttaatatttctcaggcgtaaagggggataataggactacctactcagaacctcacctctcccaagaaaggtttcctgaccatgtgctggcccaacctttacactgggattaaggtactcccctctgtttttccaggcttccttgactttaattctgtcatagctctaatttaggagttctgtaatgatctgtctgcaagctcgtgaggaactgtaggactaggaaccagcctgaaacatgtctgttcccctctgagtcaacacagtgcctgggatctgttgtccaatagggatttaaaacatattgattgaatgagaaatgatgacaggatctacatggatcacaaaggatagttgttattttacctgttaactatttaatagtgatattaaatgaaatatgaatgaacctaggaccagggaaggtggggtaagttgtgtctttcacatcaaccttcgtatgttccctaatgttttcttccttcatgtacctaggacactcttgtttaaatacaaaggtggttttattttgggtctatactagctagttccctagaaaggtcttaaatacaaaatgaatggaatacaaaataacctcccttattgttttgtttgtttcctggacaaatgacgggatgcatacagaactgctacttttatgattttgtgagtaatggtatagatgtgcacaggtcatggatgtggccccagtgatccatggaattgtgaagtccaggcgagtcctgcctctctcgtaatgatgcagcatgccttgatttctcccacttctttgctcactacctgatcctgtctcactgatgtcaccttccttttccctttaccctaccttgcagagacttctaattcagaaaccaaaccctttctagtggccctgtgtttatgcatcagagtaaaatgttaaatgcttccaaaacctatgaggccctacaacatctggcccatttcctctttgactttgtccctaccagtccccatgagccacacatctctagcagacctggactctgcagcttctgggttgtgtcaggcaggctccttccctcctcagggcctttgctctagccattccctctgtttggaatgctcctctgccatgtctacagagataacctcctcacccaccttgaggccttgatcacttctcaccttctggatgaggcctaccaaggccaccttatgatagattgttaaacccactcttccttgccaccctgttgctgatacttctgatccccttttccttggccgaagtttcctttctgttatagcattttgcatctaacagactatgtaattacttagtgatgtttattgcggttctctctcttagccgatgatggcttctgctagagtattagctcctgatggtagggatctttgtatcttgcaagcagcccagatctctgctgagcatacactggagtcactcagaaaatatctatggatgtaatgaatgtgtttgtgtcctgtgctagatgggagacttgtgagggaaagggccatgttttgttggtctttgtgaacccaccatccacactctctgatacaaccaaaagggctatagtgaatagtgtttgaattaattaatcttttgaaaatgacactgatagggaaaacattctctttgcaatctccagctattccagtagctgccatttgtttctgcaccatgtaggtaccagatgccatagaaacacagctgggcagccgtgagatacctgagggccagaagtctgattcattttccatggcctcttcacagggtagcacagttcctactacagagcatgacttgaggtgctgttttcagatctcagtcattcatcacctaaatggttttggttttatctgggcaggacttgtactatgatttacatattgtattttattttcataagacagtggctttcagaaagaaacatgattatataattaaatgctatgaaagcagaacgatgttatgaaaaagttgaaaataaagtggaagctattgttgtgtagtaggacacgtaactatggatgggctgcactaggcactgcatgtacctttttcatttaaccctaataaaagcccttcaaaggcaatgttgtcattcccattttcacaagggagaagattgagatttaaggccttatgtaacttggccagtatctgacagctaggaggtatctgaatgaggtggaatcttccaggctcattgatgagaacaccccacaaagatggcagtataggcagagccccaccacttaacttgcccctggagttctctctgctcccctccccgtttctcatgcacacatctctgcaacattttcctcccacctcctaacactttcagaagctcctcatcctagaagttgttctcctgctccttcggtcaagtgctggaaatttcaacactaatttctgcagaggcagaagaatggagtttgtttcaagtccttgtgaagggataaaatgattggtacttacagctgcttcaaggtcctgttgaagctggatctggaggaggatcttttatgcacagctagtccctgcgtgagagaattccggtcttggaaggatgccttcccctccacaaagacatcaggctagcccacaagggaagatagtttacttaccaataacactgtgtacccacaggctcaggccacttttgtcagaagcagaacaggctttccaaggtcaccacgctgtactaaaacttcacctaatcattagagaaagacaacatggcacatacacgtgatgtttggtatcaaaattgtgatcaggaagatggctgcattccctgttccatagtaaaacataatataccaccaatgaaatcagccagttctggagagattaccacatgatagagtgtttctgaccatgggctctgggccagacattctctgggagtgcaagatgggaaaaaatatttccttttttcaatcttttccaggttatctatttcaaggcaagtttgaaaatcaatagttctgttagcagttttcctacactacaatagtatatcctacaagtgaaagctatcacattcttagattctttcgctttagctttgatcaattagcttttactaccagcctacatctcagaaggaagcatctttgatttttgtgtcagatgaacttctctttgtgtaggattcacaaaattctaattaagaaattatattgggggaatgcggtttctcttaactacaatatcagaatatataataattgctgtttcagggcccaccatgtatgaggtgcttgacatatcttactgatagttttcttaaaatccctgtgacataagtttctttcttccagtttcacagatgaggaaatttaggctcagaggggtagattacttgtccctgttcacatggctaggaagtgcagagctgggatttaagaggcatgcatcacaatccattgcctacactggtcagcagtatccccacattttacacagtcttggaaagaaatccctgtgtctctgaaagccactaatataaattttaaaatttcatactgctgttacgtcatccctctattttagaggttgactcatgacaaatgctatttttcttttcctgtgaaatatttagtttacaacattatatttgagggtggcagatttgaaaaggtatatatatgaataagttaagtaatgttgatttacccctttttgtgtgctgaaaagtatgctattcactgtgtagaggcccatggacaaatgaatctgctttctagtcctgcgacacctaccagcttctagaagactttgcatggctcttgatacacaaaagccactttcctatgtggaaagcaaccagtgtactgcctccaatttggaagtgggtgtttttgctatcagtgtttcagtatgaaatgtattcattcagtaaaccttctgcaatgcctatatgtttatgtagtgtaactgattgatagagcatatgtaaagaccaagtaaaaactggttcttagccaggcgccgtggctcatgcctgtaatcccagcactttgggaggccgaggtgggcagatcacaatgtcagaagttcgagaccagcctggccaacatggtgaaaccccgtctctaccaaaaatacaaaatacaaaaattggccagctgtggtggcgagtgcctatagtcccagctactggggaggctgaggcaggagaattgcttgaaactggaaagtggaggttgcaggagccgagatcatgctactgcactccagcctgggcaacaagagctaaactccatctcaaaaaaaaaaattggttcttattcataaccaactcctaggaaaacaaaacaaacaaaaagaatgtaaattcttagctatactctgcacagggcgtatttccagtgaaagaggggaaaagagggagaggagataaaaaatttgatggagcaagagtagaggaaataggagcaggactcacatctggaggaatgaatccttgtgactatgaacatgcatgtctgtgcttgaaaatgctgttatttgtgagttcagaggcgtgatttcatattccggcatgtttatgcctttcacccaaacatttaaataattggattagcaatcttatattcattcattaatctccccagttaatttatttttaatcaatcactttttacttgtaaagcctaggggaatttctaaattaatcccactgtgaggacatttcagaaactgagagattattagaaaggcatcaattatgaagccaggaattcagcaatacactggtactaaaagctattgaccaatgggagctaggttaaaacaaagtccccatgtttcatgcattgtggtaggctctgggtttgataggaacatttaggaactttgcaggtgtctcatgcagaaaatcatgcaggcatatcttaaccccactgccagtggtctgtaaagatttgtcacagttatttatccgggaggtgttttacactcacacacccacacatgcacgtacacacacacacacacacacacatctcttataaattagaatcctggaatgctgattgagtcacagagctagctggtgttggagactctaaagcctcaaagaatgtctatcatacgagttttctataataagttatttagtttaattcaaagccactgcctgccactcccctggctttgcttgtctgttgtggccccacaggagaatcctggaactgaaatctctgcctcatttaaagggcagggacagaaggggcagccccagcatctgagcccttcacactgagaatgacaccgtcttacctggaagtgtcctccattgttgctgtcacacttgaagctgcctgttctcacagctacattgtaatcagtcttccctacacaatatttagcattctcaccactgtgcgtttagctatacctactttaatttgcaccttagagctacgtaggttatggctgagccaaaaatgattcttcatcttctgcagtggtttagataacgcagtgcatcattttagccacaatagatttcatatagtaataacttaaatacctgtatattcgttttctattgctgcataaaaaattaccacacacttagtggcttaaaacagcacacatttatcacttcccagtttccataagtctgccgtggatcaactgtgttctctgcctagggctttacaaggctgaaatcaagttgtcgttctcacagacacacccaggatcatgtttgctcaaatgtctgggcaccccatggcccagtcatgctgacacataaaattaaccataacaccaagcgtcttgacacactttgtaaattaaccattatattttaattccctttgtatcttagttaaatgatctatttccctggtttcatacctataaaatggagctgtgaataattttactttgttagttgcatgtttattaattaattttaaggttatatgtgttagtaggcaaaaacggttaatcaggaagtttatgttttttactacaaaagggaatttttatcaggtggcatgcagacttttaatatttatgaaattttaccacatagcaagttcttctataagctctttaaacgctttacctcatttgattcagcaacacaccataagtacctttgttatccctatgttcataggaagacatttcatatgagacacagaggctaagtaatttatcctagatgacatcttataagtggcaggcccaggattggaatctatggttgtagaaccagtcttcctatccaattattgtgaccacataatttattattcaaaatatatgaaagagagcaatattaaaattatgcctccacaattggcatacaacagaaaagttagacatatcaagccaattgctcactccgtgacagtttttttgcttacacatgacagaaaaatcttacttagactggctaattcaaaaagcaagttcataatctcacagcatttgtaacaccctcatgacatgactttttctcgctctactatgttattcctgtcagcatacacactggtgttatttttcccttgttaaaaaaatgcaagcaccaaaaacctgtttacttcactccttttacttgcttagtgctatttatctgttcccctattgcaagcttcccacagagtgtcatctacggtccaatactgtgtccaatatctctctttctattctctcttaatgatacttcagccaggcctacgcagcttccactaaacagaaactgttcttctcaaggtaaccatgacagagagattttgtcaccaccaggcctcccttacaagagctcctgaaggaagcactaaacatggaaaggaacaaccagtaccagccactgcaaaaacatgccaaattgtaaagaccatctatgctagggagaaactgcatcaactaacaaacaaaataaccagctaacatcataatgataggatcaaattcacacataacaatattaaccttaaacgtaaatgggttaaatgctccaattaaaagacacagactggcaaattggataaacagtcaagacctatctgtgtgctatatacaggagacccatctcacgtgcagagacacatagaggctcaaaataaagggatggaggaagatctaccaagcaaatggaaaatgaaaaaaaagcaggggttgcaatcctagtctctgataaaacagactttaaaccaacaaagatcagaagagacaaggccattacataatggcaaaaggatcaattcaacaagaagagctaactatcctaaatatatatgcacccaatacaggagcacccagattcataaagcaagtccttagagatctacaaagagacttagactcccacacaataatgatgggagactttaacaccccactgtcaatattagacagatcaatgagacagaaagttaacaaggatacccaggaattgaactcagctctgcaccaagcggacctaataggcatctacagaactctccatcccagatcaacagaatgtacattcttctcagcaccacaccgcacttattccaaaattgaccacatagttggaagtaaagcactcctcagcaaatgtaaaagaacagaaattatgacaccaatatttctaaatcgagtggctatttcacagtcttctccttaactgacctatttatacttttggatagagttaggccaggcgcagtggctcatacctgtaatcccagcactttgggaggccgaggcaggtggatcacctgaggtcaggatttcgaggccagcctgggcaacatgacgaaaccctgtctctactaaaaatacaaaaattagctgggcgtgttggcggacgcctgtaatcccagctactctggaggctgaggtaggagaatcacttgaacccgggaggtggaggttgctgtgagctgagactatgccattgcattccagcctgggcagcaagagcgaaactctgtttcaaaaaaaaaaaaaatttgatagagttgataactccctctactcggaagtcctttctttgctgagttccagtaaaatactctcttggtttttctgtgacctcattagctgtaactcctgagtccccttggctgattctcttcctttcctcatgacctcttgacattgaagtgcctcagaagtcaatccttggtctctctctcttctctgcctacactcattaccttggtgatcttttccagtattgtggtgtcttatgtgatctacactctcatcactgtccagtttagatagctgacctagattccacagtctatttccaattacccacctggcaagtacacatgcatgttaaataaacattttgattttaactgtgtaaaaattggatttatttcattcccctgatttcatctactttcattctttctcatctcagttaaagttaacattatcttttcagatgctcgcttagaaacagtggtgtcaatcttggcattaaattcatccagaaatactgttgggcctgcattctaaatatattgagaatgtgagcaattttgcccccctaccacttcattgtaagccactacaatttcttgcctggatggcaataacatttttactggttcatctccctgtacctttgtttctaatgattagtctcatcccagcagccagaggtatccttttgaaacctatgttggatcatgccactcctctgtcattgttctccatctcattgagagagaaaaaaatatcaaaccatttgcatgggcttcaagttcctatgtgatctgatactctgttacttctctaaaatccaacaactcccccactagatcccactacatcaaccctacctataaaaatcatactttcaactaaagactttttactggctgtactctctgcctgttattcttcctccacatacttaatagctcgttccatcaacttcattagattttgctgaaatatcacattgtgagggagccctatcctctgcaacgtccagccctatccaacttctcaaccttccagatctttcttttttttttaattttttattgtttttttttttttaagttttagctgtatcttatttatttatgtattattattatactttaagttttagggtacatgtgcacaatgtgcaggttagttacatatgtatacatgtgccatgctggtgcgctgcacccactaactcgtcatctagcattaggtatatctcccaatgctatccctccccccttccccccaccccacaacagtctccagagtgtgatgttccccttcctgtgtccatgtgttctcattgttcaattcccacctatgagtgagaatatgcggtgtttggttgttagttcttgcgatagtttactgagaatgatgatttccagtttcatccatgtccctacaaaggacatgaactcatcattttttatggctgcatagtattccatggtgtgtatgtgctacattttcttaatccagtctatcattgttggacatttgggttggttccaagtctttgctattgtgaataatgccgcaataaacatacgcgtgcatgtgtctttatagcagcatgatttatagtcctttgggtatatatccagtaatgggatggctgggtcaaatggtatttctagttctagatccctgaggaatcgccacactgacttccacaatggttgaactagtttccagtcccaccaacagtgtaaaagtgttcctatttctccacatcctctccagcacctattgtttcctgactttttaatgattgcccttctaactgatgtgagatggtatgtcattgtggttttgatttgcatttctctgatggccagtgatggtgagcatgttttcatgtgtttttttggctgcataaatgtcttcttttgagaagtatctgttcatgtccttcgcccactttttgatggggttgtttggttttttcgtgtaaatttgtttgagttcattgtagattctggatattagccctttgtcagatgagtaggttgcaaaaattttttcccattctgtaggttgcctgttcactctgatggtggtttcttttgctgtgcagaagctctttagtttatttagatcccatttgtcaatttgggcttttgttgccattgcttttggtgttttagacatgaagttcttgcccatgcctatgtcctgaatggtaatgcctaggtattcttctagggtttttagggttttaggtctaacgtttaagtctttaatccatcttgaattgatttttgtataaggcgtaaggaagggatccattttcagctttctacatatggctagccagttttcccagcaccattttttaaatagggaatcgttttcccatttcttgtttttctcaggtttgtcaaagatcagataggtgtagatatgcagcgttctttctgaggactctgttctgttccattgatctatatctctgttttggtaccagtaccatgctgtattggttactgtagctttgtagtatagtttgaagtcaggtagtgtcatgcctccagctttgttcttttggctcaggattgacttggcaatgcggactcttctttggttccatatgaattttaaagtagttttttccaattctgtgaagaaagtcattggtagcttgatggggatggcatggaatctgtaaattaccttggccagtatggccattttcacgatattgattcttcctacccatgagcatggaatgttcttccatttgtttgtgtcctcttttatttcattgagcagtggtttgtagttctccttgaagaggtccttcacgtcccttgtaagttggatccctaggtatttcattctctttgaagcaattgtgaatgggagttcactcatgatttgactctctgtttgtctgttgttggtgtataagaatgattgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattaaatacactttatttccttctcctgcctaattgctgtggccagaacttccaactctatgttgaataggagtggtgagagagggcatctctgtcttgtgccagttttcaaagcgaatgcttctagtttttgcccattcagtatgataatggctgtgggtttgtcatagatagctcctattgttttgaaatacgtcccatcaatacctaatttattgagagtttttagcatgaagagttgttgaattttgtcaaaggccttttctgcatctattgagataaccatgtggttttcgtctttggttctgtttatatgctggattacatttattgatttgcatatattgaaccagccttgcatcccagggatgaagcccacttgatcatggtggataagcttattgatgtgctgctggattcggtttgcagtattttattgaggatttttgcatcaatgttcatcaaggatattggcctaaaattctcttatgtggttgtgtctctgcccagctttggtatcaggatgatgctggcctcataaaatgagttagggaggattccctctttttctattgattggaatagtttcagaaggaatggtaccagttcctccttgtacctctggtagaattcggctgtaaatccatctggtcctggactcttcttggttggtaagctgctgattattgccacaatttcagatcctgttattggtctattcagagattcaacttcttcctggtttagtcttgggagggtgtatgtgtcgaggaatttatcaatttcttctagattttctagtttatttgcatagaggtgtttgtagtattctctgatggtagtttgtatttctgtgggattggtggtgatatcccctttatcattttttattgcgtctatttgattcttctctctttttttctttattagtcttgctagtggtttatcaattttgttgatcctttcaaaaaaccagctcctggattcattaattttttgaagggttttttgtgtctgtatttccttcagttctgctctgattttagttatttcttgccttctgctagcgtttgaatgtgtttgctcttgcttttcaagttcttttaattgtgatgttagggtgtcaattctggatctttcctactttctcttgtgggcatttagtgctataaatttccctctacacactgctttgaatgcctcccagagattctggtatgttgtgtctttgttctcattgctttcaaagaacatctatatttctgccttcattttttcatgtacccagtagtcattcaggagcaggttgttcagtttccatgtagttgagcggttttgggtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgcatattctgttgatttggggtgaagagttctgtagatgtctattaggtccacttggtgcagagctgagttcaattcctgggtatccttgttgactttctgtctcgttgatctgtctaatgttgacagtggggtgttaaagtctcccattattaatatgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttcatctttgttggtttaaagtctgttttatcagagactaggattgcaacccctgcctttttttgttttccatttgcttggtagatcttcctccatccttttattttgagcctatgtgtctctctgcacatgagatgggtttcctgaatacagcacactgatgggtcttgactctttatctaatttggcagtctgtgtcttttaattggagcatttagtccatttacatttaaagttaatattcttatgtgtgaatttgatcctgtcattatgatgttagctggttattttgctcattatttgatgcagtttcttcctagtctcgatggtctttacattttggcatgattttgcagtggctggtactggttgttcctttccatgtttagtgcttccttcaggagctcttttagggcagacctggtggtgacaaaatctgtcagcatttgcttgtctgtaaaggattttatttctccttcacttatgaagcttagtttggctggatatgaaattctgggttgaaaattcttttctttaagaatgttgaaaattggcccccactctcttctggcttgtagagtttctgccaagagatccgctcttagtctgatgggcttccctttgagggtaacccgacctttctctctggttgcccttaacattttttccttcatttcaagtttggtgaatctgacaattatgtgtcttggagttgctcttctcgaggagtatctttgtggcgttctccgtatttcctgaatctgaatgttggcctgccttgctagattggggaagttctcctggataatatcctgcagagtgttttccaacttggttccattctccccgtcactttcaggtacaccaatcagacatagatttggtcttttcacatagtcccatatttcttggagggtttgttcttttctttttattcttttttctctaaacttcccttctcgcttcatttcattcatttcatcttccatcgttgatactctttcttccaattggtcacatcggctcctgaggcttctgcattcttcacgtagttctcgagccttggttttcagctccatcagctcctttaagcacttctctgcattggttattctagttatacattcttctaaatttttttcgaagttttcaacttcgttgcctttggtttgaatgtcctcccgtagcttggagtaatttgatcgtctgaagccttcttctctcagctcatcaaagtcattctccgtccagctttgttccgttgctagtgaggaactgcgttcctttggaggaggagtggcgctctgctttttagggtttccagtttttctgctctgttttttccccatctttgtggttttatgtacttttggtctttgatgatagtgatgtacagatgggtatttgatgtggatgtcctttctgtttgttagttttccttctaacagacaggaccctcagctgcaggtctgttttagtacccggccatgtgaggggtcagtctgcccctgctggggggtgcctcccagttaggctgctgaggggtcaggggtcagggacccacttgaggaggcaatctgcccgttctcagatctccagctgcatgctgggagaaccactgctctcttcaaagctgtcagacagggacatttaagtctgcggaggttactgctgtctttttgtttgtctgtgccctgcccccagaggtggagcctacagaggctggcaggcctccttgagctgtggtgggctccacccagttcgagcttccccactgctttgtttacctaagcaagcctgggcaatggcagccgcccctctcccagcctcgctgccaccttgcagtttgatctcagactgctgtgctagcaatcggcgagactccgtgggcataggaccctccaagccatgtgcgggatataatctcctggtgcgccattttttaagcccattggaaaagcgcagtattggggtgggagtgacccgattttccaggtgccatctgtcaacccgttctttgactaggaaagagaactccgtgaccccttgcacttcccatgtgaggcaatacctcgccctcttcggctcgctcacagtgcgcgcactgacctgcgcccattgtttggcactcccttgtgagatgaacctgggacctcagatggaaatgcagaaatcacctgtcttctgcgtcgctcacgctgggagctgtagaccagagctgttcctattcggccatcttggctcctccccctagctgttgtttcctacagatctttcttaacttcctctaattttttccatgctgttataatcttctgacatacagtaggatgtaattattcattttatttactgtttgtataattacatggaaatatgagttccatgagggtagacacagttctctgctttatttgctgtagtatctttagggccctcaatcgtgcccgtagttagttattcttcattaaatatttggtctatttccaaaccagactggaagtcaaaagtaggtggattccatacatggggaactctggctctaggatgccatgaagagttcagatttttttcctctcttcttcgccactctcagtgtccttaacatgctggtctcaagacggctgaagcacttttaggtctctgatctgggcatggtaatgtttacagacagaaaggaatatatcttccaatgtgccttttcaaagagacaagacccatgacatagtacttcccagaagatatccccacagtcaactccaacgtatgggactgaattaggtcacgtgcccatttcaaaaccagtgaatttcaagaatattgactggcttagataaacaggagacagaatggatgttggggagtcaatcacaatgtccactgaaacacatcagtgccctggtgtgattggatgtgtgtgcttgtgtgtgtgtgtgtgtgtgtgtgtgtgtgtgtgtgtgtgtgtatgaacctgaaaatgagctgatttctggaacataaatgttacaaaatgaaaagaaatagattagggtaattaatcagtttgattaaggttattaattggtttaaggtaattaagatgggaaagagctgacatcttgcatggatacatttttgtctgttaatggtatgagactagcatcattcaatatttccatctcatactaggtaatgctttgacagtgggaccagaaatcatgtagagacttgtttttcccacacaatgcctatgtgggtatttccagaatttcctttcacggatgactgacaaaccccctcctgactgatacattcttcatgtagccatattaatacctttattcaaatcttagtgtttctttgacctggaatcaatcttattcttttttcttggtttcagcttaaagtgcataaaacggatatacaaagataaataatgaataattataaagtgaaaacctgtgtaaccacaacccaaaacagtgaaatcaaatattgataaaaccctggaacccattatgtccgcatccctaaccaccactgtctatctcctcaatagaggttcccaccatcctgctcattgtttagaatctctactttgctgctcattagaggtttgatactcattatagctttgccacctatgtaaacaactaaagtaccttgttcagtttgtcacagttttataaaatcacatctctgctcagagtttttacagtacatttaaataataaccttatttaacttggttatggaggctttcagaaatgtttaaaagcaaactctctttccacattaaagggacaacagatattccttgggtacctactgtgtgcttaggagtgaagaaagtactggagtatccatgagagctaaattgtgctgtctaccttcactgagattagagtctagttgaaaagatagtgcctaataatagtgtacagtgttagaactgaatatagttcagttatgcagcaaggccatgggtattgcaatgaggcattccatgtaccacctcttattggctctgtaactctgggaaagtctctgcacctttctgagcctgtgtattcactttgaaaagagagagagatttaaaagctgctccctaggattgttgtgcatggtatattgtagcctctaaatgaatggcagatattttactatggtacattgggctagtcagaaggaaggctgaaaataattaaattcccactgaacatatatatttagctcatatagaagcctaggcaccttagtacactctagatgttagagtgaggatatttggctccaggaacacacataggcagctaagtggaatggtaagagactagatattaagatcagaaatgtttgggccaataattttaataaggatgaaaggtatcctttgttgagtaattaattatatgactctcaaaacttagaatcttacctctggtaggcacctcagagacatggttagacctgagtccttggaaccagaactgtctaatcaaatgttgtcctctataaacaagaaagaatttaaaaatcaatgagagttaacttttaatgtgtattcgccctgtccaaatattgctgaaaacatgtgcatcatctcgtttaatccttaccatggccctaggacataggcaagctcaatgattatcctttcttacagatcaaaaactttgaattcagaaattattcataatgtttctgctatcacacagctgataaatgaagtagccacaaatttattctagttgttattcagagctcacattactttccttgggggaggtactttttttctgagataatttcaaacttgcttacaaaaaaagttgcaagaatgagacaaagaacctccttttgtacttctccctaatacctccacagttaacatttgacatatttttacacttgctctctgtctctgtctctctcaatacacagatgcataagcacagacacattttcatatatgtattctaaaccatttgagagtgagctagagacatgttcttttactcctaaatgcttcagtgttatttcctgagaataaggacattgtcttacataaacagtataattatcaaaatgttatctttattaacattgaaacaatactattatctatctcatgtacaaattttattcaaaagtgaccagttatcccaataatgtcatttacagagttttctaattttctgatctatgatccctctagtgtcatgtgttttatgtagttgttacttcactttagtcttttttatttttattttttataattttaactcactatagtcttctttagttttgaacaagtcctcagattttctttgtctttcatgaccaaaacagttctttaatgtgtgggctatttactagagtgtcctttaatttcggtttgcctggttttctatcctcatgattagattcaatttatacatttttgtctggaatagcacaaaatgatagtattttcttctcaatgcattacatctgttggcaaagtacttatttattccataactggtaatgtcaaatttaatcacttaattaatgttgtattcagcaggttatgtcaagtaaagttactatattttctttgaaattgaagtattctgtggtgagatacttggatactgtggacatatcctgtcttgtcatccactaatacttctgcctgagtccactaatgcataactgttggaaaatgatgtctttctataataacactttcttttcctacttaaaaatatatttatttatttaatcaacaaataaaaatcatatatatgaatcatgtataacatgatgttttgaaatatgtatacattgtggaatggctaaaatgagctccttaacatatatattacctctcatacttattatttcttgtggggagaacacaaaatctactctcagtgattttcaagaatacaatacagtgttattaaccatagtcaccataacgtacagtgggtctcttgaacttattcctcctatctaactgaaaatttggatccttgatgaactgctcaccaaccacctcctctcaatttcctggtagctaggattctactctctccttccacgagttcaacctttttagattcctcacataaataagatcatgcggtctttgtatttccctgcctgggttacttccgtttacacaatgtcatccaggttgtcgcaaatgacaggatgtcttttgtttttgttttttagagacagggtttcactttgtcacccaggctgcagtgcagtgatgcgatcatggctcaccgtatccttgacctctgggacccaagggattgtcccaactcaacctcctgagtagctgggaccaaaggcatgtgccactatgccacattaatttttatttttttgtggagacagggtttcactatgtcacccaggctgttctcgaattcctgggctcaagccatcctcccacctcagcctcccaaagtgctgggagtactggcatgcatcatcatgctcaggcaggatttccttcttttttaaggctcaatagaattccgttatctcctaccttttcttgattcattcacctgctgagggacatttagttttattccatatcttaactgttttgaatagtgctgcaatgaacacaggagtcatgagagcctttcaacatttaataagttggcattgtactgtcatgaagagttttcccattgtatttgtcagagttctctagagggatggaagtaataggatatatgcctatatgaaagggagtttattaaggagaattgattcacacgatcacaatgtaaagtcccatgataggcggtctgcaagttgaggaagccagtggtggatcagtctgaatcccaaaacctcaaaagtagggaagccaacagtgcagccttcagtctgtggccaaagacgggagagaacctggcaaaccagtggtgtaagtccaagagtccaaaagctgaagaacttggagtttgatgttccagggcaggaagcaccaacaggggagaaagatgaaggccagaagactcaggaagtctgctcttccatcttctcctgcctgttttattatagtcatactggcagttgattatacggtgcccacccagattgagagtgggtctgcctttcccagcccactgactcaaatgttaatctcctttggcaacaccctcacagacagacccaggaacaatacttagcatcattcaatccaatcaagttcacagtcaatattaaccatcacacccaacttcttcatttatttacttatttatgtatttacttatatcattataggttcatgggtatatacttaatcactgggtaatgatagattaccatcaaaatttattttgatactcaaattggccagcatttggctagttgaagtgccttgaaacttcctgtacctttttgtcatatatccatcttagctggaacactttctttactttctagtgcaacaagatgttcctgcctgtttgtactttccctgttccagcccttgagtcagacatttctctaaaaagcctcagtttattttagtgtacaatgctttttacaagcaagtctgcactctgaatcacctgtctctactgacaatatgactttgaaaccctccaaactttccttaattctatttacccagtgtgtaaatgcacataaaaataggatttttgtctaggtatgttgcgaggtttaaaataaggtattgggccaggcgtggtgtctcatgcctgtaatcccagcactttgggaggccaaggtgagcggatcacctgaggtcaggagtttgagaccagcctggccaacatggtgaaaccctctctctactaaaaatacaaaattagcctggcatggtggagcatgcctgtaatcccagctacgtgggcggctaaggcaggaaaatcgcttgaacccgggaaccggaggttgcagtgagccaagatcatgccactgcactccagcctgggcaacatgagtgaaactccgtctcaaaaaaataaataaataaaatttaaaaataaaaacataaaataaggtattgaaagcatttagcactgttcatggcacaaaagtaattttggtaatttgaccatttgaacatgagaatgagtaataatcataataataacgggttgtgacccaattaataaaatcagaatccataagaccaattgaaaataagtgggagctattttatcaccatttttgttattatcaaatacccttgacagtgaataagttttacctctaggaaaaatttcaagtttacacttatagccttgtcaagcaaaagtaagatctgcagaatcacagagcttgagaaagtaccaatatgggggaatgattccagaagcaggcaggccttaggccttgatgactggcaggacttcactgtttgaaacaaaaaagattaagtgaagaacagcaactactcctacaacccctgctaccagaaccccatatttcccctatcatagccgcaaatccactgttccataaatagttacttgtctgtgtacttcattagactgagagctgatagttgtgacttatttgccaacttatccccaatgcctgaaatggtgtctgtagataggagacattcaataaatgtttgctgaatgaatgaatgaaagtattaataatttcaaatatgtcgtgaggataattaatgagagaaggaaactgagactcagagaagtagggaagcgtgcccaaggtcatacaactttttttttctttttttgagacagagtcttgttcttgttgcccaggcgctggagtgcaatggtgcaatctcagctcacttcaacctctgtctcctgagttcaagtgattctgctgcctcagcctcccgagtagctgggattacaggcacccaccaccacaccaggctaacttttttgtatttttagtagagacggcctttcaccatgttggccaggctggtctcgaactcctgacctcaggtgatctgcctgccttagcctcccaaagtgctgggattacaggcctgagacaccatgcctggcccaaggtcatactactattttagtaagagagagagggaggcagaattccattctgccctgactctagtagctttgggtgtattggcctctctagatactgagccttcccagtaagattaacttgtctgatttccatgtttaccagagttcaaatgggagtcccatatgtgccaaactatgtatgcaagactggttcaagggtttggtaattaattcaacaactatttattgattgctcaatataggccttacaggttctggagatacagcagtgagtacaacagatggataacctcctcttatcaacattccattctggtgcacagagacagaaaataaggggatacagaaaacttaagatggtaaagaaagtaaagcttgattaacaaatagaaaattacccagcatgtgtgtgtttgaaggagggagtggctatggaggtgagaggaggcttgttaagttcagaggacctggaggaattttctgtgtctggaattagaaagggatgcaggctgggagttgaggtgagaaattagaaagtcgaaacctcaagaaaataagccacttaatgtctatgagactaagtgttctcacctgcaaaacagggattcaaacatttgaggtaccgtgtaaaaaatgtagtgtaaagctcaaatctgaaaacattaatgttattcagctgatttattgaacaataatagcagctggtacttttgaatgcttgctgtttgttaggcagtatgctagttgctttccatgttaatttcatcctctgcaatgaaaagtagttagggtttttatattttataaggttggatagcaactgattgcaggtattaggattaaagcccaggctcagtctgtcaaacttgaaaagcttgttctttttcacaagtttgtgcttccagaatcgcaaacaggcaactgatagtgaccaagatgaattgagtggtacaacatttaaaagacagttataaaacttacttagcatagcatttatataattattaatgaaaggaaaaataatgatttattatttatatttcaatcttagtatctaaacttatatttttatattttattaaattaatttctaaaattcttacactagcacataatactaagtgtttgtatttttagaagtgacataagattttctttttaaagttttattttatttttagttggcatttaataattgtacacacttatggggtgcaatgtgatgtcttgatatatgtatacattgtgtaatgattaaatcaggataattagcaaatacatcataccaaatattgattattttttgtattgagaacattcaaaatactctcctctagctattttacaatatagaatatattatcgttaactatcgtcaccctactggacactagaacatcagaacctctttctcctccagatggaagatcaacaaggaaatatagaactgaacaatgttatagacaaaatagacccaacacacatataaggaacattccacccaacagcagcaaaaataatcattcttctcaaatgcacatggaacattctccaagatatctcatagtagaatctcatatcaagtcttaacaaatttaagaaggttgagatcaatctaagtatcttttctgatcacaactgaatgaaactagaaatcagtaataaaaagaaaatgaggaagctcacaagtgcatggaaattaaataacacgctttgaaacaattattatgtcaaagaagaaattgaagatgaaattagaaaatatattgagacaaaggaaaaccaaaacacaacacagtgaaacataacatgcagccaaatcagcactaagaaggaagtttataacaataaatggtttattaaaagaagaaaaaaaaggaaagagctccagtaaactaactttctccctcaaggaactagataaagaagaacaagcaagtcaaagttagcagaaggaagtaataatgaaggttatagcagaagtaaatgaaatagagaatagaaaaacaatttaataaaattttaaaaaccgaagagttttttgaaaagataaataaaatggacaaacccttagctagactaataacaaaaaagaaaatattcaaataatacaatcagagatgaaagaagagacatcccatggctgggggtagggagagctataggaactattatgaacatttaaatgttaataaattggataactcagaagaaattgaaaaattcctagaaacataggacccactgagactgcatcaataaaaaatataaagcccagacataccaaaaaacaaataatgacattaaaagaataatcaaaaatgtcccaacaaagaaaaatacaggaccaggtggcttcatagataaattctgtgaaacattaaaaaaattaataccaatcttactgaaagtcttctaaacaacagaatagggaatacttacaaactaattctatgaggccagcatcaccctgatacaaaagccagagtaagacaccagaagaaaagaaaactacagactaatatccctgatgaatatagatgcaaaaagcctcaaaatattattagcaagccaaatacaaaaatgcatttaaagactcatacaccatgaccacataggagttatgcctgtgatacaagaatcgttccacatatgcgaattaatcagtgtgataaaccacatgaatagaatgaaggatgaaaattacatggtcatctcaacagattcacaaaaaacatttgacaaaattagacacctctttatgctaaatattttcaacaaattaggtttagaaagaacttacctcaatataataaaggccatagaggaaaatcccacaattaacatgatgctcaatgatgaaaagctgaaagatttactcctaagatgagaagcaagacaaagatgcccactcttggctctcctatttaacataatacagtcattcctcagtattcatggggaattggttttgggaccctcacagataccaaaatccgtggttacatttgtataaaccaacaatgacctatctgtaaagctgatttcaggaaacaatttgactcacaattgcacaacaaataaaatacttagaaataaatgcaggtggctgggcatggtggctcatgcctgtaatcccagcactttgggggactgagacgggcagatcacctgaggttgggagttcgagaccagcctgaccaacatggagaaaccccgtttctactaaaaacacaaagttagctgggcatggtggcccatgcctgtaatcccagctactcagggaagctgaggcaggagaattgcttgaacctgggaggcagaggttgtggtgagccaagattgtgccattgcactccagcctgggcaacaagagtgaaactccatctcaaaaataaataaataaataaaaacaaataaatgtaggtaaaggaggtaaaagggttgtacactgaaaactacaaaacattgacaaataatttttaaaaagcagaaataaatggaaacatctcatgatcatgtattgagaagaattgatattattaaatgtccatacttcccaaaatatctgaagattcaatgcaatctctatcaaaatctctatggcatttttgtacagaataaacaatcctaaaattcagaagaccctgaatagccaaacaattttgaacaagtacagagctggagttatcacactccctgattccataatgtgtcacaaagctgcagtaatcaaaacagtatggtactgttataaaagtagtcatatagaacaatggaacagaatagagagctcaaaaataaatctactgggtgccaagactacactatgtggaaggatggtctctttgatacatggtgttaagaaaattgcataggaatcgaaatcacaggaatcgaaatctggatctccaagagatgagtgtattcccatgtttgttgcaacattattcacagtagccaagatatggaaacaacctcagtgtctgttgatgatgaaatactattcagccttataaaagaaggaaatcctgctgtttgtgtacctggaggacattaggctaagtgaaataagtcagatcacagaaagacaaatactgcatgatctcagttttactgtatgtgaaatctaaaattgttaaccatatagaagcagatagtagaatggtagtggccaggggctgagggaagggagaaatgcaggtggggtgttggttaagcgatacaaagtttcagttatgtgtaataaataacatctgtaggtctagtgtataatacagaacctatgattttatactcaagtttgctgagagggtaaatcttcattaagtgctctcaccacaaaaaggaaaataaaaaaacaaagagggcaggaggaaactttcagaggtgaaagataagattatggcattgagagtgatgatgttgtgatcatttcatgggtgtatactcgtctcttaacacatgatgttgtgtacattaaatatgtacagctttttgtaaaaaaaaaaaagccatataaacgttgcgataaaagtagcatccattgcttttcctgtctgcagtctataatatattaatttattaaaacatcaaacactcgattatgcacaccgtatttccagaagtaatctgtaccctgaacataccatgatcaatgaaacatggcctttcatcatcagggatttcatgatctcctcttggaggcataacacatcaatgaaaagggactttaaaaaggaactgtaggccgggcgcggtggctcacgcctgtaataccagcactttgggaggccaaggcaggcagaacacctgaggtcgggagtttgagaccagcctgaccaacatggagaaaccccatttctactaaaaatacaaaattagccgggcgtggtggcacatgcctataatcccaggtactcggggaggctgaggcaggagaatcgcatgaacccaggaggcagaggttgtggtgaaccgagatcgtgccattgcactccagcctgggcaacaagagcaaaactccatctggaaaaaaaaaaaagtccaggaagtccagaatgtactggtactagaagttcctgaaaacagcaatgatcaactacaaaaacattctccaagtaaagataatctgaggacagcagtagcctgtattcattaatttatcatgaatttttccaactaataaatagctcataaaataatagctatgttttattgggcaatgatcagaataggaatcatccacattcatacaataagtatttattgagcacctgctagacaccaggttctaggctgtatgccaaattttaaagtcacatgtgacacaggctctatcacatatatcaatgacttctcagattaatgaaaatacacagatgaacagataattactgggttatcaggagaaccataacagaagtaaacacagtgaacactaagaacagagaagggaatgctaactcaaatggtctaaagtgcttctcatcacttatgagatggttgctattattgtccccattttttatatgaaaaaacctaggaacagagagaatggtgcaggaatatagcaggcactcataatttgtggaatgcatgaaagtttacttcaccaacaccaaatatctcaaaaatagatattgtagtaaagccaattaatttttaatttcaaaattaatagaggatttttagaagggttttaggcttacagaaaaatgagtggaaagtacagtgaatttccaaatacccccccacactctcctcctccattattaacacttgcattagtgtggtacacttatcacaattgataagccaatattgacacatcattattaactaaatttcacagattatattacggtttgctctttgtattctacacttctatggattttgacaaatatattacaggtattcattattacagtatcatacagcatagtttcactgccctaaaatcccctatactccacctattcacccctccctctttccctacaaacttcagacaactactgaacgttttgctctttccatatcatgtcctatagttggaatcacgccatatataaatcttttcagactggctgcttcttcttttttttttttttttttttgtcagatggagtctcgctctgtcgcccaggctggagtgcagtggtgcggtctcgtctcactgcaacttccacttccccagttcaagcgattttcctgcctcagcctcctgagtacctgggactacaagcatgtgccaccaagcccggctaattttttgtatttttagtagagacggggtttcaccatgttagccagaatggtcttgatctcctaaccttgtgttccacccaccatggcctcccaaagtgctgggattgcaggcatgagccaccgcaccgagcccagaatggcttcttttatttatttatttatttatttatttattcatttattttttattattatactttaagttttagggtacatgtgcagaatgtgcaggttagttacatatgtatacatgtgccatgctggtgcgctgcacccactaactcgtcatctagcattaggtatatctcccaatgctatccctctcccctccccccaccccacaacagtccccagaatgtgatgttccccttcctgtgtccatgtgttctcattgttcaattcccacctatgagagagaatatgcggtgtttggttttttgttcttgcgatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgcgtgcatgtgtctttatagcagcatgatttataatcctttgggtatatacccagtaatgggatggctgggtcaaatggtatttctagttctagatccctgaggaatcgccacactgacttccacaatggttgaactagtttccagtgccaccaacagtgtaaaagtgttcctatttctccacatcctctccagcacctgttgtttcctgactttttcatgatcaccattctaactggcgtgagatggtatgtcattgtggttttgatttgcatttctctgatggccagtgatggtgagcattttttcatgtgttttttggttgcataaatgtcttcttttgagaagtgtctgttcatgtccttcgcccactttttgatggggttgtttgtttttttcttgtaaattcgatggagttcattgtagattctggatattagccctttgtcagatgagtaggttgcgaaaattttctcccattttgtaggttgcctgttcactctgatggtagtttcttttgctgtgcagaagctctttagttgaattagattccatttgtcaatttgggcttttgttgccattgcttttggtgttttagacatgaagtccttgcccatgcctatgtcctgaatggtaatgcctaaattttcttctagggtttttatggttttaggtctaacgtttaagtctttaatccatcttgaattgatttttgtataaggtgtaaggaagagatcccgtttcagctttctacatatggctagccagttttcccagcaccatttattaagtagggaatcctttccccattgcttgtttttctcagggttgtcaaagatcagatagttgtagatatgcggcattatttctgagggctctgttctgttccattgatctatatctctgttttggtaccagtactgtgctgttttgcttactgtagccttgtagtatagcttgaagtcaggtagtgtgatgcctccagctttgttcttttggctcaggattgacttggcaatgcggactcttttttggttccatatgaactttacagtagttttttccaattctgtgaagaaagtcattggtagcttgatggggatggcattgaatctataaattaccttgggcagtatggccattttcacgatattgattcttcctacccatgagcatggaatgttcttccatttgtttctatcctcttttatttcgttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgtacactgactttgtatcctgagactttgctgaagttgcttatcagcttaaggagattttgggctgagacaatggggttttctagatatacaatcatatcgtctgcaaacagggacaatttgacttcctcttttcctaattgaatgccctttatttccttctcctgcctgattgccctggccagaacttccaacactatgttgaataggagtggtgagagaggtcatccttgtcttgtgccagttttcaaagggaatgcttccagtttttgcccattcagtatgatattggctgtgggtttgtcatagatagctcttattattttgagatacgtcccatcaatatctaatttattgagagtttttagcacgaaggattgttgaattttgtcaaaggccttttctacatctattgagataatcctgtggtttttgtctttggttctgtttatatgctggattacatttattgatttgcatatattgaaccagccttgcatcccagggatgaagcccacttgatcatggtggataagctttttgatgtgctgctggattcggtttgcccgtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagtttcagacggaatggtaccagttcctccttgtacctctgatagaattcggctgtgaatccatctggtcctggactctttcgttggtaagctattgattattgccacaatttcagatcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgcgcctatttgattcttctctctttttttctttattagtcttgctagcagtctatcaattttgttgatgctttcaaaaaaccagctcctggattcattaattttttgaagggttttttgtgtctctatttcctttggttctgctctgattttagttatttcttgccttctgctagcttttgaatgtgtttgctcttgcttttctagttcttttaatggtgatgttaggatgtcaattttggatctttcctactttctcttgtgggcatttggtgctatatgtttccctctacacactgctttgaatacgtcccaaagattctggtatgttgtgtgtttgttctcattggtttcaaagaacatctttatttctgccttcattttttcatgtacccagtagtcattcaggagcaggttgttcagtttccatgtagttgagtggttttgagtgagattcttaatcctgagttctagtttgattgcactgtggtctgagagatagtttgttataatttctgttcttttacatttgctggggagagcattacttccacgtatgtggtcaattttggaataggtgtggtgtggtactgaaaaaaatgtatattctattgatttggggtggagagttctgtagatgtctattaggtctgcttggtgcagaggtgagttcaattcctgggtattcttgttgactttctgtctcattggtctgtctaatgttgacagtggggtgttaaagtctcccattattaatgtgtgggagtctaactctctttgtacgtcactcaggacttgctttatgaatctgggtgctcctgtattgggtgcatatatatttaggatagttagctcttcttgttgaattgatccttttaccattatgtaatggccttctttgtctcttttgatctttgttggttgaaagtctgttttatcagagactaggattgccacccctgcctttttttgttttccatttgcttggtagatcttcctccatccttttattttgagcctctgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatcatattagctggttattttgctcgttagttgatgcagtttcttcctagtcttgatagtctttacattttggcatgattttgcagtggctgataccggttgttcctttccatgtttagcgcttccttcaggagctcttttagggcaggcctggtggtgacaaattctctcagcatttgcttgtctgtaaaggattttatttctccttcacttatgaagctcagtttggctggatatgaaattctgggttgaaaattcttttctttaagaatgttgaaaattggcccccactctcttctggcttgtagagtttctgccaagagatccgctcttagtctgatgggcttccctttgagggtatcccgacctttctctctggctgcccttaacattttttccttcatttcaactttggtgaatctgacaattatgtgtcttggagttgctcttctcgaggagtatctttgtggcgttctctgtatttcctcaatctgaatgttggcctgccttgctagattggggaagttctcctggataatatcctgcagagtgttttccaacttggttccattctccccatcactttcaggtacaccagtcagacatagatttggtcttttcacatagtcccatatttcttggaggctttgttcgtttctttttattcttttttctctaaacttcccttctcgcttcatttcattcatttcatcttccatcactgataccctttcttccagtgatcgcatcagctcctgagtcttctgcattcttcacgtagttctcgagccttggttttcagctccagcatctcctttaggcacttctctgtgttggttattctagttatacattcttttaaattttttcaacgttttcaacttcgttgcctttggtttgaatgtcctcccgtacgtagcttggagtaatttgatcatctgaagccttcttctctcagctcgtcaaagtcattctctgtccagctttgttctgttgctggtgaggaactgcgttcctttggaggaggagaggcgctctgctttttagagtttccagtttttctgctctgttttttccccatctttgtggttttatctactttttgtctttgatgatggtgatgtacaggtgggtttttgatgtggatgtctgtttgttagctttccttctaacagacagggccctcatctgcaggtctgttggagtacccggccatgtgaggtatcagtctgcccctgctgggggttgcctcccagttaggctgctgaggggtcaggggtcagggacccacttgaggaggcagtctgcccgttctcagatctccagctgtgtgctgggagaaccactgctctcttcaaagctgtcagacagggacatttaagtctgcggaggttactgctgtctttttgtttgtctgtgccctgcccccagaggtggagcctacagaggcaggcaggcctccttgagctgtggtgggctccacccagttcgagcttccccactgctttgtttacctaagcaagcgtgggcaatggcggccacccctcccccagccgcgctgccgccttgcagtttgatctcagactgctgtgctagcaatcagtgagactccgtgcacataggaccctctgagccatgtgcgggatataatctcctggtgcgctgttttttaaacccgtcggaaaagcacagtattggggtgggagtgacccgattttccaggtgccatctgtcaccactttctttgattaggaaagggaactccctgaccccttgtgcttcccgagtgaggcaatgtctcacccttctttggctcgtgcacggtgtgcgcacccactgacctgcgcctactgtctggcactccctagtgagatgaacccggtacctcagatgtaaatgcagaaatcacccgtcttctgcgtcgctcacactgggagctgtagaccggagctgttcctattcggccatcttagctcctccccagaatggcttctttaacttcgcaatatatatttaagtttcctcaatgtttttgtggccagatagctcatttcttatccttgaataaaatgtcattgcatagaggtaccacagtttgtttcttcattgacttattgaagtatattttggctgtactatggtttgaatatttgtcacttcccaaacttaaatgttgaaatttaatcctccgtttggcagtactagtactagtggggaggctttaagaagtgattggggccaggcgtggtggctcacacctatattcccagcactttgtgaggccaaaatgggcagatcatgacgtcaggagctcaagaccagtatggtcaacatagtgaaaccccgtctctactaaaaatacaaagaattagccgagtgtggtggtatgcacttgtagtctcagctacgtggggggctgaggcaggagaattgcatgaacctaggagacaaaggttgcaatgagccaaaattgtgccattgcactccagcccaggcgacagtgcaggactctgcctaaaaaaaaaaaaaaaaaaaaagtgattgggtcatgaagactttgccatcatgaatgacttaattcattcatggcttaatgcattgatgggttatcatgggattgggactggtggctttataagaagaggaagagagatcatagttagcctgctcagctttctcaccatatgatactctgccttgcctcaggactctgcagagtacccaccagtaagaaggccctcaccagatgtgaccccttgaccttggacttctcagcctccataactgtaagaaataaattagttttcacataaattacccaggtccaggtattatgtataaacagcagaaaatagactaagacaggccacttccaagttttggcaattatgaataaaactggtacaaatatttgtgtacaagtttttgtgtaaatataattttcatctcatttgggggttcaattgctgatcatatggtatgaatatgtgtaattttctaagaaattgccaaattgaattctaaagtagctgtaccatttttccttcccaccagcaatgaatgagagtttccatcactccacatcaagcatttgacagtgttttgaattttagtcattctgataagtttatgaaagctttttatcatcgtttcagtttgcaattccctaaagacgtatgtcattgagcatctttttatatgcttatgtgctatctgtacattttgtttggtgaggtatctgttcctatattttgcccgtttttaagttggttgtttagttttttattgttgagttttaggagctgtttgtatattttggatactagtcctttattggttatgtgttttgcaaagattttctcccagcctggtcattaagagtgtgttttgtagtgcagcttttattttcaataaagcctgaaatcaattttttctttcagagattgtaattttggtattatatccaaaatataatagtcaaaccgaagatcaccaagattttctcccctgccagcttctagaagttttataattttgtgttttacatattaacaattacatgggtaattgataaaagatgtaagatcttttgataaaagatcttttgataaaagatataagatctatatctagattctttttttgtgcatgtagaactgcatgcaagcagttcatttgttgagaagtctgtcctttctccattgaattgcctttcttcttttgtaaaagatgggttatctgtatttgtatgagtctatttctgggctctctattctattctcttgatctatttacttattcttttgccaatactaaactatcttggctcctgtagctttatagtgagttttgaggttgggtaatgtgagtcctccaattttgttcttcttcaatactttcatagctattctgattttttgtctttctatgtaaactttagaatcagtttgttaatattgacaaagtaactaactgcgattttgattggaaatgcattgaatctatagatcaagttgggaagaacttgattgctcgacaatattgtgtcttcctatttatttacatggaatatttccccatctgtttagttcttctttgaattatttcaccagtgttttaagcagtttgacttatgtatattatacttgtatcccatgacctcgttataattgcttattagttccaagacttattttattgcttctttcgaattttcaacatacacaattatgtcatctgcaagcagacagtttgatttcttacttcccagtttgtataacttttatttccttttcttgtcttattgcattggcaaaattttccaatcaaaattcaaaaaagagtagtgatagtgaacatccttcttttttttcttgatcttagggggaaaacatctagtttcttgtgattaactataatgctaactgtagattttttgtgtgtagatattcttttccacagtgaggaagttcacctttatgcttagtttgctgtgtgtttctattgctagttggtcttagattttgtcaaatgcttattctccgtctacttatatgatcacatcccttttttctttagcctctcaatgtgatgaatcacatcaattgatttgcaaatgttgtcccagccttgcatacctggaataaatcccacttggttataggtgtataattatttctaaatattattggagtcaattcactaatattttattgaggatttttgcatctatgttcagagtggatattggcctgtatttccatttcttgtaacatccttcattttagtattagggtaatgttggactctagaatgagtgaggaagtattcactttgcttctattttataaagaagattatagaaaattggcataattttttccctttaatgttaggttaaattcaccagtgaacccatctgggcttgctgaactttgatttgggaagattatttgaaacttcattccagatgattattaattattgatttcattgctttaataggtgtaggactatttatgttttctatttcttcttaagtgggttttggtagattgtgcctttagaaaaattggtgcatttgctcttcaaggagaactacaaaccactgctcaacaaaatgaaagaggacacaaacaaatggaagaacattccatgctcatggataggaagaatcaatatcgtgaaaatggccatactgcccaaggtaatttacagattcaatgccaccctcatccatctaccaatggctttcttcacagaattggaaaaaactactttaaagttcatatggaatcaaaaaagagcctgcattgccaggacaatcctaagccaaaaaaacaaagctggaggcatcatgctacctgacttcaaactattttacaaggctacagtaaccaaaacagcatggtactggtaccaaaacagagatatagatcaatggaatggaacagagccatcagaaagaataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacctaggcagtaccattcagggcataggcatggggaaggacttcatgtctaaaacaacataagccaaaattgacaaatgggatctaattaaactaaagagcttctgcacagcaaaagaaaccaccatcagagtgaacaggcaacctatagagtaggaaataatttttgcaatctactcatctgacaatgggctaacatccagaatctacaaagaactcagacaaacttacaagaaaaaaacaaacaaccccatcaacaagtgggtaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcatgaaaaagtcaggaaacaacaggtgctggagaggatgtggagaaataggaacacttttacactgttggtggcactgtaaactagttcaaccattgtggaagtcagtgtggcgattcctcagggatctagaactagaaataccatttgacccagccatcccattactgggtatatacccaaaggattataaagcttgctggtataaagacacatgcacacgtatgcttattgcggcactattcacaacagcaaagacttggaaccaacccaaatgtccatcaatgatagactggattaagaaaatgtggcccatatacaccatggaatactatgcagccataaaaaatgatgagttcatgtcctttgtagggacatggatgaagctggaaaccatcattctcagcaaactatcgcaacgacaaaaaatcaatcaccgcatgttctcataggtgggaactgaacagtgagaacacttggacacaggaaggggaacatcacacaccggggtctgtcgtggggtggggggaggagggagggatagcattaggagatatacctaatgtaaatgacgagttaatggttgcagcacaccaacatggcacatgtatacctatgtaacaaacctgcacattgtgcacatgtaccctaggaattaaagtataattttcaaaaaaagtaagaaaaattggtctctttgatctacattatcaaatttgtggactagacttgttcataatattcctaattttccctttggtgttactgagatcagtaataaggcccctatttcatttctggcattagtaatttgtgtcttctcttttattcttgttatccttactaggggtttatcaatttcattaacctttcaacaaaaaaacaggttttggttttgttgattatttctattgatttactgttttcagttatattgatttctactcttaagtttttattatttttctttttagtttagatttaatttgctcttatttttctaatttcttacggtagaaacttagatcattgattttagatctctcttattttctaatatatgtattcaatgctgtgaattttcccataagcactgctttcactgcattatacaaattttgttgggctttcattttatttagttcaaaatattttaaaatttatcttgatatgtcttccttgacccgtgtattatttagaagtgtgttgtttaaccttcaggtatttggggattttccagatatctttctgttattgatttttattttgataccattgtggtctttgcgtgatttcttttcatttaaatatgctaagttgtgatttatggcaaataagttgatctgacttggtgaatattccatgtgtgcttgagaagaatgtgtaaattgccattttttgatgttttctataaatgtctgtcagatccagttgattgttctgttcagttcaactatgtccttaccaatttttttgcctgctgaaattgtcaattacattctctccaaatctaaaagtctccaactacaatagtggactcatctatttctccttgtacttctatcggtttttgtctcacatattttgatgctctgttgttaggtatatacacattaagaattgttgtcttctggagaattgacccctttatcaatatggaatgcattttctttatctttgataattttccttgctctgaattctgttttgtttgcaatttatgtagtaagcttggctttttattaattagtgttagcatagtacattgttatccatcattttgcttttattctattcatgtctttatatttaaagtggatttcttatagataacatattgttgtgtcctaattttgatccactctctctttttcttttttgagatggagtgtcgctttgtcatccaggctggagtgcagtggcattatcttggctcagtgcaacctctgccttctgggttcaagtgattctcctgcctcagcctcctgagtagctgggattacaggcacacaccatcacacctggctaatttttgtatttttagtagagatggggtttcaccatgttgatcaggctggtctagaactcctgacctcaggtgatccatccaccttggcctcccaaagtgctgggattataggtgtgagccaccatgcctggcccactctgtcttttaactgatgagtttagaccactgacatttaaagtggttatcgatatagttggattaatatctatattgggttaatatttgctactgttttctttttgttgttgttgttgttgtattttttgtagagatggagttttgtagagattggccaggctggtctcaaactcctggcctcaagtgatctgcctgcctcagcctcccaaagtgctggaattacaggtgtgagccaccatgcccagccattatttgttactgttttctattcaagccaattttcaaaactacatctttatcctttctttacacaaatactctcttttaataataatgtcattctctttaatacagcggtactggctacatttcctgggctttgcttgcccatatatttaaagcttaaatcggctaaggagagtatataattgatcaggagacaacttgtagagaaaaactgcttgaaggtctctgtttttgcctgacacctaacttaatcctcacaggacaattatgaggtatcctctgacaagagagagttgacatcattttcctaattccacaacagaagaagcagaaacacttgctgaggcatctcaggtcatgcactgaaagtcatattgccagcaaggggtgcggtgggatttgaatccaggtagtctgatcctgtgcccatgctctttaacttagtcacactaagcagatggtgccctcatagttttgaagggggtgagccaggtaagccaatatcctctgtgatctgctactggggccagggaagaagtatgttccttgaatgctccatgctctctcaggcccacaggacctcatgcatacatgctgttcctctgcctggacaattcatcacccaccttccactcagcttccagtcagctgccaaccaccttctactcagctaactgccactcagccttcacacctgaaattactggccactcacttggggagaatgtcccccctaaacaaggttatagtttcctgccacatgccattagagcccactgaattctatcacactgcacattcatcagggttgaagattctttacttgttgtatgcctcccccagaagatgatgaaacccctgaaatcagggtccttgtctgcccttcccaaccctgaggccccaaatccccactgcacagaagtgtgaggtccagagatcttaaaggaatcgtgtttttgctgggaacaaatggttagtggtgacaggaagtgggggtgctaacatatacaattattcaacacctctttcctgttcatcctggaaaagttaggggtggatgaaaagttacagctaaaggattgacatttttgtggaatcaaaaccaatggatttctaggagagagactggttaggttattggattataatacatacctgtgggattatatatttgaacaaactaatacattaagataaaatgctcaaaggcagatacctaaatagagatgttcactttacacagtaattaatactagaacagccattgaggttttaaaaagtgaacattgtagtatactatattagtctgctctcacactgctaataaagatgtacctgagactgggtaatttataaaggaaagaggtttaatggacttgcagctccatttggctggggaggcctcacaattatggcagaaggcaaaggagaaacaaaggaatgtcttacatggcagcaggcaggagagcatgtgtagggaaactcccctttataaaaccatcggatctcgtgagatttattcactatcacaagaacagcacaggaaaatcctgtccccatgattcacttacctcccacttggtccatcccacaatgtgtgggaattctgggagctacaagtcaagatgagatttgggtggggatgcagccaaaccatatcatatactaagtgaatgaaacagaaattaattgaaattaaacaatgtctgtaacagagcgcctgttacatggtgggtgctcaataagtattagttatataagtaagtttatgcatcattttctcctttagttggtatttgtggagtacttactatgtgcttcacctgggccctatgtgctctctgaaaagctttctgtgtttcctcagtaagtactctctcctgttctacatacagctttttcaaattatcttacctttcataagaccagttctctgacttatcaccaccccccatacccagtcatagcataaaatctggcctactaaatcaccaaggaaagggaaaatatatctagtaattttttaacttttttgctacattatagttaatacaccaaaaagatcacccattgtaactctaaattgagacaacttataggaaatgtttacagttgtacaaacatcattactatgcagttcaagaacacttttgttatcaataaaagttcccttgtgaccatttttaacagctttattgtggtataattgtcatataataaaccatgtgtgtttaaaaaagtgtacaatttgatgttttgacatatgtatagacttgtaaaaccatccctacattcaagataatgaatatatttatcacccctaaaagttttgttttgaccctttatcattcattcttcataccctgctcacttcttcttatgctcatgcaatcattgaactggcttctattcttttttattaatttgcatttcctagagttttatatcaatgccatcagctatactatgtatttttctggcttctttcactcagataattattctgagattcattcgtattgtgtgtatcaatagttcctttgtttttattactgagtaatattccattgtatgactatgccacaactaaccattcatcagttaatgggcagttacgctgtttccagtttaggggtattacaaataaagtgtcaatagacattcaggtaaaactgttcacatggtgtcttaatctgttttgtgttgctgtaaaagaatatctgagactgagtaatttataaagaaaatatgtttatttggcttacaattctgcaggctctgaagtacaagaagcatgatgccagcatctgtttggcttctggtgagggtcatgtgtcggtcaaaacatggtggagaaggccaaaggagaagcagacacatgtgaaaacagaggacctgagggacatcctggctttataacaacacactctcatgggaactaatccattctcagagaagaaatccagcctttcaagaactcagtaccatgagaatggcaccaagccattcatgaaggatctgtccccatgacccaaacacctctcaccaggcctcacctctcaacactgccacattgagaatcaaattgccacatgagttttgttggggacaaacaaacctcatccaaaccacagcacatagatatatattttctttactctttgttaaatacatagtagtggactggctggaccatatgatacttatatgctttttaagtaactaaaaaactgttttccaaagtggctgtgcaattttacatttcaactgggagcatatgagagttctagttcttccacattcttataacacttggtatggtcagactttttaaattgtagacattgtaataggtatgtagtggtgtctcattggggttttagtttgcattcccccaattactgaagatgttgagcatattttgatgtgcttacttgacatctgttcaaatcatttgcccatttttaatttggttgtttgttttattgttgtattttgagagctctttatatattatagatatatgtactttatcagatacatgctttgaaaagagtttttacccagtatgtggctttttttccattcttttatcattgtttttctaggagcactttttactatcggtgaaataaatttaacaatttgttatgttgtggattgtgctttttatgtcatatctaagatatcttcacataaaccaacatcatgaagattttctcccatcatttcttctagaaattttataaatttagattttacagttagagctttggtctattctgagttgcgttttatggtatgatatatggctccaactttaatttttgcatatggatatccaattattttgtttaagaaagtctatccatttctgcactgtcttttgcacctttgcaaaaacaaaaaataagttgtccatttctgtttgggtttgtctgcactttctattttgttccactgatctatttatcaatctttacatcaatactgtggtgttttgattactgttgctttgtaaaaaaacatttgaaataaagtggtagtagtccttcaatttcgttctttttcagagttgttttgaataatttaggtacttttcattttcgtatttcatatttcatatagcattttcttgtcaatttttgcaagaaaagccagctgtgatattgactggtattacattgaatgtatacatcaatttgggaataaatgatgccttaataacatcaagtctttgaaccagttaagatatatctcttcatttacttaggtcttcattaatttttccccaccatattttgttgttctcagtgtactggtctgatatggtttggctctgtgttcctacccaaatctcatgtcaaattgtaatacccatgggtcaggggagggacctggtgggaggtgattggatcatgaaggccgatttctcccttgttgttcttctgatagcaggtgagttctcttgagatctggttgtttaaaagtgtgtggcacttcttccttcactctctctctcctgcctccatgtgaagaaggtccttgcttcctcttcgacttctaccatgattgtaagtttcctgaggcctccccgtcatgcttcttgttaagcctgcagaactgtgagtcagttaaacctcttttattcataaattacccagtctcagataattctttatagcagtatgaaaaaggactaatacaagatctttcatgtgttttgtaagatttatccttaagtacttcatattttacgctcttgtaaatgattatgtagtttcaatgttcaatttttttattgcttatatatggaaacacaatttttgtatcttgactttgtagttccctaccttgataaatgtgcttatagttccaataggtttttgaagatttcatctaattttctaaatgagcgattacatcatttatgaataaagagagttctacttcttcttttccaaactctgttacttttcgttttcttactgacttcactgcctagaaccaccagtctaatgcggaatggatgtggtgagtgtagacatttctgtattcctcatggtgtgtgtgtgtgtgtgtgtgtgtgtgtaaggggagaccttccttcctcccttccttccttctttcctctttttctctttctttcttttttctttcttccttcctttgtctttctttctttctttctttctctttctttctttctttctctttctctctctctccccttccttccttccttcttccctccctccctcactccctccctttcttccttccttcctgcattccttccttctttcttgcttcttagagacggagtcttgctctgtcacatagctcactgcaacctccacctcctgggttcaagcaagcctcccacctcagcctcccaagtagctaggactacaggcatgcaacaccatgcccggctaattttttaattttttgtagagacaggggtcttcccctgttgcccaggctggcctcaaactcctggcctcaagtgatcctcctgcctcagcccgcaaagtacttggattacatgtgtgagcaactgcattcagaaagttttttgttgttaaatatgttagctgtaacatcatatttatacacatcctttataaggttgagaaaattttctttcatttctagttttctcccagtgcttatcaggaatggatgttggggtttctcaaatgctttctctgcttcaatggaaatgatcaaatgatttttcattaaagtttgctaatatggtaaattacattgatggtttttgattgttaaatggctgggcatggtggctcatgctgcctgtaatcctaacattttgggaagttgaaatgggaggattgcttgaggacaggagttcaagacaagcctgggtgaaatagtgagacccccatctctacaaaaaatacaaaaaaaaaagtaaaaaaaataagcagccctgaattccagggataaaacctagctgactatgatcatcatatattcctttaatcattttgatatagttttatttaattcctttaacatatttataatactcgctttaaatgctttgtctgctcaatataacatgtgagcccattcagagtaactttctattgccagggtttttttcccattttgttgcgtcataagttttgtttgtaaactagatattttagatagtgttttatagcaattctagattttgttttattttttacttattttttttgcaagcttcaaacattttattttattttattattattatactttaagttttagggtacatgtgcacaaggcgcaggtttgttacatatgtatacatgtgtcatgttggtgtgctgcacccattaactagtcatttagcattaggtatatctcctaatgctatccctcccccctcccgccaccccacaatcatccccggtgtgtgatgttccccttcatgtgttcatgtgttctcattgttcaattcccacctatgagtgagaacatgcagtgtttggttttttgtccttgcgatagtttgctgagaacgatggtttccaacttcatccatgtccctacaaaggacatgaactcatcattttttatggctacatagtattccatggtatatatgtgccacattttcttaatccagtctatcattgttggacatttgggttggttccaagtctttgctgttgcgaatagtgctgcaataaacatacgtgtgcatgtgtctttatagcaggatgatttataatcctttgggtatatacccagtaatgggatggctgggtcaaatggtatttctagttctagatccctgaggaatcaccacactgacttccacaatggttgaactagtttccagtcccaccaacagtgtaaaagtgttcctatttctccacatcctctccagcacctgttgtttcctgactttttaatgattgccattctaaatggtgtgagatggtatctcattgtggttttgatttgcatttctctgatggccagtgatgatgagcattttttcatgtgtctgttggctgcataaatgtcttcttttgagaagtgtctgttcatatcctttgcccactttttcatggggttgtttgtttttttctggtaaatttgtttgagttcattgtagattctggatattagccctttgtcagatgactaggttgcaaaaattttttcccattctgtaggttgcctgttcactctgatggtggtttcttttgctgtgcagaagctctttagtttaattagatcccatttgtcaattttggcttttgttgccattgcttttggtgttttaaacatgaagtccttgcccatgcctatgtcctgaatggtaatgcctaggttttcttttagggtttttatggttttaggtggaacatgtaagtctttaatccatcttgaattaatttttgtataaggtgtaaggaagggatccagtttcagctttctacatatggctagccagttttcccggcaccatttattaaatagggaatcttttccccattgcttgtttttctcgggtttgtcaaagatcagatagttgtagatatgcggcattacttctgagagctctgttctgttctactggtctataactctgttttggtaccagtaccatgctgttttggttactgtagccttgtagaatagtttgaaatcaggtagcatgatgcctccagctttgttcttttggcttaggattgacttggcaatgcaggctcttttttggttccatatgaactttaaaatagtttttttcagttctgtgaagaaagtcattggtagcttgatggggatggcattgaatctataaattaccttgggcagtatggccattttcacattattgattcttccgatccatgagcatggaatgttcttccatttgtttgtatcctcttttatttctttgagcagtgatttgtagttctccttgaagaagtccttcacatccattgtaagttggattcttaggtattttattctctttgaagcaattttgaatgggagttcactcatgatttggcctctgtttgtctgttattgttatataagaatgcttgtgatttttgcacattgattttgtatcctgagactttgctgaagttgcttatcagcttaagaagattttgggctgagatgatggggttttctagatatacaatcatatcatctgcaaacagggacaatttaacttcctgttttcctaattgaatgccctttatttccttctcctgcctgattgccctggccagaacttccaacactatgttgaataggagtggtgagagaggtcatccctgtcttgtgccagttttcaaagggaatgcttccagtttttgtctattcagtatgatattgactgtgggtttgtcatagatagctcttattattttgagatacgtcccatcaatacctaatttattgagagtttttagcatgaaacgttgttgaattttgtcaaaggccttttctgcatctattgagataatcatgtggtttttgtctttggttctgtttatatgcttgattacattattgatttgcgtatgttgaaccagccttgcatcccagggatgaagcccacttgatcatggtggataagctttttgatgtgttgctggattcgatttgccagtattttattgaggatttttgcatcaatgttcatcaaggatatttgtctaaaattctctttttttgttgtgtctctgcccggctttggtatcaggatgatgctgacttcataaaatgagttagggaggattccctctttttctattgattggaatagtttcagaaggaatggtaccagctccagcttgtacctttggtagaatttggttgtgaatccatccagtcctggcctttttttggttggtaagctgctgattattgcctcaatttcagagcctgttattggtctattcagagattcaacttcttcctggtttagtcttgggagggtgtatgtgttgaggaatttatccatttcttctagattttctagtttatttgggtagaggtgtttctagtattctctgatggtagtttgtatttctgtgggatcggtggtgatatcccctttgtcattttttattgcatctatttgattcttctctcttttcttctttattagtcttgctagcagtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggagtcaattttagatctttcctgctttctcttgtgggcatttagtgctataaatttccctcttcacactgctttgaatgtgtcccagagattctggtatgttgtgtctttgttctcgttggtttcaaagaacatttttatttctgccttcattccgttatgtacctagtagtcattcaggagcaggttgttcagtttccatgtagttgagcagttttgagtgagtctcttaatcctgagttctagtttgattgcactgtgttctgagagacagtttgttataatttctgttcttttacatttgctgaggagtgttttacttccaactatgtggtcaattttgggataggtgtggtgtggtgctgaaaagaatgtatattctgttgattaggggtggagaattctgtagatgtctattaggtctgattggtgcagagctgagttcaattcctggatatccttgttaactttctgtctcattgatctgtctaatcttgacagtggggagttaaagtctctgattattattgtgtgggagtctaagtctctttgtaggtcactaaggacttgctttatgaatctgggtgctcctgtattgggtgcatatatatttaggatagttagttcttcttgttgaatttatccctttaccattatataatggccttctttgtctcttttgatctttgttggttgaaagtctgttttatccgagactaggattgcaacccctgcctttttttcttttccatttgcttggtagatcttcctccatccctttattttgagcctatgtgtgtctctgcacatgagatgggtttcctgaatacagcacactgatgtgtctggactctttatccaaattgccagtctgtgccttttctttggagcatttagccaatttacatttaaggttagtattgttatgtgtgaatttgatcttgtcactatgatattagctggttattttgctcgttagttgatgcagtttcttcctagcctttatggtctttacaatttggcatgtttttgcagtggctggtactggttgttcctttccatgtttagtgcttccttcaggagctcttttagggcaggcctggtggtcacaatatctctcagcatttgcttgtctgtaaaggattttatttctcctccacttatggagcttagtttggctggatatgaaattctgggttgagaattcttttctttaagaatgttgaatattggcccccactctattctggcttgtagactttctgccaagagatcagctgttagtctgatgggcttccctttgagggtaacccgacctttctctctggctgcccttaacattttttccttcatttcaagtttggtgaatctgacaattacgtgtcttggagttgctcttctcgaggagtatctttgtgacgttctctgtatttcctgaatttgaatgttggcctgccttgctatattggggaagttctcctggataatatcctgcagagtgttctccaacttcgttccattttccccgtcactttcaggtacactaatcagatgtagatttggtcttttcacatagtcccatatttcttggaggctttgtttctttttattcttttttctctaaacttctcttctcgcttcatttcattcatttcatcttccatcactgataccctttcttccagttgatcacatcggttactgaggcttgtgcagtcgtcacgtagttctcgtgccttggttttcagctccatcaagttctttaaggacttctctgcattggttattctagttatacattcttccaatttgttttcaaaatttttaacttctttctcattggttcgaacttcctcctttagctcagagtagtttgatcttctgaagccttcttctctcaactcgacaaagtcattttccatccagctttgttccattgctattgaggagctgcgttcctttggaggaggagaggcactctgatttttagagtttccggtttttctgctctgttttttccccgtctttgtggttttatctacctttggtctttgttggtgacgtacagatgggtttttggtgtggatgtcctttttgtttgttagttttccttctaacagtaaggaccctcagccacaggtctgttggagtttgccggaggtccactccagacgctgtttgcctgggtatcagcagtggtggctgcagaacagtggatattggtgaactgcaaatgttgctgtctgatcgttcctctggaagttttgtctcagaggagtacctggtcgtgtgaggtgtcagtccgcccctactggggggtgcctcccagtttggctactcaggggtcagggacccacttgaggaggcagtctgtccattctcagatctctagctgcatgctgggagacacactactctcttcaaagctgtcagacagggacatttaagtctgcagaagttattgctgtcttttgtttgtctgtgccctgcccccagaggtggagcctacagaggcaggctggcctccttgaggtgtggtgggctccacccatttcgagcttcctggctgctttgtttacctactcaagcctgggcaatggcaggctcccctcccccagcctcgctgccaccttgcagcttgatctcagactgctgtgctagcaatgagcgaggctctgtgggtgtaggaccctctgagccagtcacaggatataatctcctggtgtgccatttgttaagcctgttggaaaagcacagtattagggtgggagtgacccgattttccaggtgccatctgtctcccctttctttgactaggaaagggaattccctgaccccttgtgcttcctgggtgatcatgcacggtgtgctgcacccactgtcctacaccgtctggcactccccagtgagatgaacccagtacctcagttggaaatgcagaaatcacccgtcttctgcatctctcacgctgggagctgtagactggagctgttcctattcagccatcttggctccactccctagattttgttttaattatatgaattttttctggagagttgcctggctttagcattgtaatttgtcatctcatggcaagaagccactgaggtctctgtttaatttttttatccttgtttttattttttattctggattcctattagtcacccctgtatctgcatatcttagtgatcaggcaatggtttggccagagattgttttaaaaaacctgaagcctgtaaagcttctacactcagctgaccaatcaatccatcaatcaatctgtgtgtggattggggagcacaataaacatttcagtcaattctcaagcctgccttcacttttacttttctctgagctctcctgggtctctcccatacatgtgcatattttcccagtcacacaggatatatgaagacctactgttgtgcattcattttcaaaatctctttattaaattcctctctgatcctctgcttgccccactgtaacctcaaacttaggcaaccaaatggacagattttaccatttgattcctaatgagtatacaactcttaactaataataacccagcttttcaccatctgacccaaatggaattcacccactgggagaaaagctgctaaattgttttggtcggcacatactgtaaacctatccttctcaccttgggatctaaggagattgaggggtgggctggatggaagaagccccatgcaaggacacagattcttttacacacagatctagcagtttttcaaggttaaacacttattaataatttgtttaccttgagtatattttcagagccccaaaacacttgtttttgacaattttgtccagccttattcttgtatttggcaaaaaggattaaccaaactcttcaagccaccataaccagaatttcacatcaggtgtaattttcctcattttctttcaactaaacctaaaaacttttttgtagtcattctcttattagttagttattgctgcaaaacaaatgacaccaacacttagtgcttaaaattatattgatttatttaactcttcttactctggtgagcaatttagtcttagctcacctagccagttctgatctctgctggattcatttacatttgtgtgatcaactggtagattgactgggagctggatttttttaagatggccccagataagatgtctcatctcttctgtatgtggtctgtcatcctccagccaattgacccaggatttcaaatgtcagctgagtaagattccaagagggaaagcagaagtgtgcaaggattctttaggcctatactcagaattagcaaaatatcatttattccacattttattagtcaaaaggttgtaggaaaatctgggttcttttcacatgaccaggaaagattaggcttgcagacactttgaaaggtgaggggaaacagaatttattggtcaagaaaggaaaaagagagaaaaactttcagtagagtgagagggaagcctgttaactggatctcatcccaccacacaggaactcaagagactgggctcctctgcgaatggcgtgacattccatgacaccatactcttctcccagtgtgcaggccagttggagtttctttgggaccagcagtccggtttttcagcctttaggctgttttagtcttgaaggcagggttttgctgggcagcccttggctgcctcctgtctctaccattcccccttctaaagaagtacatctaactgtccctagagtaagaataaagataaggatgaagactgatctcaactgcttcctgctgagagggggtgctgttttgggaaaatggcagtcagatctccctcagagagaggtctgaggctcctgttgcatgaccatttggactttgatggcctgaaggtgagataagacaaaccaggttattagaaaacatatcaaaatgaaacaagggtgagtaaggacagcttaggaattctgaggcctgttaccagtttgcatggggagagggaagccaataactggactggcaaaaacacttttacccttttgatggcatgtcagacttctgggttcccttcccttgagcccaaccctaagccaaccagtttaaagtttgggaaattaactttccccattttggaagatgcatccaaggggagtgtcccatagtatggagacacaattacctattggtgaagagaggacagaggaggagaaaagaaagaagaaagcgttttttttcaaaggagtcccagggttttgggatgcatttgaaaggggtacagactgaagatggatggctactcttctagtaagaggggagcaggtatccctggttcccttctcttcccagcaaatacacagggtacatgagggggagaaagtgaggcactcctctttctttcctccatctttgtatccccgagtcccagtgaccacaacaggttgccacccatgagtgccaaagcagcttgcacctatgaagcagggatggcctagagaataggaattatccactctcacctgtgcctctatccccgctactgtcagtagccttggagttcactagacctcacttatgctatacataccagcttgacatttatccatgaaactggaggcttggcttaatcaacaggaattagccaagctcacctgcactgtacctttaacctctgttatcaactgcctctggatccctcagatccaattttctttcctagggctttgacccaaagcttggaataaggttgggaccaaaatgtgtcttggggagattgcatggattccttattatcagctgcatgctaaggtgaagctgtggaattgagtcctcctcaaacaaggtagagaagaggatgtctcgtgacatgcccagacaacttgtggctatacttatgcttgttaagatttgggcacatgatgcttggctttggttagcaaccttggtctcactttcccaaaaaggaaacctctggctgatgggcaccctatttattcccatacctggcaggatttgcaagataattgctcagaacaagaatattgatccagatttctacagtacccatctcttttgttctttctgagctgcagccagagattgctagttggttcacaggaacaagcagcgttagtctaaaatgtaggcaaaaacttaaaaacaactaataagtctagaatttaatgacaagtgtatgataagttttgaaacaaaatttctgtctctctaatcctaatttttgttaaaagaaatcatgataggactgagtcgtttgcaaaatagactttagttttagacttagcctgattatttgcataaaatgcagcaagaataactatttctacataggccttttagattggctttgctggaactctgttccataaggaatctcagataagaccttttaaagctgagcccagccatgggtttttatcctcaaatacatgtgagttgggtgatcctctcctcttaaggtcccaagataaacttggagctcctgggcctgttagaaagtgacattctttactgaccacaagtaaggaacgctgtacagggactgcgtagatgagggtatgaggccagtttccccgaggggcttttatcagctctgcaaatcaagcttgactccttaaaggggagcatacccttccagtcaaagccttggtaaagcaaccagtttcttcaactgcatcctgttgcaaaagaaaatggattcttattgcactgatgcaaacagctagattaacacgagttaagaatactcacagatagcttctaaattctagaggaaccaggccaaaagaaacaaacatgctttaaattttgttcacaggagtataccttactcaattattaagggccataaatagttcaaaataagtttccttgactctgaaaaacaaaacaaggatcagcagtattccaagcaaaaataaaaaaggttgcgtcagtttcctgagttcattctgttggctcttgttttgcttgatattcacgaacatttcagctcttcatgagccctgtatgtttttcctttattccaatgtcacaatctccaaagttatcagaaacttgtatttgagagcacttgtcaaagttctatagcttattataaaccattttttgaaaaggattaaaacaagacaacaattgtctgtgaataacaaaatgtctagggtagttacagttagaaacacaattgacaaagaagtttggttatctctgtcatttacaataacttaacataacaaacttaattatgattgatagcattatactttagacattagaattttgggctgggaacagtggctcacacctgtaatcccagcactttgggaggctgaagcaggcagatcacttgaggttaggagtttgagaccagcccgcccaacatggtgaaaccccatctctactaaaaatacaaaatttagccaggcatggtggcatgtgcctgtaatcccagctacttgggaggctgaggcaggagaatcacttgatcccaggaagtggaggctgtgctgagccaagatcatgccaatacactccagcctggatgacagaatgagactctgtctcaaaaaataaaataaaaaataaatagatattagaatttttggaatcccatacaattttggaacatatattggtattattctccaaaatataacttaaagaagattgaacattattttgcaatttcatgcaactaaaattgtcaaataatcctgtttacctctcatctctgaacattccaggggcccttctgaagtatctgaaaagctaggtgtcaagaaagacaattttgaaactgaagtttgattttgggaagcctattacatgtgttagaggtttgaaacacttggtgttatgaaatagaattccagattaccataaattatttagtttcccaaaataatgactcagaaatgtttaaaaagcaaaacaaccttttataaacctttacaaattttgctaaagagcagattagtgccttgggagtaccttgttttgcttttattttaatcctcaatttacagaaaaaccatataatacccttttgaatttaatcaatatgttcacacagagaatttcttttacaagattgatttttacaatccttcctccacttgtttgaacctttagctttatcatatctaatttaaaacaattctttaacccaaggcaagaatttacatttttatgccttcttataaccttttattacaaacacattttatgttcttatacacctcgcatgtaaatctattttcagtagtttcaattacatttcataatggtaactcctagcaatttttaactttaatgtaaaacctggtaagttgttttaattttctaagtacagccaagatttgactccttccagtagaattaggggcatggttagttccatatgtccccaggccttaccaagttgaacaggcattaccaagttgaacaaaaaccaaaaagcagtgtataaccttaaaacactcagcaaacctttcatcttacctgcataatttagtccacttatttatattttaatgacatctgcattttaccaataatctttatagctgtttttatttctcaaagattaaagtcacatgaactaaaaggtaccacttttatcttacctttaaaaaatatttgatccaagtgcttatcttcctttaggccaaattaattagagttctttttacagatatcacatatacaacacatatataactatacagacaggcagaagaaaatccagttgccataaaatcttccatcagaggagaaggatctatccacttttaattcctggggttcttatgagaaaaatagaggtctcttgcctcatacatgcatcgagagtggcaagacaaaatcaagaaaaataattcagctgactgagaacaaaaaacctttttccagcaaaggagatccaaggaaagaaaacataaaggccttttaaatataaccataatttggatatgcacttttaatgaagctgagcactccttaagaaaaccattttaggccaggcacggtggctcatgcctgcaatcccagcactttgggagacagagatgggtggaacatgagatcaggagttcaagaccagcctgaccaacatggtgaaatcccatctctactaaaattacaaaaattagccaggtgtggtggcacacacctgtaatctcaactactcaggaggctgaggcaggagaatagcttgagcccaggaggtggagattgcagtgagccaagatcatgccatcgcactgcagcctgggtggcagagtgagactgtgtctcgaaaaaaaaaaattgctgggcatggtggctcacgcctgtaatcccagcactttgggatgccaaggcaggtggcttacctgaggtcaggagtttgagagcagcctgatcaacatggagaaaccccatctctactaaaaatacaaaaattagccaggcatggtggcacatgcctgtaatcccagctactctggagactgaggtaggagaattgcttgaacccgggttgcagtgagctgagatcgcaccaatgcactccagcctgggcaacaagagcaaaactctgtctcaaaaaaaaaaaaaaaagaaagaaagaaaatcattttaactcccttattatctgactttagccatgccaatcagccaatatttctggctttcaaactttgctaaaggctcagagaaaggacaatccaaggtggttcgtggaggggaggggaatcaacaaatagcaaaaggtcatgcagatataaaaccagaaaggactcataccctaagccaggattgaatccgcaccacaacagtgagaatgccaaatcctaaccaccggaacaccagggagagaagcttaattgctgttggatgaagctggactccctagctggaaaagaaggagaatccactagatgcatggtggggaacacaggccagcctgctgttgggcacccttgggccatgcattccagccctggctgtgaagggagttggggggccaccattccccactccatcctgcacatgcctgcagccactgggatgtgccatttcctctaccctcagaagagatccgaggagaaaaaaggcttagaagcaaaaggaaaaaaggttttttgttttgcatgatactcacccttcctcaagccccatgttgggtgccaaaaaatgtaggaaaatccgggttcttgtcacaaccaggaaatattgggcttgcagacactttgaaggctgagggaaatggaatttattgggtgaaaaaggaaaaaaagaaaaactttcagcagagtgagaaggaagcttgttaactgactcctgccccaccacacaggaactcaagaggccaggctcctcccctctgcaaatggtgtgaacttctgtggctccaccccattctcccagttcacaggccagttggagattcttggggactggcagtctggtttttcagacttcgggctgttttaggtttgaagacaaggttttgccaaggctgggcacgaggatgccttggctgcctcctgtctctatcaaaaccaagtcacaagaccagtataaaatggacaaatcaggcaaaaaaaaaaaaaaaaagatactgactttgtttataggtagttccacgaaaaatcgtcataatggatggatttgtcccttatgtgttttcatttccagacaccccttatttatttgtaagtagaaaaattatttcctttccaaatatggatgtttaatgttactcgatattttccttctactcaataatgatcaagagtcataatgataaacatgaataatttgtaggtcctgattacattgcaggtcctgattacattgctgctacaataattatttttggtccaattttatggatgaagaaaatatgatttactgagtaattgccccaaggttaagaaataggtaagcatagatttgaatccatgtgtgtctttccagatcttgtgttctttccatatttcaagttaatatattgagagttctaagaaaactatcacagttgcagcccatttcaggcagtgggtgggctagaggtaacatatagaaatgaaaactgtcatattttggttcctgatacagagttttcatttgctgttcatcacacacagccttatctgggtgaaaagcacaagtaaaagcttgaaatttcacttgatggtacttgatgaaggtttattataaccaactggaatggactaaggtctaattatggttcaaaggtcaaagtaaagtctgatagcatgattgatatatgcagccgaaaagattacagattaagctttttctttctcagtctaccagattattgggttggaaaagatattttttctttgtttgactaattttcagtgttgcagtcatcccttggtatatgcaggggattggttccaggaccaccacccaccccactccacacatactcaagtcccccagtcagccttatggaacctgcttatatattaacagttggccctccttatatacaggtttcttgcatctcccagatgctgtattttttatctgcttttggttgaaagaaatatgcatataagtgaacccatgcagttcaagcccatgttgttcaagtctcaactgtatctagtagtattttttagttgtgaaactgtaaagccataaatgtattaaggaaattacccaaagtcaagcaaccactcataacatctgttcagtcatttttccatctatagtaggtgaatgtttgtatattttatattagcaagtatacactctttcattttcaccttagatattttagttcatttttctgactaaaagcataataattttaaaagttaaaaagcaggccaggcatggtggctcatgcctataatctcagcactttgggaggccaatgtgggaagatcacttgaggccaggagttcaagaccagcctgagcaacataatgagaccccatctctacaaaaaattttaaaattaaccaggcatgatggcatgcacctgtagtcccagctactgaggaggctgaggtgggaggattgcttttgcccagggggacaaggctgcagtgaaccttgattacaccactgcactccatcctgggcaacagagaaagaccttgtctcaaaaaaaaaaaaagtaaacactaaagaagatttagggggaaaagaagagtaactcatctgtatagggtccccccaaattaaaatacacactaaccatcatgatactggttaaacaaatatttattatttataagcaagccgattgtatgtctagaaaaaggaagacagttgacagtgaaaataactgtcttagaaaaagtgcctaataaattgtctatgtacacaacaaatattcacaaattgatatttctcaatataccataaataattagctgttgacactagccataaaaacataatgtttagaaattatatgaaagaaatgtgggtcctgtatgaaaagaattattaaatggagtgagactaagtggtgatttgaataaattgaaatatttgctttaattggatttgaagactgaattgtaaagatattagtatttgatacactcaatagatgttccaaaggtattcagtaataattaaacacctattctcattttttaaaatatatatacttaaagtaaattctagtaggctatattgaggtgatttttttccctgtaaaaaaagcacagaatggttttatacaaccagaggaaatttcattaaaatcaagaccaagacaaatatgttcattatccctagtattatttaatattgctttagaaattatctttactgttaagagatgttaaaaagaaataagttctgtaacttttgaaaaggagaagacaaagttatcattgcttgcagaagatagggatatagtcctggaaaacattagaaacaacataaaatgtcttggtataaatgaattttacaaaaggatagaataaatggtaactatttaaaatatcaatagcttttatgcatatcagaaagccttacatataaaacataatgggagaaatgatgacattcacaataggatctagttttaaaaatgataaaaattgcgaattctgaaagaagatttgaataacaaatggagagacagttttgcagagctaggatgatggtagtggtgactggaatgatgaggaagtcatcacaaagcccctgttgaattacagttttcctaggttccagccatatcacaaggatccctcacaatcatcaggaacagttatgtctcatctatgtgtcattttgtggaataattcaattccacaaccgattatgcccctctaattcagtgtctttgcaagtacctgtatcagagggaaggggaaagaggagaaagacatgctaaaatgggaaaaaagttatgaggtaagccagccttttaatgataatagcaggcaaaaccttatttctagaacacgagggccataacttactgattgaataaaatcccaatcaaaatgccaatggaattttatttgtagagctttacataaccatgttaatattcacgtattagaataactaggaaagaatgcttaatttttaaggaagagtacaatcattttcaaggggatggcattctgatgcctggatttgcaataattattaaatatttcactaatgttgcataagtattatttgctaactgctttgaactttaacccccatcttttagcttcaccaaaaagcagagaaacaaaaacaaccacaaaacttggttttgtaatggaaatttaatctatggtcaaatgagttaatgcttaacattgcctagagtcaaaaggaaagggaagggctgaagtaatccagcattggttgagcatgatctatttgccaggccctgtgttaaacacttcatctcctttaattctgataacatattggtattaatgtcaattatataagagtaaaccaaagattagatagtatttgggattggaattcaagtttttctggctcccgagcctatgctcgcacactaccactgtgccttgtctaaccaattacttcactgagtgctgttgtttgttatggcatttttcagtggtagacagcatttacaacttagatcaggtactcacctgctgaaaaacactatgttctctggaaagcgtttgatggttttgtttgtttgtttgtttgtttttaagactgagtctcactctgttgccaggctggagtacagtggtgtaattgcggctcacagcaacctctgcctcctgggcccaagcgattctcctgcttcagcgtctcgaatagctgggactacaggcgcatgccaccatgctcagctaatttttgtattttttagtagagacaaggtttcaccatattggccaggatggtctcgatctcttgaccttgtgatccacctacctcagcctcccaaagtgctgggattacaggcatgagccactgcacccagtctgctgtgttttttattcttcttctgcatgatatagtaatctcgagctttatcctaatacatatctgcattccagtcacattcccaccagttaatagctgtgtaaccttggacaagctacttaaacatttggagcctcaattccagcagcatacatacaatttcataaagcaacccagaaaagaggatagtccattttgtcattactccatgcaactattttgataaaatctgcaccttcacaatgaattcaatgacgtttatttggggtaatgatattgttgcattgcctctcttgtgcattaaatattgggtgttttttatcacccagcctagggtgaaaagtaaagaaacaaatgtggctcacacttagccacttttaaatcaaaagttcaaataaataaccaagtcaaaagtctgaatacagaaaatttttacttttctatataacaagagagtcacgtatatagaactgttggatataagctatcctgccaaatggaatagcatcatttttcagagggagagattgacaaaaatgtatttgatatactgacaccaagtatatgttaagggcagtgctagttgtggagggcacatagacaaattatatagagtttctaccctcaaggtttttacagtctagttgcggttggggaagaaaaacagacaaatcatgatctttcttgatgatctcttctgtgctataaagaatttttttctctcagtaaggcttcagttagacatcagtgatgctgagaggttaaatgactaagattgtaagtggtggagctgggacttaacgcttaggtatgtttacattaaagctgatctgcttccattcattatggcaacagtttacttatgttatatgtagtgccgtttataattcccagtgagagagtcatcctgtttcccaaatgattcacatctgaaaaatccaggcacacaacatgcccataaaggccagatcacccagtcaaagctcaaataaagtgtgttgaaaccaacaggccagttgtccttattcttgactattttttgtgttaggaaggagcagataggttagaaagtgagagtcacaatattgagcccttctacgaaaagcatatgtttttggctgtgaaggtggcagttacctctatgcttttgctatcttagtggggaccaatcctaagagagcagtttctcaaaaacagctgttatctgggaaaggggaggtgaaaggcctaactcagaaactgagctactcacagctaggcagagcttctcacctcagtttctcttgttggcaggccccagaaacagtttctttaaagacttcagcagatcttttcaagtagatttattgatagaagagccatgagaaatattttggtggctataaataaaaacatatttgcaggttcaagtcaacagacccagaattgaaaactgacttggccactagttagttgttttgtattcattctagagcaattcaagccacattgtattcactcaataaatattcattgattgaatgaatgtgtttattccccccattaggctgtgagacccttgagggtaagagccatatttcattggtctttgtaaatcacatccagttcactgcctaaattctgttaagtatcactgaattttaaattaattattctttggtaagaaacactgatagggaaagcattcgcccaatgtgaacataatacagaagatactattgatgtaggcaccatgtattttgttggttgtataccaagcaaactcttctaatcagctgagagtctgtgagggcaaagatgtctgactcattatctttggtaatgcacagtagctgacatattacagtacatgtaatgatttactgcagcatttcctagagctttttcatttgagtgtcactcagggtttttgctttatctgtgcacagtctgtatgtttatttacttaacatgtttctgtggtatctttgaaataaaaggtatcacttgaaatgaaacgtaactctacgattaaaaactaagaacaaaaaataatgttactaaatatttttaaatgaaattaagattcagtacaagtagtagtaagctactaatgtgtgttgcactaacattttatataccttctctcttttaatcctcatgatagctcttctaaaaaatattttcccattaccacagatgagattaagatctaggtaagttacgtaacagcccagtgtcacacagctagtgtaagggagggccaggactctaaagggagcttgttttttaatgctaaagccaacgtgggatgcagtataggcaatccttaactttattattcccaagtgattccacctggccccttcccctttttcttattgatccagctctccttggttctcagaccacctcctggttacactttaagcagctcttcatcccacaggtcattcccagaccctctggcccactgccaatacacccaacaccaagttctgttagagcagaggaaagatggatatcttttcatctttctgagaacaaaaaacaattgctatctatactttattgagaactattaaggagtgagcatcctgaggaaggctctttgagatctggtttctgggcataagaatgcagatagggacttcagggagagattgaaattgtcctccctgcgcaaaagtctgggggaggagatggagtttggagcctgctgtggggtaagggaggaagggagggagggaaaaagctaagactgagttttggtctgcaggaaatgtgggagacaagggagagcacagggccaggctcatggtgggtacccagtaaatgcccttaagatttaactagagtgaggggtggtaagttgtggggattcacataaagagaaaattgctttccgagttgaaactgtgaccaggacctttccgttttggttcacaaaaatcttttctctgtttttgtaagctgggtagctgaatcaaggaagtttgaggcaggtaatgatttagggcaaggtttggcccaaggaataatggatctgggactggtaactgaagccaagggatagaatacacagtaaaagaaagaggaaaggaactatatgatttattgaaaccagaaccccttttcttcaaagccagctataaagcctaaaaatataactctaactttccctctgcctttctatgtaaaaactggacataaagaagtgatctggcctcctttatttgactgtaggtcataagacccccccattctagagagggaactgccacatacccagaaggaaggaatgctgctcagagaggccaagaagaatctagacagacaggccttgctgagtttcccctcttagtctattcgcattagctcataccctttttgttcaatcatatttctacatggctgttcatactttgttgaacttaaacatagacaaaatggacaatttcctttgtgtctttgggtcttcattctgaaagctcctgtgcatacatgctgaatccatttgtatgccttttctccaattaatctgccttctgtgagttgatttttcagcaaaccctcagagagccaaaggggaagctctcccttaggccctacagcacccactctccactgtgtcaggtaatttatttatattattcattgaaatcttcagagtaactctgtaaggcagatgttgtctctacatgacagatgaggaaataggttcagaatgatgtgaaggaattcagcccaccaaagtgatataaagattattttaaactgaaaatatctgaacagacagcagaagcagaaatgaatattacctaaatttaagcagaacctcctgaaaatacaaccacaattgaacaattgattctgagggagtttcctatttgtattaagactgaccccttagcattgagaagtgcaaatgcagctgccataaacccccccagagggaaatttccagcctaggaaagagataaactgttcattttcattagcatcaaaaaaaccaatagaaccttccatactttcacattgaagccctaacttctcctttgttaaatcgggtatataaatctctctctctctctggcttattgagcaagttactcattattcaatggtcccatgtgcatatggaaataaacattgtctttactcctgttaatgtgtctattgtcagttaatttgaaagcccctgtcatttgactattgaaaccttagatgatagatgatagataaagcagtgtggttccctagaacagcagtcctcaacctttttggcaccagagcctggtttcccagaaaacaatttttccacggggcagggagttgggggagggagaggtggtggggtggcagggtagggggatggcttcgggatgaaactgttccacctcagatggccaggcattagattctcataaggagcacacaaccttaatccctcacatatgcagttcacaatagggttcatgcttctatgagaatctaatgccctgctgatctgacaggaggtgaagctcaggccataatgctctgcaggcccactgcgcacctcctgctgtgtggcctgattcctaacaggctgtggacccatacccatctgtggcccaagggttggggacccctgccctagaataagacccaagagcaaccatagaactgtcccagtacatatccagggttcttaaacctcatataatcatgatccaggccatagctcccaaacttgttgaagctgaagcaaactttgtacgtgggtggacacagaaggaacctgtgtcccttcaaggagtggagtaacagttaagaccagtaagtggtcactttacagaattatcttctgtcctagaatcttctgggcagtcacagatcctggggaaaaggtgacctgagtcaggactattcatcagagcagtcagggcagcctttggattcagggagaccacactgattgaggacaagtcacttaacatccctaaggctcagttctgtaaaatgtggatactcttatctattgccggagatcttgtagggaatggggatgatattagacaagtgtttgccacagcaagttcagcttataatattagcagctcctctgcaacactttttaaaattccaacatactttgtagataactgtatctgcacatataaaacatatccaacacacacacatacatgcatgtagaaaataagaaaaatatttttaaaaattaattcttccattatttgctgttttaagcaagctgcaacatataatattgcacttagaatttacacaacagttatatttctagaattttggcaaaccatggtgctcagatcaactcttcacgtgtaaagcaactcaaaacattatggtaaataacactgggatctagacttttgaggatattttgtctttaatcattaattgttcctataagaaactaagaattgatttttttgttttgttctaattcaaaagccatcagaaagccctggagtcattctaatatttcatgaaaaaggatacttacttggccttttctagaccaactcaaaaaggaggagattagcaagtggcacactgctgatatgcattataaagtgtttctaacaaatatttggcaaatgaatgcttcaagtgttcttattctacaaagtctcttcctgagggttttagcataccataccaactaatgcacaatgtctttctcaaactcttgtttatgatagatttttcttaagaatattaaaatatataatagctatgatttatacagtgttacctatatttgaggaactgactacccaacaaccaaggcagtacaaactgttaaatccacaaaacaacagtggcaatatatgcaattaattactgattttgtatattacgaaagtgaggctcacagagaataagcaactgacccaaggtcacagagtcagtagacagaaaatactagagctggaacatgtgtagtggtgggctagtacaggtttaaaaaccattaagggtggaagatggggcctggaagcacatgctttgtagagtttgctgatttctatggtgtaaatgctccactatagacaattttaaggagtaaatgcacacaattacaagagccagttccagaatgttactacaataggatcctatagtctgaatgtttgtgtccctctccaatttatatgttgaaatctcaactcttaatgtgatggtattaagaggtggagcctttaagaggtgattaggtcacaacagcagagccctcatgaatgggattagtgctgttataacagaggccccagaaagactcctcactccttccatcatatgaggacataagcagaaggtgccatctatgaaccaggaagtggttgctcaccagacactgaatctgctagtaccttgatcatgggcttcccgtcctccagaactatgagaaataaatttctactgtttatacgctacctggtttgtggtattttattttagcatcccaaacaaactaagacataggggaagccattaaccactgagcatcaaaatttcttcactgtgaagtgagaataagaataacttcactgaaaaaaattgctcttaaggcttatgggaataacacaatgtgagagtgcctaatactgtgcctagctcataggtgctcaaagaatgtttgtttagagtcacaatagtaacaaaatagctgctttcaacaataaaacaagatcattactattctccttaactaactcttgaatggaatctactctgtatgagcaacaagtaccatttttaccaacatatttctgtgtggatcattccctaaagatatgtttaaaaactaaatttgcgcagaaaaccacaggctgacaaggttctcagtggcacaacttaactcatagttatccaacctttctaagtcacagctcctactaaacaggtatcatgaaagctacacttcaagtttggtaggatagaagcaaaatctgatggcacatttagcagagtctagtacatggtgcaagtacaatatatggtacttacagactggtataattcacaccctgaagctttcttcaaagcactggaagatggggctgatgccctttttcccccaaggacaccaaacaagatcgagagagattatttacttactagtgggatacagtgtactgaaagagactccacagaccagttgccctgagggtacacatgtagttccaggaatttcatgggtgcttgagatttaaaaagaaaaaaaaaaagctcatacgagtatatttttgcctcagaatatatgatcagtaaaatagatgcattctctgttcatttgtaaaagcttcaagtccatcctgtacaatcagcctattctagagggatgcttcattagcaggcaccaaggtagagtggttatgaccacaggttctgtttcaggccttactcttttataatctatttggaaggaaaatatcttttgctttttgttttattcagactatgtatttcacggccatcttttccaataaatggagacctgtgtttagagttcaaattataagaatgtactctagaaaaggacaccaaatagatgtttagtttatgagctctctttagctttacttgtttccaataacaacctatgcctcagaaggaatcatccttggctttttttttaatttacttgcctgttttgtgcaattgccaagttgcctgtaaagaaattccaattgtgtgtgacacactttatgtatctgcagtataagacctaaagttaaggctcaatattatgtgctgccttgacatctggtgaaatttagagggcttcaaatgacctaaccatgaatctccctccctactctgctcctatgaatgaagtccatagccaaataatggttcttatcaggtggaccaggcatagctcctgcttatccctgagtagccggtttcaattccctgaccgtccatggaattctttaaacaaaccaatcaaatcctcccaggggaaacagggagcactccaccttcttaataccaaatggcctgcttccaacagctcctggttgtccaaatgcaaccacatttggccctgcttggcatgagatgtcttctttcccaggttgtgaatataggtgaaaataaactgttgtcaatgttatttgttccgtattaagtgttatgtgcttggtcaaccccataacgcaagactgggaatactgccctcactgatggaataaatgggacacgatcttactgctgattattaagatcctgtgagataggtatctttattcccatttcaataatgagaaaattaaggttctgaaaatagtagataactgccccccaatcacacagctgagaagcttccaacctgggatttgaactcaatccttttatacttcaaaatctgtgttcatgttagccaacatatctcaaatattgtttaaacactgagaaaattctgtttatcctaaatatgcaacctaataaacttatttttaaaagatcattatttttgagactgagtcttgctgtcatccaagctggagtgcagtggtgagatcttggctcactgcaacctctgcctcctgggttcaagtgattctcctgcctcagcctcccaagtagctgggactataggtacctgctaccacacctggctaatttttgtatttttagtagagatggtgtttcaccatgttgggcaggctggtctcaaactcctgacctcaagtgatccgcctgcctcagcctcccaaagtgctgggattacaggtatgagccaccccgcccggccaaagacatcatttaattaattaatttatttatttatttgagacggagtttcactcttgttgcccaggctggagtgcaatggcacgatctcggctcactgcaacctttgcctcccgggttcaagcgattctcctgcctcagcctaccaagtagctaggattacaggtgcctgccaccacgcccagctaatttttgtatttttaatagagatggggtttcaccatgttggccaatctggtcttgaactcctgacctcaggtggtccacacacgagaacttcatgaagcatacacaagtatcaatagctgaatggtccaagcataagaaaggatatcagagtttgaagaccaccttactgaaataagacatgcagacaagactagagaaaaaagaatgaaaaggaatgaacaaagcctccaagaaatatgggacttcataaaaagaccaaacctatgattgactggagtaacagaaggagacggagagaatggaagcaagctggaaaacacacttcaggatattatccaggagaacttccccaacctagcaagatagaccaacatgcaaattcaggaaatacagaaaacaccattaagatacttcatgagaagatcaatccccaagacacataattatcagattctccaaggtcgaaatgaaggaaaaactcttaagggcagccagagagaaaggccaggtcatctaaaaaagggaagtccatcagactaacagtgaacctctcagcagtaactctacaagccagaaaagattgagggtcaatatttaacattcttaaaaaaaaatttcaacccagaatttcacatccagccaaactaagctccataagcaaagaagaaataaaatcctttccagacaagcaaatgctgagggatttcattaccaccaggtttgccctgcaagagctcctgaaagaagcactaaatatggaaaggaatagttgataccagccactgcaaaaacacaccaaaatataaagaccaatgacactatgaagaaactgcatcaactagtgtgcaaaataaccaaataacagcatgatgacaggatcaaattcacacataacaatactaaccttaaatgtaaatgggctaaatgccccaattaaaagacacagactggcaaattgcatagtcaagatacatcagtgtactatattcaggagacccatttcacttgcaaagacacacatatgctcaaaataaagggatggaggaaaatttaccaaccaaatggaaagcaaaacaaaacaaaaaacaaaaaacaaaaaaaaacctagggtttcaatcctagtttctggcagaacagactgtaaaccagcatagatcaaaaaagacaaagaatggcattacataatggtaaagggaacaattcaacaagaagagttaactattctaagtatatattcacctgatacaagagcacccagattcataaaacaagttcatagagaccaacaaagacacttagattcccaccgaataatagtgggagactttaacaccccactgtcatattagacagatctatgagacagaaaattaacaaggatattcaggacttgaactcagctctggataagtggacctggtagatgcctacaaaactctctacaccaaatcaacagaatatacattcttctcagtgccacatggcacttattctaaaattgaccacataattggaagtaaaacacttttcagcaaatgcaaaagaactgaaatcagtctctcagaccacagtgcaattaaattagaactcaggattaagaaactcactcgaaaccacacaatttcatggaaattgaacaatctgctcctaagtgactcctgggtaactaatgaaattaggacagaaatcaagaagttctttgaaaccaatgagaacaaagagacaacgtaccagaatctctgggacacagctaaagcggtgttaagagagaaatttacagcactaaatgcccacatcagaaagctagaaagatctcaaatcgacaccctaacatcacgattagaagagctagagaggcaagagcaaactaatccaaaagctagcagaagacaagaaataactaagatcaaagaataattgaaggaggtagatatacgaaaaactctctaaaaaatcaacgaatccaggagctgagtttttgaaaaaaataacaaaatagatagaccactagctagactaataagaagagagaaaagaatcaaatagacacaaaaaaaaatgataaagaggatatcaccactaactccacagaaatacaaactaccatcggagaatactataaacaactctacacaaataagttagaaaatctagaagaaacagataaattcctggacacatacaccctaccaagactaaaccaggaagaagttgaatccctgtatagaccaataacaagctctgaaattgaggcagcatttaatagcctaccaaccaaaaaagcccggggccagatggattcacagctgaattctaccagaagtacaaagaggaattggtaccattgcttctgaaactattccaaacaactgaaaaggagagactcctccctaactcattttatgaagccagcataatctgataccaaaaccaggaaaagacacaacaaaaaaagaaaacttcaggccaatatccctgatgaacattgatgtgaaaatccttaataagatactggcaaactgaatccagcagcacataaaaaaacttatccaccacaaacaagttggcttcattcctgggatgcaaggctccttcagcatatgcaaatcaataaatgtaattcatcacataaacagaaccaaagacaaaaaccacatgattatctcaatagatgcagaaaaggcctttgataaaattcaacatttcttcatgttaaaaactctcaataaactaagtattgatggactatatctcaaaataataagagctatttatgacaaacccacagccaatatcatattgaatgagcaaaagctggaagcattccctttgaaaaccagtacaagacaaggatgccgtctctcaccactcctattcaacattgtattggaagttctggcaagggcaatcaggcaagagaaagaaataaagaatattaaaataagaagagaggaaatcaagttgtctctggttgcagatgacatggttttatatatataaaaccccatcatctcagccccaaaactttttgaactgataagcaacttcagcaaactctcaggatacaaaatcaatgtgcaaaaatcacaaacattcatttacaccagtaataggtgagcagagagccaaatcctgaatgaactcctgttcacaactgctacaaagagaataaaatacctaagaatacagctaacaagggacgtgaaggacctcttcaaggagaactacaaaccactgctcaaggaaataagagaggacacaaacaaatggaaaatcattccatcttcattgataggaagaatcaatatcatgaaaatggccatattgcccaaagtaatttatagattcaatgctattcccatcaagctaccattgacattcttcacagaattagaaaaaactattttaaatttcatatggaatcaacaaggtcccatatagccaagatgatcctaagcaaaaagaataaagctggaggcatcacgctgcctgacgtcaaactatactacaagcctacagtaaccaaaacaacatagtgctggtaccaaaatagacatatagacgaatggagcagaacagagatctcagaaataacaccacacatctaccaccatctgatcttcgacaaacctgaccaaaaatagcaatggggaaatgatctcctattcagtaaatagtgctgggaaaactggctagccatatgcagaaaactgaatctggatcccttccttacacattacacaaaaattaattcaagatgtattaaagacttaaatttaaaacctaaaaccataaaaaccctagaagaaaacctaggcaataccattcaggacataggcatgggcaaagacttcatgacaaaaatgacaaaagcaattgcaataaaagccagaattgacaaatgggatctaattaaactaaagagcttctgcacagcaaaagaaactatcaccagagtgaacaggcaacctacagaatgggaaaaacattttgcagtctaccgatctgacaaagagttaatatccagaatttacaaggaacttaaacaaatttacaagaaaaaaaacaaccccatcaaaaagtgggcaaaggatatgaatagacacttctccaaagaagaaatttatgcagcctacaaacatgaaaaaaagctcaacatcactgatcatcagagaaatgcaaatcaaaaccacaacgagataccatctcaggccaacatgacatttaagtcatccctgaattaacatgtcaggaaacaatagatgctggtgatgctgtggagaaatgggaatgtttttacactgttggtgggaatgtaaattagttcaatcattgtggaagacagtatggcaattcctcaaggatttagaaccagaaataccatttgacccagcaatttcattactgagtatatacttaaaggaatataaatcattttactataaagacacatgcacatgtatgtttatggaagcactatttacaatagcaaagacatgggaccaacccaaatgcccatcagtgatagaccagataaagaaaatgtggtaaatatacaccatggagtactatgcagccataaaaaggaatgagctcatgtcctttacagggacatggatgaagctgtaagccatcatcctcagcaaagtaacacaggagcagaaaaccaaccactgcatgttctcactcatagtggcagttgaacattaagaatacatggacacagagaggggacaacacacaccagggcctgttaggaggtggagggcgaggggagggaacttaaaggatgtgtcaataggtgcagcaaaccaccatggcacacatatacctatgtaacaaacctgcacgttctgcatatgtatccagtttttttaagaaattttaaaaatcaaaaaaaactaaaaaataattttaagaaaagacagctgaaaacataattctttctccgtctcacaaaggttgaaaacaaatttccctgtcaaaacgtaactaaaacgtggaaatggttcaagttaaaagctattctaaattaaccagatagtcggctggagaatctggagaaaagtcctagagtaaggagctagtggaaagtcttaaaaggaaattagattataaactttgcagagcctattagtgagaaaagaaaaggtaataaattgtaactattgggataataatccaagtggggggctggctatgcaagtcttatgcacacttaaaataatcatgggattgaatctttgatctgggaatagagtttatcataatatttgtttattatccttataatccctatagggtctgtagtaacatcacacctttcattcctgatattggcatttggtgtcttctctattttgttattggtcagtgtggctagaggtttatccattttatttatcaaagacccagcttttagccaggcatggtggttcccctgtattcccacctacttgggtggctgaggcaggaggatcacttgagcccaagagttcagtgctgtagtgctctaagatctcatctgtgaatagcctttgcattccagcctgggcaacatagcaggaaaaaaaaaaaagaactagtttttggttgtattgattatcaatcaattataataatttctgctctttattatttccttccttctgccttctttgggttaattttgtttcttttttaatagtttctaggtatgatttacttatcataacactcaccaattttaagtgtccaatcaatgatttttagtaaatttacaaagttatgcaagtgtcatcaaaatccaattttagaacatttccaaccctcccccatcattgcagtcaatctccatttctacctccagccccagataatcactgaaatttacaaattttcatttatcaatttgccctttaaggcccctgcatacaaattaaataatacactatgtaatcttctgtgtctggcttctttcattaacataatgtttatgaggttcacctatgtcatagcatgtattggtccttagtttgttttattgctcaatagcattttgtatgactatgctctgtgatgtttagatgtttagatttacagacattagggcaattttcaggttttagctattaagaataatgctgttacataccttcatgaatgggtctttagggaacatatgttttcatttatcttgactaaatttctgggagtacagttatatggtaaatttatgtttagccatttaagaaattgccaaactgtttttccaaagtggctccatcattttacattcccactcgcaatgcctaagggttccagtttctccacatgctcataaacactccttattgtttgtcactttgattacagtcattctaatggtgtgaaatggtttagatttgcatttccctaataaataaagatgagcttcttttatatgctttttggatgtagtatttgtacatcttcattgttaaaattttattacagtgttttgatcatttttaattggtttatttgaccttttgctatttagttgtaagaattgttcatatgtttgggatacaaacccttattagatatggtttgcatgtattttcactagtatgggacttgtctcttcttttttcttcatggtcttttgatgtttggaagtatggggtagatgaagcacaacatatcatttttctcttttgtagattgtgtttttagtgttgtatgcaagatatctttatctaaccttaggtcatgaagatttgattctaccttttcttctaaaagcattatagttttagctattacatttagagatacaatctgttgagagttaattttttgtgtagtgtgaggtgaatgtctaaagtggtctttttccaagtgcatgttcaactgtccagcactgtttgttgagaaggctactctttatcccagtgaattgctttggcttctttgtttaaaaaatcaattaatcataaatataaggggttatttctgaactttcaaatatattccattgaactatatgtctgtccttatgccagttaatacagtgttttgattactgtagatgtataaaagttttaaaactgtgtagtagaaaccctccaacaattttttctttttaaagattgatttgccaattctagatcttttgctttccatatttttaattggatagtcactttctacaaaaagtcctgctggaactttgatggggattgtgttgaatccatagaccaatttggggaaaattgccaaacagcatcgtgtcttggaatccatgaatatagaaagtctttctaataatttagatcttctttaattcattgcaatgttttacaatgttcaatgtgcaagtcttgcacttcttttggtaaatttagtcctaaatatttttctcttatgctgttgtgaatggccttcttttccaaaaactcatttttgcttgttcattcgtaatatatagaaatacaactgatcttttatcctgcaactttgctaaatgtagctattagttctaatatttctgtgtgtgtgtcttaacattttcttcatcaagattatgttgtcaacaaataaagtcagtttaacatcttcctttgtaatccagataccctttatttgcttttcctgccttctttcactggatagcacctctaatacaatgtggaatagaattggtgagagctgctattcttgtcttgttcctgatcattgagggaaaccattcagatttttaccattaattatgatgttaacagtaggtttctcatagatgctctttatcaggttgaaaaacatcccttttgttactattttattcagagtatttcttatgaatgaatgttggatttttgtcaaatgctttttatgtatctaccaagatattcaggtagattttgttctttattaatataatgcattatgttaattaattttttaatgataaaccaaccttacatccctggtacaaatctcagttgttcatggcacataatcccttttaaatattgctggatttcacttactaatttttttatttacttttaaatctatattcataagaagtatttgttgttttcttgtaatgtatttctctggttttggtgtcagggtaattttgacatcatagaatcagttgagaagtgtttcctcttctattctctgaaagattatgtaaaaaaatctttacttatttaaatgtttggtagaattaagcagtgaaactacctggtcctgtacttttctttgtgggaaggtattttaattactactttctttgatttcttcacttgtttattctgattttctatttctattttctctttctttcttttttttttttttgatgcagtctccctctgtcacacagggtggagtgcagtggcacaatctcagctcactgcaacctccgcctcctgggttcaagtgattcttctgcctcagcctcctgagtagctgggactacaggcacgcaccaacatgcccagctaatttttgtacttttagtagaggcagggtttcaccatattggccaggctggtctcgaactcctgaccttgtgaactgcccaccttggcctcccaaagtgctgggattacaggcgtgagccaccgtgcccagcctattttctatttctttctaagtcactttcagcaatttgtgtcttcctaggaatgtgtccatttcatacattttaaaatttgttgccataaagattatcatagtagcctctataatcctttaatttctctaaggtcaatattgatgtacccacttccatttctgattctggtcctttgcatctcttccctttatttcttggtcaatccagctaaaatattgttaatttttttttttttttgagacggagtctcgctctgttgcccaggctggagtgcagtggcgcgatcttggctcactgcaagctccgcctcccgggttcatgccattctcctgcctcagcctccagagtagctgggactacaggcgcctgccaccacgcccagctaaatttttttgtatttttagtagagacggggtttcaccgtgttagccaggatagtctcgatctcctgacctcatgatccgcccacctcgacctcccaaagtgctgggattacaggcgtgaaccaccgcacccggcctaaaagattgttaatttttaaaaaatactttcaaagaagaaacatacagtttcactgatttttgttatggcttttttttttctaattcattgatttccagtttaatctttgttatttccttttttcacttgctttgcattaaatttgctctgactctttctagtttactcagttgaaagcttcaattactgatttcaaaactttttccttttctaatacgagcatttattgccttcatcgttcctctaatccttactttaatggcactgcaaagttttattttaatggtaacatcttgcaaaactataataaaagttcaaaataacaatattgatattgacattgatgcaatccatgcatcttattcatatttccccagcttgtttgtactcatttgtttgtgtatgtttgtgcattggcttctttttttgttttgtttttttctctgtcccccaggctggagtgcagtggtgccatctcagctcactgcaacctctggctcccaggttcaagtgattctcctgcctcagcctcctgagtagctgggattacaggcactcgccaccacgcctggctaatttttgtattaaaatttaatacaaatttttaatagtggagatagggttttaccatgttggccaggctggtctcgaactcctgacctcaagggattcgcctgcctccgcctcccaaagtgctgggattacaggtgtgagccactgcacctggcctgtgcatttggttctatatatttttatgacatgtgtagattcataagttcatatatttactatcagagtcaagatacagaacagatcccagcagtgccctttcataaccacactaacctcctccccatccctgcatcagccctaagcactagcaactacacatctgtcctccacatctgtaatctttcatttcatgaatgttatatacattgaaaactacactatgtaatcttttttttattatactttaagttctagggtacatgtgcacaacctgcaggtttgttacatatgtatacatgtgccatgctggtgtgctgcacccattaactcgtcatttacattaggtatatctcctaatgctatccctccccccttcccccactccacgacaggccctggtgtgtgatattccccttcctgtgtccaagtgttcccattgttcaattcccacctatgagtgagaaaatgcagtgtttggttttttgtccttgcgatactttgctcagaatgatggtttccagcttcatccatgtccctacaaaggacatgaactcatcattttttatggctgcatagtattccatggtgtatatatgccatattttcttaatccagtctatcactgatggacatttgggttggttccaagtctttgctattgtgaatagtgctgcaataaacatacgtgtgcatatgtctttatagcagcatgacttataatcgtttaggtatatacccagtaatgggatggctgggtcaaatggtatttctagttctagatccgtgaggaatcaccacactgtcttccacgtggttgaactagtttccagtcccaccaacagtgtaaaagtgttcctatttctccacatcctttccagcacctgttgtttcctgactttttaatgatcaccgttctaactggtgtgagattgtatctcattatggttttgatttgcatttccctgatggccagtgatgatgagcattttttcatgtgtctgttggctgcataaatgtcttcttttgagaagtgtctgttcatatcctttgcccactttttgatggggttgtttgtttttttcttgcaagtttgtttgagttctttgtagattctggatattagccctttgtcagatgagtagattgcaaaaattttctcccattctgtaggttgcctgttcactctgatggtggtttcttttgctgtgcagaagctctgtaatttaattagatcccatttgtcaattttgtcttttgttgccattgcttttggtgttttagacatgaagtccttgcccatgcctgtcctgaatggtgttgcctaggttttcttgtagggtttttatggttttaggtctaacatgtaagtctttcatccatcttgaattaatttttgtgtaaggtgtaaggaagggatccagtttcagctttctacatatggctagccagtttttccagcaccatttattaaatagggaatcatttccccattgcttgtttttgtcaggtttgtcaaagatcagatggttgtagatgtgtggtattatttctgagggctctgttctgtttcattggtctatatctctgttttggtaccagtaccatgctgttttggttactgtagccttgtaaaatagtttgaagtcaggtagcatgatgcctccagctttgttcttttagcttaggaccgacttggcaatgcgtgctcttttttggttccatatgaacttgaaagtagttttttccaatttggtgaagaaagtcattggtagcttgatggggatggcattgaatctataaattaccttgggcagtatggccattttcacgatattgagtcttcctatccatgagcatggaatgttcttccgtttgtttgtgtcctcttttatttctttgagcagtggtttgtagttctccttgaagagcaaatgcaccaattttgctaaagacacaatctaccaaaactcacttaagaagaaatagaaaacataaataatcctacacctattaaagcaatgaaatcaataattaataaccatctggaatgaagtttctaatcatcttcccaaatcaaagtgcagcaagcccagaggggttcactggtgaatttaacctaacattaaagggaaaaaattatgccaattttctataatcttctctttaaaatagaagcaaagtgaatacttcctcactcattctagagtccaacattaccctaatactaaaatgaaggatgttacaagaaatggaaatacaggccaatatccagtctgaacatagatgcaaaaatcctcaataaaatattagtgaatcgactccaataatatttaaaaataattatacacccataaccaagtgggatttattccaggtatgcaaggctgggccaacattcgcaaatcaattgatgtgatccatcacattgagaggctaaagaaaaaaaggatttgatcatataaatagatggagaataagcattggacaaaatctaagaccaactagcaatagaaacacccagcaaactaagcatagaggtgaacttcctcaccgtggaaaagaatatctacacacaaaaaatctacagttagcattatagttaatcacaaggaactagatgttttccccctaagatcaagaacaaaacaaggatatccactatcactactttttcaaatttttattggaaaattttgccaatgcaataagacaagaaaaggaaataaaagttatacaaattgggaaggaagaaatcaaactgtttgcagatgacataattgtgtatgttgaaaattctcaagaagcaataaaataagtcttggaactaataagcaattatagcaaggtcacgggatacaattataatatacataagtccattgctttcttatatacccacaatgaaatatttgaatttgaaatttaaaatacaataccatttacattttcagtaaaaaataagtataaatctaccaaaatatgtagaggatatatataaagaaaatgacaaaacactggtgaaataattcaaagaagaactaaacagatggggaaatactccatgtaaataaataggaagacacaatattgttgagcaatcaagttcttcccaacttgatctatagattcagtgcaattccaatcaaaatcacagttagttattttgtcaatattaacaaactgattctaaagtttacatagaaagacaaaaaatcagaatagctatgaaagtattgaaggagaacaaaattggaggactcaccttacccgacttcaaaacttactataaagctacaggagccaagatagtttagtattggcaaaataataagcaaatagttcaagagaatagaataaagagcctagaaatagactcatacaaatatagataacccatcttttacaaaagaagaaaggcaattcaatggagaaaggacagacttctcaacaaatgaactgcttgcatgcagttctacatgcacaaaaaaagaatctggatatagatcttacatcttttatcaaaagtaacccatgtaattgttaatatgtaaaacacaaaattataaaacttctagaagctggcaggggagaaaatcttggtgacattgggtttgactattatattttgggtataataccaaaattacaatctctgaaagaaaaaattgatttcaggctttactgaaaataaaggctgctctacaaaacacactcttaatgactaggctgggagaaagtctttgcaaaacacataaccaataaagaactagtatccaaaatatacaaacagctcctaaaactcaacaataaaaaactaaacaaccaacttaaaaatgggcaaaatataggaacagatacctcaccaaacaaaatgtgcagatagcacataagcatataaaaagatgctcaatgacatatgtctttagggaattgcaaattgaaacgatgataaaaagccattataaacttatcagaataactaaaattcaaaacactgtcaaatgcttgatgtggagtgatggaaactctcattcattgctggtgggaaggaaaaatggtacagctactttagaattcaatttggcaatttcttagaaaatcacacgtattcataccatatgatccagcaattgaacttccaaatgagatgaaaattatatttacacaaaaacttgtacacaaatatttgtatcagttttattcataattgccaaaacttggaagtggcctgtcttagtctattttctgctgtttatacatagtacctggacctgggtaatttatatgaaaagtaatttatttcttacagttatggaggctgagaagtccagggtcaaggggtcacatctggtgagggccttcttactggtgggtactctgcagagtcctgaggaaaggcagagcatcatatggtgagaagctaagcaggctagctgtgatctctcttcctcttcttataaagccaccagtcccattcccatgtcaaaggccttttctacatctattgagataatcatgtgttttttgtctttggttctgtttatatgctggattaagtttattgatttgcgtgtgttgaaccagccttgcatcccaggggtgaagcccacttgatcatggtggaaaagctttttgatgtgctgctggatttggtttgtcagtattttattgaggatttttgcattgatgttcatcagagatattggtctaaaattctctttttttgttgtgcctctgcctagctttggtatcaggatgatgctgacctcataaaatgagttagggaggattccctctttttctattgattggaatagtttcagaaggaatggtaccagttcctccttgtacctctggtagaattcggctgtgaatctgtctggtcctggactttttttggttggtaagctattaattattgcctcaatttcagagcctgttattggtctattcagagattcaacttcttcctggtttagtcttgggagggtgtatgtgtccaggaatgtatccatttcttctagattttctagtttatttgcgtagaggtgtttatagtattctctgatggtagtttgtatttctgtgggatcggtggtgatatctcctttatcattttttattgcatctattggattcttctctcttttcttctttattagtcttgctagtggtctgtcaattttgttgatcttttcaaaaaaccagctcctggattcattgattttttgaagggtttttttgtgtctgtatctccttcagctctgctctgatcttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttaggtacctagtagtcattcaggagcaggttcttcagtttccatgtagttgggcagttttgagtgagtttcttaatcctgagttgtagtttgattgcactgtggtctgagagacagtttgttataatttctgttcttttacatttgctgaggagtgctttacttccaactatgtggtcagttttggaataagtgtgacgtagtgctgagaagaatgtatattctgttgatttggggtggagagttctgtagatgtctattaggtccacttggtgcagaacactatgtgatcttttgggattaacttcttacattcagcataattctcaagtaattgtgtctatcaatagtatactcatttttattgttccattttatttcgtggtttggctaacttagaagtatgactggtttatattcagttgagagctattatgagtaaaatttctatgaacagtcatgtagaggcttttatgtgaacattcttccatttctctggcatatgcctaatagtgaaattgctgaattatttagtaattggctgtctagttttataagaaactgagttttccagaatggttgtatgatttaacaaccctacaagtcatctatctttgattcagtttctctgcatctttgccaatatgctgtatgtcctcttctgtgaaatatctgttcatgtttttaacattttcaaatttgactgtttaatactgctgagttttgagagttcttaatattttctgaattttagtcatttgtctgatttgttgtttacatatattttctactatgttttaatgttccttatatgtctgataattgttcttgttccagaatttgctttgtctgatattattgtagccactctagctctctttcttttgattagattttgcatagtatatgttctttatcctttatttttaacctatctgcaccatgatatttaaagaggatttcttgtaaatagagtacagttgagtgttcttttctttacctaaactattttttaattggtgtactttgaccacttacatttattatagttactgatatgttggatttggctccactgctttattgtatgcttcttgttgctgttttccccctccatttatttgtttttctgttcaactttttctttcttattttagattatttgaatattttaatatgttattctatttatctctttgctttgtaattatctctctgtattacattttaagtggttattctaggggttttatatatatatactttacttttcagaatctactttagttaatgctataagtaaaatcatcccttttatagtgtagttgtcatatgcattatatctacatactttaataatcccatcagtcaatgttataagttttactttctacagtcaaacatatttttaaacttaagagaaataaatagtctatttatccagacatttaccatttctttttatttttctttatgctgaagttcagtttccctctcttaccatgctccttcagtctaaaaatcttcctttaacatttactttagcctagagttttcagcaacaaactctattagtgttcctttcatctgagaatgttactgtttcgttgtcattacttaagcatatatacatattgctgcacgtagaattccagattgacagttattatctttttcttcaacttttcttcaattttttcttcaacttttattctgagttccagggtacatgtgcaggatgtgcaggtttgttacataggtaaacaagtgctatgatggtttgctgcacctatcaagccatcacctaggtattaagcccagcatccattagctattcttcctgatgctgtccctccccccaagccccgactggccccagtgtgtgttgttctcctccgtgtgtccatgtgtcctcatcattcagctctcacttatagatgagaacatgcggtgtttggttttctgttcttatgttagtttgctgaggataacggcttccagctccatctatgtccctgcaaaggacatgatacagttcattttatggctacatggtattccatggtgtctatgtaccacattttctttatccagtcgatcattgatggacatttgggttgattccatgttttgctattgtgaatagtgctgcgatgaacatacacgtacatgaatctttatcatagaatgatttatatacctttgggtatataccatagggattgctggtcaaatggacttctgcttctagatctttgaggaattaccacactttgaggaattatcacactgtagtgtgaggaattaccacactacaatggttgaactaatttacactcccaataacagtgtgaaagggttcctttttctctgcaacctcaccagcatctgttgtttgttgactttttaataatcaccattctgactgacgtaagatggtatctcattgcgattttgatttgcatttctctagtgatcagtgatgttgagctttttttcttatgtttgttggccgcatgaatgtcttcttttgagaagtgtcttttcatgtcttttgcccactttttaatggaattgtttggtttttctttttgtaaatttgttgaaattccttgcagtctctgaatattagacctgtgtcagatgtatagtttgcaaaaattttctccctttctgtaggttgtctgttcatgctgttgatagattcttttgctgtgcagaaactctagttaaattagatcccatttgtcaatttttgcttttgttgcaattactttgggcattttcgtcaagaaatctttgcctttgcctatgtcctgaatgatgttgtctaggttttcttctagggtttttatagctttgggtttcacatttaagtctttcatccatcttgatttttgtataaggtgtaaggaaggggttcagtttcaactttctgcatatggttagccagttctctcaggactatttattaaacagagaatcctttccccattgcttgtttttcacattgacagttattttctttcagcactttaaaaatgctgctccaccaccttctggcctacatggtttctaaagtgtagcacacagctatttgaatcgttttccctttgtatgcattgtattactttttactggccattttcaaggttttactctatctttggtttttagaagtttgattatgatttttctgggcacaatttgctttgagtttataatttttgagattagatgagcctcttgaatctgtaattttgtctttcccctaattcaagaagtttcagcaattatttcttcaaatatattttctacaccaatatcttttttctctccttttgggagtgcaatgaatatgacaatttctgagttgctgcttattttatatcaatatttttactctgtgttcatgagattgcataatttctatttatctaattttaagtcactgaccctatatttatcattgcccattcttccattgagctcatccagtgaattttaaaatttcacatgctgtgtgtttcatttataaaatttctatttggctttgttaaaaattatatttctctgctcagaatttctatatttcatgtcagcagcatttatccttactataccttcaccccatggaacatggccataatgattttacagcttttaaaaaatatttggcacttcccagatgacaaatctgggtcatcttagggttggcatatgttgtctttttttatattggtttttcaaatttttcttgatatttagtatattcttgatatttagtataagtttaggttatattcttggcattttgcataatatcttgttagaatctgagtcctattaatatcctctggagagtgctgaatttttttgggttggacttagctagaccaacatggctagattcagactaaatgttctgtctcgctttctttgaattattattccattttcagttcagtttgcaaagaaattgctattctgctttggctgtcccatagacacacctctcagtatttagtttgagacttgagtggcgctttatgaaatagaaacttcaaaatactttactatgctgctttgggtaaattctgtgaatgcacgacttaacagaaagcctgaaatttatgcatattccttcacagcattaggagattcccctctcaagctctttcctctttaagattctccctctccggccaggcgtggtggctcacgcctgtaatcccagtacgttgggaggctgaggtgggtggatcatgaggtcaggagttcgagaccagactgaccaacatggtgataccccgtctctactaaaaatacaaaaattagccaggcatggtggtgcacgcctgtaatcccagctactcaggaagctgaggcaggagaatcgcttgaacccaggaggcggaggttgcagtgagctgagattacactactgcactcaagcctgggtgacagagcaagactccgtctcaaaaaaaaaaaattcatcttcatattctctggtttccaggagccccttttaccaatcctctgtccagaaagataagatttcttttggatttttaatcactcatgacactagaggtgaactctgtggttctaagttctctctagctgtgaatggcacagaactttcaggtaaaacatccacctcctctttcccaggtaacagctgtttctgaggagctctctttctgagggatataccccattcgatgagtaggacacatggaacagctctgcttcccaagtgttttaactctgtcaggtactcaattctctcttatagtgtctctcatttattgatcaggctgcatactccatccttaccaacggaaatttggaaagataaaacccaattttgttggtttcagagatcttcttagctttaatgaagaatactttgcagagatgctatgccctgtgaggtgcttgtatttttcagcaaaaattgtattggaggtagatgattatctcaggaataaatatatctattaatatatatcagcaactctaacatgattaaattattgtcgtcactcaaacctgaatctttatatacataaagtggaatggaaaatggtccactgcactgaaattaactacatgacaaaaaatggtgcttagcagcataatgaaatattttctcacttttaaataattttaaaaaatacatatttaactttctcaatataaaaagctaatttgaaaaataatctccttatacaagtctatagcagatagctcctcctccttcctgtgattctcttgggggtaacatgacttctttcccagtatctaagtccttgagctagaattttaaaacaattttaagcattgtgacatctcctcaccctccattcttcacaatagcttccttgagaataatgctgatgaccactactttttgatacattgcatttaaaatctttatctgtttctcttttactggaacaaagtcatgaaagcttgctttctaaacaaaataatctcttgtatccaaagggaaaaatgcaaaccgaaatcagtagttaggcataaaatgtacttttaaagaacaatgttggctgggggcggtggctcatgcctgtaatcccagcactttgggaggccaagatgggtgaatcacctgaagtcagttcaagaccagcctggccaacattgggaaacgttgtccctactaaaactacaaaaattggccgggagtggttgtaggcacctgtaatcccagctactcgggaggctgagacaggagaatcacttgaactcgagaggcagaggctgcagtgagccaagattgtgccactgcactccagcctgggtgacagagcaagactccatctcaaaaaaaaaaaaaaatgctgtcctgtttcccagtacctacccccacttcactgaacttggaatccaaggttcactacttttccaagtattagactggagtgtggaaatgttattgaaaaaatgtgtaactaccagacagatccaggccagaaacccagaaatatttttttttaatttaaccgtgtgcattcattttaggcagactaggtggacacacataggtatgcacacagacatacacatggtacagtaagagggtctcataaaacttcaaggtacagtaagagggtctcataaaaattcaacgctggaaatagttgtttccaatccggaaggcactgtgccaagcaaacagggatgtctgaaacctttgaacactgattttaaaccaattgactctgaattgatttacacagaaatattgacacaaacacttattgaatacttaagatatgccagcactattttaagtgttatgcactgacttaattctgacagcaatcttttttttttttttctgggacggagtctcactctcgcccaggctggagtgcaacggcctgatctcggctcactgcaacctctgcctcccgggttcaagcgattctcccgccttagcctccaagtagctgggattacaggcatgcaccaccacgcctggctaatttttgtatttttagtggagacggggtttcgccatgttggccaggctggtctctaacacctgacctcaagtgatccgcccgcctcggcctcccaaagtgctggtattacaggcgtcagccaccgtgcccagcctctcacagcaaccttatgttaaaagaaagacttcagctgaattcaatttaaaggagtttaattgagcaatgaatgattcgcaaatcaggcagtccccagaatcacagcagattcagagagactccagcgcagccacatggtggaagaagatttatagcaaaaaaaagggaagtgtcatacagaaatcggaagtgaagtacagaaacaactggattggttacagctccgcgtttgccttaattgaacacaatttgaacacttagcagtctataagcagttgaagtatggctgctgggatttgccaagactcagctattgttacagggcatactcctaacttaggttttcaatcttgtctacctattaagttaggttacagtttgtccacaaggactcaaatttagaagtatggagtccttctcaggccatatttagttcgtttcaacacttataatgcaggtactattattttctaaatatcacgcttgaggaaaccaagggacctcggtcaacttaaacagctagtaaatggtggtgctgagatttgaatccaggcataggtatggccctagtacccattattttaacccagtacagtacactattgcctctccatttgtgaaaagaaaaaaaaaaagacggaaagtcctttttatatggaaatacagataggattttaaaaacaggccccagaaaaccttacacaacactttctgctattaaaccattctctttccttcttccccttctctctccttcccttttccctctccagtccatcaaatccttgctatggaatatcacgcactcctaaatccaactgctcctttgacattctttggccacaaccttaaaataaatggccaccctaggatagatggggttaaaaccacaaaaaaagagtcttcttggcatgctagagtggctgcagtctaggaggctttctggaaaatggaggtgattctccagaaaatggaggtttgtttttctggaaacaaaatgtcatggttgtcaggttactgataaggggactattaggaaaattgggtcccaaatttattcgtaaggcaagtaggggtgcaggacgtgaaaagaaggtgggtttccctgtatgctgggtgtaatggcctaattatttctactacatgcaaaatacaacactgcttcttgggttcctcaaaatactcaggccctgggcactgaatagtgtgtgcacggatgagggctgtcccccttagagtgatgattggtaatgataggtgattcatgaaaaaaaaaaagtacagaaggttacagggcagaggatggcaaagggacaggttggagaatctgttttttttaaaaagttatctggttggtggtcaaggactggaggtggagaagagtggaggggttgaagaggattgtcttctctgtgaaaagggttttataggttatttctagtatagcacactcttgtgggaataaatgttcatttgaatttttgtgaaattctaaaaatagtttctaacattcacttggtaaagaattcagtaactttccaagtgaatatgtatattgatcaataggttcccaatccatttttacctaaatggtagcacactgtacaaactactctgtaccttgctcttttgaattagcactgtaaccatagacaaccagaaaaaaacctaagtatttatcaaagtgggcaatggttaaaagaattattctatatccatgaaattgagtatcatggagatattagaaatggtgatgcaatcatatattgacattaaaattatattcatcttctaaggtcaaatgagaaaagcagcttttgaaacagagatgtgtgtgtacacatgcaaatgcatagttagaagtttagagagatataaacacacaaaaattgttgactgaacatctctgaatgatggcattacagatgatatgtttccctattttatgtgcattttgtaatgtttgggatttgctaccatttggttcattacatatttaatttttaattatgtaatactttcacagaattttttaaaatcagcaaataacaaaaggtatagattaaaaagtccccatcctgtcccaggatcctgcatccctagctccctagttcccattcctagattaggaaattcaacattcaaatgaataaaacaagtttctcatgatatagtgtatatatggagaggcagggatgctgtattagcaaataagctcaatatattattgccacggctaggagagaaatctgttcttcgtgtgaaccaagctctctctgacttgttcaggtcctcagatatactgttccaactaactggaaaacttgcccttccctttacacctggctgtctttttactgttccaactaactggaaaacttgcccttccctttacacctggctgtctttttactgttccttcaagtctcagctgataaatctcttcctccaagaggccagcgtaaactagcagggatttccatcctgtgctgtctcaaagcactctgtatttcttgtatctcagaaagcacatataccctttgctgtagcttcttttttcttttctgtctcttagcaaacagcacaaacccagcatgaagcttgttcatttttgcatcttagaatctaacatgatacccagccagcaggtttgggaaaatctatctcatttgggtcacaaagaccaatacaaaaactttgttcccatcatttcctcatcatccaacatatgttagagctgtttgaaaggcataaataaaggagttgactttttggtggatggaaaatggtaaaagtttattactaatatctgaagtggaccaagatgttactcaggcttaaaaaatgtaattagaaatagaatttgagggcaggagacttctggaaatggtttccttactcttaaaaagagacatacagggctgggagcagtggctcacacctgtaataccagcactttgggaggctgaggcgggtagatcacgaggtcagtagttcgagaccagcctggccaagatggtgaaacccgtctctactaaaaatacaaaaattagctgggcatggtggcaggcgcctgtaatcccagctactcgggaggctgaggcaggagaattgcttgaacccaggaggtggaggttgcagtgagccaagatcgtgccactgcactccagcctaggcaacagagcaagactccatctcaaaaaaaaaaaaaaaaaaagacatacaggtgaaaacgacctttttcttttcttttctttttctaattaagaaaacacattggtttttctattactcaaggtttaatcaaataaacaaaaccagcaggagatatacatatacacacacatacacattcaagtgactggcttacataattgtgggggctggctatataagtccaaagtccatagaatagtcagtcaggaagtaaagatcacgagtaggctagagtctcctcaggtatgggatgaagcggtttctacaagtacaagcgtctcttttcccaaggaaggcctaagcccctttttagggccttctaaccgattaagtcaggcccacccaggacaattcctctaactcaaagtcaactgattagggtattctagtacatctggaaaatccctttgcagcagaagctatatttgtgtttaaataactgggagtagtgtgtatgccatagaatggctgctacttcccttccatcttctaattcacacaagagattatctctagtagcccacttatcaagaaacataatagaaagttaattctggggaatgtaattttgcctacccaagttgacacaccacagagttattatatcctctatagaatgcaccatccaggacttttcccagaacttgatgagaggtagacttgttttgggagatgagcaaaggaattatgaaagtttatttcttctttgtttcaggcagtcttctttttatactggaagcagttgtgcctagaattgatgcctggaagtcttattgcagagaaagcattctaaccgaagtgttttttgatgtcagagggctcatttcctggaattcctagagacagaaatcttctgacttcaagaaacccagacaccctgaagagaagtcagccaagacgcgggcttcccaaataacctacccagaatggtacagttgcctccaatacccactggaggtcacaacttcactgctgatatcatcagctgttgtccagtgggaatagaagtgaatcctttacaacctattttaagtcctcatagcacaaagtatatcaatataaaataggtccaggacttagttgtgtggtcaaaagggataagatagaaaggacaatgatccttcccgcatgatctatactggactgaaaccccagtggctaccggcatactgatgtgaatagctcttcttgaagcatggcaggtatgcttgggtgcccaagattcctgtccaggcagagcagtaagagtagtgttaaaccttagggcctcgttgcaattggattgattgaacccaagctgtagcagcaatagtttatttatgtccacttatgaactcttgtccttcagagaaaatgcaggatttcattgctcccggagggtgagtttggaaatctgcaattgcactatttttaggcagaacagaggagtttctgtttatttttggttaattactaatacttcatattgcctctacagcccctcccccatccatttcctcagacatggaaattttgctctctctgaaccctttctgtgagcgctgtaataccaaaagccagcactaaaatatagggatcctccttagaatacagcaggaaaagaaaacaatttctttctcatttctcaaaaggagacatatattagttttatcatatagtggtaatcagctatagcacctctgctattttgtagtttttaaagaattttacaactatttgtttttcattgtatttatttttagttataatctatgatatgaaacattagttttccattcttgatcatgatgtggggcttcttttaaactgtatttaaatttaaagtttatatggtttcaatggaaatattaatcgaatgattattcaggtggtatttggatatgttaaaaatcctaaagatggtacgtgaatgaccaagatctgggaaaagcaactttgattcactgtgacagataccatatgcaatgtctcagtaaaaggagtcaaagttcttcttcctcagtacctcataactcaccacaagagttaatctggtacctgatacacaaagctacacattggtactaatagtggtggcacttgtttttctcattccagattgggttagggagcttgttttcctatcagtgtcactactaaggttaattaattaattcaacaaatagtcagtatgcctattaggtttcaaccagtgacctgtatgccggatctgtaaataccaaggaaatatggcctttgtcctatctacagaaacaggggagcacaaagaagggacatagagaaacaggagagaagcgaaatagacagagaagatgtggctacagaagttggaggaaaactatcagaactatctcttgtgaatacaagagtgcttacctgtacttgacaattccactgatacctgggttcacaccatcaaatatatctatgtaagcctgaatgatgcttataccttttacttataaaataaaatattctaattagcatgcctatatacatccattaccctgcatgtgggaagcaatcagtgaattattcagttcaatctcgtcaggaggaaaatcacactaacagatacactcagatacattaagaaatcaagaattcaagaatatactggctctggaaattatgagaagtatggggttgaaagacatagacccttctcttagtgaagaaaattggagttgaaagatgtcctgtagtcacttgtttaaaagatattattaccaactaacatataatcagtacaataacatctaaactttattgtaaactctgtgtagaatgttccatattcttcacagaataaatgtttactgaagaccttcagggcactagtttccaggtactgtgagtacacatgatgattcaagtttggtcccaggctcaaagaacccacagtctaatggacacagataattacagtactgatgtgtgggaagcaggaaagctacaagagcaggggatgttgggaaaacagaggtgggcccctttaatccatgtggtctcagtagggggcttctttagtaggtaggtactattattatctccatttgtctgatgagaaattaacagagagaatagtacctggtatatggcaagcactcaatacacattcctttaaggaataagtggatgttaagcaacttgctcaagaaaacacagctagttagcgctggagtttttcagccccaaatctgactgcctcaaagccctgtgctgcttccagtatgctgatctctctctttgccagtaatgtcactcatactgtggagagctactctccctctgaggattcaacctgccatagagagcagtgagagaaggggcaggtacagtttccaagcctttcacattggatgaggcaccgaacttccagagaagatgcttctgatgtcactgtcattttctgagctgtctggtctttctacactcattaaaaagttaggaaggtgtactgcatgcgtcttggcttcaggaaaactccttttagtgctgacttagaggctcctgtcacattataagggtgctgggtcctgctgaatttttagattgtccgggagaaaatggttttcccaggaagatggctatcttatcaggaatgccatgtcctgctctgcagcactgtggaaaggatgccataatcgaaaactaaggtattatctcaggctgtgaaatgtaacatgtgtaattataaacaagattgttaactgtttgcttacctgttctgccctccttgaaatgaaattgtccagtccaggtctaacttcaaagccttttctcttttctgaaagtaagagcttccaaaagtgtggaacacagaaaactggtgatgttcataataattttagtgctacttggacattaaaattttaatagttgtatatgtgttttacttttcagtaaacatgtagtatatcacagccacatcaagatctttgtgtggtgattggggaagagcattgatattacacactccatggaaaatcaccataacatttcctttcaagatctctgatctttccctcagatttcctaccctgttggcaattgcgcagttttttctcactgtttaaatctttcatccattatcagacttcttgtttccccaagaatagaagccatccttctgtcctccccttctgtcatctgtttttacagaagcagaatctaaggttgtgatttgcattctttcaaccaggaaccatttctgcaataaaggaccctcctcagaacacaatctttggctgacagcaagatattgtaaacgatgaattttttctctctcagaaagcatacaaacaaatttccccacccctaaaagacagaaattataactgcatttcaggaagaaaaaaacaccatacctcatctcattgggtgtcctgagcattttgccacaggatctagggagaggtctcagggatgagaagttggctgatagtgttgagatcataaattccataaagtgtgtcggagagaatgttggtggataattaagctgacaacggcctacactgcttactcagcagtctgtgggctttggcatcatatgactgtgggtgtccatcctaaatctgtggcatagcagatttgggcatcttttctaacttctctggtctcagttttctcatcttgaaaaatggaaatggtattatgcattctgagttgctttatgaggattggatgagataatacatatgaagtgtttagtagtatagaaatctattatttatttcatttttatttcattttaataaaaagggtgaagaataaaatatttaattgaaataaattgatttaagtaatttaaggaaatttttcaataaaaaattaaaaaaaaaaccttttaaacattttattgtatttctttttgaagttatctttcctaccctgattgtccacttttatagttacatatgttactttaagttactttcaattttaagtaattctgtttcactgaaaatattagaaaaaaatcagcacaatggtatctatactagtaaaaaatcttaaaagtggtgaatgcatgactgagttctgagaaatgttaacctgagttatgtcctgtggtgtgcactgtgctagctatgatgagggatgacactgagaacatgaatcagaattccctgctccctcaatacctcatatgcaatggaaaactttacttgacatctaatacacaatagccaaattatggtacctattgtactaatcccagattggaagatagttttctgttgctatgagtagcacagtaaaatatcaattcaataaatactcgataatgcttattgtatttcagtctagatttcctgaggtctagtgggtaaaggccaatgcatacacagaacataaaaatgggactgtaagtgatgaattaaaagcctttgcctggcacatcaaaaagacaactaccaggaagaagaaaattcaaatagattaaaaaggagttaccacaggagtatgaggaaaaccaggaaagtcatctccttgtgagtgtgaaaatgttcacttatgttgacagtttcaccagtcattggattcacatatttaattctgtcagaatgatgtctatgaatttaaactctgacataaaataatacaattagcaggcttgtattaactcaacaagtttttttcttccaataagtatttattaaagactcattgtgtatcacagtttgtatttgagaaagttttagtaaatcatcaatggccaccctaaggccagatcagtgaatacgataataatgagttgaccaagattcatcaagaggcaaatacgttaggtgtggaaggtctggagggttctaaacccagggtgtggatgaaaagcccaaatcccccttgaaatgaagtttgaatgcggtggtagaacactagctatcctttactgaggggtgggtcacacaataaacatttacagaacatgactgggctttttggacatggagaagaaccaagccaaggctacaaagtgcttttagtctagtgggcagacagttatacagaaatgtaattgccaaacattttgatgaaaatactgacagggctgagaagatgagtcactggaaacacagaggaaggcctctaaaaaccaggctgagggtgtgtgggtgtgatcaagctgtacaaaagtttaacttggtcagggacacagagctaaatagcagtgtggtcagttttcatcactggatcagcctgattccaatgctctgtgcagtttattccaagttcacgcctacaacaaggccatctgttttcatttggaacttaaaggtgcacttcccctggctctgctttcactttccatcatgcttccttctcctttcagactcaccataaagtgaaatagttgatcccagcctgttggcttcagagcagcaattttgagctctttcctagcactttacagcgatgctcttttctgctgagtgctgagattttttaggcatgaactctattggaaacatcacacgtgtctcatcaggaagggcaggtatatttcagcaagtacagtatacatgaactgttgtcatagtgagtggacagaggtctggctttggagacagacaaatatggatgcaaacccctgctccattacctactacccaagttactgaacagggtagttactgaaactaccctgtttgctcatctgtagaaagcagagaaggtaggaattgataaaaatctctcagggtaggctgggaaagaaaaatatgcactccttgagattatctgtttatgtttctgactgttaagagtgtgaactcccagaggacagggatgccatctgagtcatctctgtgccttaaaaactccataaccacatccaaccagagcagtctcagcacatttttcttgtgcagagctgaatcaggcctcagctgcttctgctccaaagcgatggtgcttattttgaagatcctttcttgcatcctagaggtctatgaatactactcatatgccaacgttgatgagaatctccacagaggaagatatattttgctccattgtgacttttgccgtgtctgtttccatttgcatttttgagccacacttggatacagctgaaccagaaataatttctcgttctctctgccatattaaattttatacacagacaattcaagaggcaggtctcaggccttttaaaggtataaggctttattggcagaaagactggaatgtgaacaacaaaagctttccttactatatctgccagtagcaagccataatatgtcgattttagccctaatcccattgtgctgtaaacagtggtaacgtgtatgtcttattaactgaactgtgagcttccagaggccacgaaatgtatttattcttgtttattcctctttttattcccagcacccatgacagtgccaggcacatagaggacattcaataaatggttcttaagtaaatgaatgagagcatttgtgagttttatataagaaccatacagaggaggtggcaggctaagagtggttctaaagcaatgctgatgttacacaacttgcaagtgagagagacagaagcctctagatctgcttgaatccagaagcctgcagtcttagttgtattggctttactagactctgggactccctgaagcttaccttggccactttccatggtactcagaattcagaaaggagccctgtttaggatggactttgtgtccaaggctggttcatagattagattactcatgcaataagtagttattattcacttaatatgattagctatccctccaggtgctgggaatttagcagtgaagaaaactgagactgttccttgagtaaatgtccctgctctatgaaagctggtattctagttcaaagagaaagaaaacaaacaaacaaatgcgcaacaaggctcactaaacagtatttgaggattaattattgtgagataggagtttagcaaattgcagatgaatttaatacatgaaagcaaacaacataatatcctcttatttatcttatggaagtaattaatagcaagtgatatttttgaattaaatatacgattatataagtaaaacagtataaagattcttgaattttgggaacaaatatctgattaaatagctattgcttcaagtctctttcaccaactcacacagcttctgggagcagaaaaacactttgatggagagaacgtctgagtaatacattctttctctagctgtgatatcattacagattcagccttgtcaaattatgttgaattttaaatacaaactgagtcctcatgaactagtcaccaggtattttatgcatacttattatggggttaacattaaattgggtaccagaggtacaagggaatgctaaatcattctctgccttcaatgatcatatagccttgttgggaagacaatgcgatttgaccttttacactggtagaactcaagacagtttgagctacagtgcagggaatggaatctagattcataaatacccttgatcatcacttactggttttgtgactctggacatgatcttgcactcctctgagcttatttgcctttgtgtaagttagagataataaaatccacctttcagggttaccaggaagatgagaaatgactcctgtacacagtagaatcagagtattattagtctggtacattatgtgaacatcaaagattagcacagagctattggtatagattaggcattattactcatctatagttttatggtcagaaaatgggagtggaaaataattaaatacaacctgatccatacaaacaggacaaacagaaatccttagagtagattaaatattgatctaacaatgtgatggtctagctagcaccaggaaacatgcagtctagcaacacagtagattggtaaggtgctagccactagagtcagaaataatcagttttaggatgacaggtgataggtgctcatagcagtaggggaattcaagatatcctgagatgagagatgactatgtttcaacatccattttaatgcatacagcaacaatataaggtagatactgttttataccccatttacgtataaagaaacctgagactcagaggctaatgaacttgcctagaaatacctagccagtaaaggaacaggttatgattcagacctaggcactctgattccagtacttaagacatacctggggctacttttctaaacgtttcacatgtactatctaatgtaatccttacagttgcagaatttttattaaaaagcacagttctcactcagaaagaaagaaggatttgcataaaaaagaatttcaagcccagaaatactaagattacaggtgtcaggaatagtaacatccagcctacttccagcctttctctctctctctctctctccttccctcctttcttttctccctacttccttctctctctctccctctcccaccctccctccttctttctctttcctctccattcctccctcattcaaatccaagcaatagaatattaccaagggctcctttaacattcttttgccatgaagtcaaagaactgctcctgcagagaaaagggttaattgagaccacagagaagaacagttcaccaagcatactagagtttctgccctggtaaaacatacccaaagatgatggtgactgattggagccagggattcctggaaactaagaactttacatttagggcaagggacttgagatttaaaggaaaggtaatgttagggaaactgggttgtaattttagtcctgggagtcagttggagggggagcgtagaaggtagggtcatctttgtgatggactggttcggttttgtctcagggttacatgaatctgtggagagaagccagcagtctgctgtaggcagctcataccaactcactagagctgatgattaaaaattaaattatatgaacttacaataaaataaattatattaacaacaaagaggccaggcgcggtggctcacagctgtaatcccagcactttgggaggctcaggagggcggatcacgaggtcaggagatcgagaccatcccggctaacacagtgaaaccccgtctctactaaaaatacaaaaaaattagctggccgtggtggcaggcgcctgtagtcccagctactcaggaggctgagacaggagaatggcatgaacccaggaggcggagcttgcagtgagccgagatcctgccactgcactccagcctaggcgacagagcgagactccgtctcaaaaaaaaagaaaaaaacaaacaaagataaaatactcaaaatgaatggggctcctatttctcttattacgttttactattctctgtgttcttgaagggatttgtgtttttcatctgtaccgtggaagtgttgtggaatagtatgccgctgctcatctggtctcaggtgtgtattcagtgacttcacattggtagcttgaagtaaaccatggtgggggaatttacagcacccagaaatcaggccttcatttgttgttatgttgatagactagaattaatgaaatgatgtagaaaatgttaataatgctgattaaactttaatgcgttttgtgtctgtagccactacattgtgaatagaatagcatagaaaattgaggagctattatttttgtatttaaagactattgttcagtttgccaaagaagtcactagagtcattgatgaataagtgaagttcttgatgaataaatgaagttctgatatggttctttgttatatgactcttacttgttaacataaacaagttaaaaccccaaatttatgctagaactacacttggagagatgcttgctaggtatttaccagtatatatctggccaataccttcaactcctgccgcatcccatgcacaccaaatgacctggtctcccagcactgactagtggttccagagcagtgggcattgcaagtgacatcagaagggatggttagagaaaatgggatataaggccttgaagggaacaggaaagggcaaactgaggaggggatgaaggggtggaggagctagcccatttctacgagtacatatgtgtgagaatatatagctaatgtttacttagaatgtgtttctttacaaacttcaatgcatattccatgcatattcaaggatatatatttgtacatgcatgtacgtaaataggcattcaagcacataactacaatagagttaatcaattttatttattcatttttaaacaggttaatgcatggacatattaatgtgtatgtgcaatgaatgcttcaaaattttcaaaaacactggctaattgtttcccccacttctttttactcaaaccgtaaatacattttttcagaatttcccaccattggcaggaaatagctatattttaagttatgtgctttctaaataagtataattctggaagttgtaaaaccccaatagaagctctacttcagtaactggtgcacagtgagtattcttagcttatgcatacacagatatttattggataatgatatgtcaaatgatgtacggggcacttgggattcacaaagaattgggcagtgtccttgccttcaaatatctcacagaaaacagaaattaaacaaatgtaatttatgatctggtactgggaccaggatagaagtctgatcttcatgtatgtcacactctctccagcttctaagacctcatatatattattccactctctggaaaattctagttctgcttttcacctaactcctatttatttgctatatctcagatagcgtgtctcttcttttgaaaggctatatcttgcctccatcttgatatatactgtcagaacatcttgaattcccctactgctatgagcacctatcactgtttgttgtagtttcttgttttgttgtcttcctcaacagaccatgagctccacaaggactgagatcaaggatgccttactcatttctatatccaggagcctacttcagtacctgccataccagtgtgaggaaagacactatgacagctggagggctcagttcataggatggggataaaaaacagttagaaaaaaatgaatccatgccaatttcctattcatatatcacagtcaaagttgcatgatcggacatgactagatgctggaaattcactgatgtaggttgtattcttaatattcaaatagtcgaggattttatttagcaaggaaataaaatttgggagcaatgattttatgaaagatgtcctatttcacggaaaggacacagaaaaaaacagtgcctctttctcttcttgattctattcttcctggttgtaattcctagaatgcttattatagaggaaagcatcctaactactgggcttctttcccagagattctgaggaagcaagcgtcatcccattccctatgaatttctcaagtgttaaagtaaaatcatccaacaatgtgccatcacttataacgtccactggagggcgatatactactgctggtaccaccttctatagcatagcccgcgaggactaactttagtttcctaacaatgtaattataagtcctcatagtgcagaacacctaataaataaaagaagccttttcagtagatgtgaagatacagatgagaagatggaaatggcaccagccctgcgcccacctcccatttccttacctatgaccccagggtagaccaggttcccaggggtcctgtaatacttcccctccatgctgacttgtgactaacacagaacacagagctaatggtttcacctagaacatggccggtctctttaggttcctgggtatctcatcctggagagaggacaagattaggagatgagtgttattatcataacaattttagagatgaggacactaaaactgaggtccaaataagtttattaactggcccaagaataaacttattaactggcctcttttctgtgctcccacagcaccccactttttcctagtcacactgtatttggaggctttctcattcgctaaatggaagtgataaggacctagagactgtgttttttgttcactgttctatcttagcatggaaaacagtgctgggcagccaggaggcataaagtggaggaaggctaggcagagaatagggtatgaggtgggagaggatgaggttccatctatggtgattcccctgtcacagcttggatgaatgtggatggggaagaaacagtggatgttgtctgataaatccattaagaggagaaagatcatgcagcaccctacggatttacttcctattactccttctaccctgtcactggattgatgtaactctcactttaagtgtccaaaaacatcgcacctgagagggtatccatgaaagtatctaaatcttaggatagagtgcaatcatgacccttggttctatttatcagtgtcgtcacctaataagagcaaccatcatagcaaattcttgagtgcctgctgggcgttagccactgtaccagcagattatacacacgccctcatttcatcctcacaatgaagatgagggtgggcttttatagatttttttcttttttgagacagagtcctgctctctcacccaggctggagtgcaatggcgcaatctcggctcactgcaacctccgcctcccgggttcaagcaattctcctgcctcagcctcctgagtagctgggattacaggcgtccgccaccacacctggctaattttttgtattttgacagattttacaaagctggacagtagtgcatagaagagttgggttttcagcccttgctctttccttgaagtaagagatgcctgaagcatggcacagtggccactgtcagggtccatgatcactaatggctcacaaacattcattcacaattttgaagtgtaagatatacttctgtgcaatagaaaaaaagacagctaacacataaagtaacattaactttaaagcctcctttggaaataaaggggaaaacactgacttcctggaacctgtggtaaaatcccccaaagactcccttaaacacctcttgctttcccctatattccttgctggatataagctgctcgttgcttctctttctctccagttcttactcagtcatccccttccccaacagcttgttctttctcaggttttagcccccctcccattccttctcaccagcacaacagtcctctgcttgcattctcacacacagaaaccagcctagcatgcttaaactgtatgccaagttaaaagggtgcttggcactcttgaacatgagtctttaaccaaactgatgaatgatttgcacatggcttagagaagcaaaaattatcagaacacgctttaaaagtcattctcagaaaaagagagaaattatatatacacatttctttggacagaaacactgacatggcagaagcatgacatcttgagtcatttttttccatccctctggatctattctatgcaatggagtgtaatataggtgtaactcagtgcaatttggtattttctgaccaccaatatgactgaaccacctaaggcatatatgcatgttcatgttctcccttcctctctccctccctacctcaactcaatccctaggtggagaaggactggggcaagctattccaaagaacaaaggaggaatcttggggagtagagcaacatgttggagaaaccaggtcacaaaaaccttccctttaggtaggggtaggggaagatggaaaagaagaggtatgaattgaaaggtggtagcatctcttatgtgaggcatagccatgtcatctctcatatacatggaaacacaaacttacttaattgatctcttttcccttcgttgaaaaggtaagtcaagttaaacaattcaacatccaatgaaacatgtacagaggagagacagacagcaagtaaaagacatatggaaagagtatccaggcccttttaccgaagtagtagaacaatgcagacatttattagaagtttgctcctttgaaatattattattacactgaaagttggaaaaaagctaaacatccatcagaggaggttgattacataaattatgaaagatccatattttttaattctatgaagccataaaatgataatactgatatgtatcattgaacccaccactgattgtttgataaaaatttcagataccaagaattacatataaattagagttggttttgtaatatacagcatagaaatacatacttttctattattaaatatttactgatttctgaatacttacacatgtataagataggtatttagaaagattaaagagggcatacagcacacagacgtttctcattcctatctcccatctcctttcccagagacagtttctaaaacaaaactgaggaaaatactaacatcattcgtctaataagagcaatgaggtatgtaatactaatgaatcttaaaacatatcatataaaaaacactagataactggactaagtagtgcaaacgtgaatgtctatctaaaacacacacgtcgcacacacacgataatgaatggaagacgtcctagcacatgtttacaaactgtttgtgtgttgccgtcctacacaccagacgcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttatcgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctcttttacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccacagtttcctgaacgtctcccagcgctcccgctgtgcgcccaggtccagctccttaggggactcggcgggcgccggcgggtccgggagtggcgcggagggcagcggatctctggagcccgcctcccgggcccgccgccaccggcgcttccgccgcaactttcccagccacctcttggccgccgcgtggctcccgaccccgacttggacccgggggcactgcgcgcggctggcgcccatgaccgcgatggccgcgcaggcggcgggaggatccccgggccgctttcgcctccgccgctgagcagtggcgcggttcctcactctgcccatggcgcctgcagcctccggagcgcgtgcccagcccgctacccccattttcccgtcagttgctgagcagcctccttgtctgcgccagcaggattggccacttgttgaatgtgatgtaaagggacccttcccttgaccctatcacaacagcctttgctggcccgaaattctgactgagcctatcagttgccccttctcctaaatgttaatttctattgttgattcaaatcatcagcctaaccttaacatattgaaccactgaaaatactgtagatcttttagttagcatgcaacagcaggtagatcagcttaagaaaaaagaattattcatctactatagaagagacagagtcatgcataaagccttggggggagaaaatgtgtggtgtgtaagtagttgtaccaaagttaagtgtagtaaagatgatgatccacagtactatgttacatcggtggacccaaccagagaaaatacaggcaaaaaaaaatttactcatttaaatccatcttctaaggacaagagataaaagaagaaacagtacatttatttttgtgtctgtgccaagaacaaattaacagctctggcaggcatgaatatgaagtggatattttgttcttttaagattgatttggttgatcgttgggcatagtcagaggagagaccccacaaaatgagcacagatcttcttttctggggtgcaataagtacctgggaaaacagtgagcagtcttaggaaagctgcttcttgtgagttaagtagtaacatccacacacatgggttttaagcagagatgcatccatctacccacaacctagattcaatgattcttaacattttgttgtatgtacctatatgcgacaactgtagacagaacagtaattcgataggaattacatgtatctatatgcatgcatatgtgcatacattttttcaaaaacatttaaagtaagatacatacattaatgccatgttgtctcaatatttcagcactcacatcctaagaataaacatataatttctctttttttgaagctcaagattatgtatttacttatttttgtaagttcggtgctacatgtgcaggtttgttacttggatatgttgtgtagtggtaaggtttggggttctagtgtacccatctcccaaacggtaaacaccgtagtcagttggtactttttcaactctcatttccctcccaccctccctgcttttgcagtccccgtgtctattatttccctctgtgtgtgcatgtgtacccattgtttagcttccacttatgaatgagaatttgattttctgtttttgggttattttatttaggataatagcctcaagctccatctatgttgctgcaaaatacatgatgttattcttttttatggcagtgtagtattccatggtgtatatatagcatatttttctttattcaatcatctgttaatggacacaaagtccatgacttcgctattgtgaatagcactgcaataaacataccagtgcaggtgtctttttgatgtaacgatttattttcctttgagtagatacccagtagtgggattgctaggtcaaatggtagttctatttttaactctttaaggatctccatactgctttccacaggagtcgtactaattcccaccaacacgatataaacgttttcttttctctgcatccttgccaacatctgttagtttttggctttttaataatagccattctgactgctgtgagatggtatctctctccttgtgattttaatttacatttctctgataattagcaatgctgagcattttttcaagtgtttgttggacattcgtatgtcttcttttgagaaatgtctgttcatgtcctttgcccactttttaatggggttatgttttttttcttgttgatttgtttcgttccttatagattctggatattagtcctttgtcagatgcattgtttgtgaatattttctcccattctgtaggttgtctgtttactctgttgattgcttcttttgctgtgcagaagctgtgcagtttaattaagtccaatttgtctatttttctttttcctgcattgtttttcaggtctcagtcataaattctttccctaggccaatctcctgaaaagtttttcctaggcttccttctatgatttttatagtttcaggtattacgtttaggtctttaatccatcttgacttaatttttgtgtatggtgagagataggggtccatattcttctgcgtatggtgctaattttcccagcaccatttattgaatagggtgtcctttccccgttgtttatttttgtcaactttgttggagatcagttggttatggctgtgtagcttcacttctgagttatctgttctgttccattgatgtgtctatttttgtatcagtatcatgctgttttagttactatagccttgtagttatagtttgaagttaagtaatgtgatgcctttggcttttgtctttttgcttgtgattgctttgactatttactctttttttggttccatatgaattttagaatttatttctaattctgtgaaaaatgatattggtaatttgatagaaattacattgaatctgtacattaatttgggcagtatggtcattttcatattattaattcttcttcttcttcttcttcttcttcttcttcttgttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttctttcttcttcttcttttttgagacagaattttgctcttgttgcccaggctggagtgcaatggcgcaatcttggctcactgcaacctccgcctcccaggttcaaatgattcttctgcctcagcctcctgaatagctgggattacaggcatgtgccaccacgcccagctaattttgtatttcttgtagagatggggtttctccatgttggttaggctggtctcaaactcccaaccttaggtgatctgcctgcctcggcctcccaaaatgctgggattacaggcgtgaaccaccgcaccttgctgatattaattcttctaatccatgagcatgggatgttttttcatttgcttgtgtcatctacaatttctttcagcagtgtcttgtagttttccttgcagagctcttttatttccttgcttaaatgtatttctaggtgttttatttgtttgtgtgtgaatattgtagatgggattgagttcttgtttttatttttagcttgaacactgttggtgtatagaagtgcaactgatttttgtatgttaattttgtgacctgaaactttactgaagtcctttatcaagtctaggagtcttttggaagaatcttcagggttttctaggtacaagatcaagatataatttgttatacagccacaatatcattttcacatctacaaatcattaatgatttcctaatatcttctaactcccagtagatgtttaaatttctccaattgtttcctaaatgtgttttataaaaagattcttccctaaacacactctaattaatatttacacatcagattcagttgatatgtctttttagtctcttcaccaacatttattttaataggccaggacagttatctgctgattttgtctgattgtttcctgtgccattagattgctcacttatctatttcctatataactaaaagtcacatctaaaggcttaattaaattcaagttacatgttttggcaactatgtctcataggtggtattgcatacttcatatttcaccacatcagaggtttgtgataccaaattattccagtagtaataaaactaaatgttatctcttcactaaagtggtaattgctatatttttctattatgaaagcatggtctttctttgcaataagcaagtaatcttgttgcaggacaagcaaaccccaaatcaagacttaaccaaaaagggttcttggcttcacccagaaaggatttcaagggttagccggtagtattagctagcaatcttctattgaacacactgctccccttagagcatagctaactcataggcagtgcacccagagtcagcaaagtatgatgctcttggcaactgtatttatacttacatggaccctctttcaattacctgcaaattaaggggcaggtcaatgcaaattgaggggtgaggtatttaaaactttctagggggagaggcggttccaagatggctgaataggaacagctccagtgtacagctcccagtgtgagtgatgcagaagacagggtatttctgcatttccaactgaggtaccgggttcgtctcactggggcttgtcagacagtgggtgcaggacagtgggtgcagtccacctagtgtgagccaaagcagggccaggcatcacctcacctgggaaatgcaaggggtcagggaattcccttttctagccaagggaagctgtgacaaatggcacctggaaaatcgggtcactcccaccctaatactgcacttttccaatggtcttagcaaatggcacaccaggagattatatcctgcgcttggctcggagggtcccatacccacggagcctggctcattgctagcacagcagtctgagatcgaactgcaaggctgcagcaaggctggaggaggggtgcccaccattgctgaggcttgagtaggtaaacaaagtggccaggaagctcgaactgggtggagcccactgaagctcaaggaggcctgcctgcctctgtagactccacctctgggagcagggcatagctgaacaaaaggcagaagaaacttctgcagacttaaatgtccctgtctgacagctttgaagagagtagtggttctcccagcagggagtttgagatctgagaatggacagactgccttctcaagtgggtccctgacccccgagtagcctacctgggaggtaccacccagtaggggcaggctgacacctcacacagccaggaacccctctgagatgaagcttccagaggaacaatcaggcagcaacatttgctgttcagcaatattcactgttctgcagcctccactgctgacacccaggcaaacagggtctggagtggacctccagcaaactccagcagacctgcagctgagggtcctgactgttagaaagaaaactaacaaacagaaaggacatccacaccaaaaccccatctgtatgtcaccatcatcaaagaccaaaggtagataaacccacaaagatggggaaaaaacagagcagaaaagctgaaaattctaaaaatccgagtgcctctccccctcgaaaggaatgcagctcctcaccagcaatggaacaaagctggacagagaatgactttgacgaattgagacaagaaggcttcagacgatcaaacctctctgagctaaaggaggaagttagaacccattgcaaagaagctaaaaaccttgaaaaaagattagtcgaatggctaactagaataaccagtgtagagaagtccttaaatgacctgatggagttgaaaaccatgacacgagaactatgtgacaaatgcacaagcttcagtggcctatttgatcaactggaagaaagggtatcagtgattgaagatcaaatgaatgacatgaagtgagaaaagaagtttagagaaaaaagagtaaaaaaaaaaaaaaacgaacaaagcctccaagaaatatgggactatgtgaaaagaccaaatctacgtctgattggtgtacctgaaagtgacggggagaatggaaccaagttggaaaacactctgcaggatattatccaggagaacttccccaacctagcaaggcagaccaacattcaaattcaggaaatacagagaacaccacaaagatactcctcgagaagagcaactccaagacacataattgccagattcaccaaagtagaaatgaggaaaaaatgttaagggcagccagagagaaaggtcgggataccctcaaagggaagcccatcagactaacagcagatctctcagcagaaactccacaagccagaagagagtgggggcaaatagtcaacattcttaaagaaaataattttcaacccagaatttcatatccagccaaagtaagcttcataagtgaaggagaaataaaatactttacagacaagcaaatgctgagagattttatcaccaccaggccttccctacaagagctcctgaaggaagcactaaacatggaaaggaacaactggtaccagccactgcaaaaacatgccaaattgtaaagaccatcaaggctaggaagaaactgcaccaactaacgagcaaaataaccagctaaaatcaaaatgacaggatcaaattcacacataacaatataaaccttaaatgtaaatggactaaatgctccaattaaaagacacagactggcaaattggataaagagtcaggacccatcagggtacagtattcaggagaccaatctcacatgcagagacacacataggctcaaaataaagggatggaggaagatctaccaagcaaatggaaaacaaaaaaaggcaggggttgcaatcctagtctctgataaaacagactttcaaccaacaaagatcaaaagagacaaagaaggccatcaattcaacaagaggagctaactatcctaaatatatatgcacccaatacaggagcacccagattcataaagcaagtccttagagacctacaaagagacttagacgcccacacaataataatgggagactttaacaccccactgtcaaaattagacagatcaatgagacagaaagttaacaaggatatccagaaattgaactcggctctgcaccaagcggacctaatagacatctacagaactctccaccccaaatcaacagaatatacattcttcccagcaccacattgcacttattccaaaactgaccacatagttggaagtaaagcactcctcagcaaatgtaaaagaacagaaattataacaaactgtctctcagtctacagtgcaatgaaactagaactcagaagtaagaaactcactcaaaaccgctcaactacatggaaactgaagaacctgctcctgaatgactactaggtacataacgaaatgaaggcagaaataaagatgttccttgaaaccaatgagaacaaagacacaacataccagaatctctgggacacatttaaagcagtgtgtagagggaaatttatagcactaaatgcccacaagagaaagcaggaaagatctaaaattgacaccctagcatcacaattaaaagaactagagaagcaagagcaaacacattcaaatgctagcagaaggcaagaaataactaagatcagagcagaactgaaggagatacagacacaaaaaaactttcaaaaaatcaatgaatccagcagctggttttttgaaaggatcaacaaaactgatagaccgttagcaagactgataaagaagaaaagagagaagaaccaaatagatgcaataaaaaatgataaaggggatatcaccaccgatccaacagaaatacaaactaccatcagagaatactataaacacctctatgcaaataaactagacaatctagaagaaatggataaattccatgacacatacatcctcccaagactaaaccaggaagaagttgaatctctgaatagaccaataacaggagctgaaattgaggcaataattaatagcttaccaaccaaaaaaagtccaggaccagattgattcacagccaaattctaccagaggtacaaagaggagctcttaccattccttctgaaactattccagtcaatagaaaaagagggaatcctccctaactcattttatgaggccagcatcatcctgataccaaagcctggcagagaaacaaccaaaaaagagaattttagaccaatatccttgattaacatcgatgcaaaaatcctcaataaaatactggcaaaccgaatccagcagcacatcaaaaagctaatccaccatgatcaaatgggcttcatccctgggatgcaagtctggttcaacatacgcaaatcaataaatgtaatccaacatatatacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcataccgaatgggcaaaaactggaagcattccctttgaaaaccggcacaagacaaagatgccctctctcaccactcctattcaacatagtgttggaagttctggccagggcaatctggcaggagaaagaaataaagggtattcaattaggaaaagaggaagtcaaattgtccctgtttgcagatggcaagattgtatatttacaaaaccccatcatctcagcccaaaatctctttaagctgataagcaactttagcaaagtctcaggatacaaaatcaatgtacaaaaatcacgagcattcttatacaacataacagtcaaacagagagccaaatcatgagtgaactcccattcacaattgcttcaaagagaataaaatacctaggaatcccacttacaatggatctgaaggacctcttcaaggagaactacaaaccacagctcaacgaaataaaagcggacacaaacaaatggaagaccattccatgctcatgggtaggaagaatcagtattgtgaaaatggctgtacttcccaaggtaatttatagattcaatgccatccccatcaagctaccaatgactttcttcacagaattggaaaaaactactttcaagttcatatggaaccaaaaaagagcacgcattgccaagtcgatcctaagctaaaagaacaaaactggaggcatcacgctacctgacttcaaactatactacaaggctacagtaaccaaaacagcatggtactggtaccaaaacagagatatagatcaatggaacagaacagagccctcagaaataataccacacatctacaaccatctgatctttgacaaacctgacaaaaacaagcaatggggaaatgattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacttaggcaataccattcaggacataggcatgggcaaggacttcatgtctaaaacaccaagagcaatggcaacaaaagcccaaattgacaaatgggatctaattaaactaaagagcttctgcacagcaaaagaaaccatcatcagagtgaacaggcaccctacagaatgggagaaaatttttgcaatctactcatctgacaaagggctaatatccagaatctacaatgaactccatcgaatttacaagaaaaaaacaaacaaccccatcaaaaagtgggcaaaggatatgaacagacacttctcaaaagaagatgtttatgcagccaaaagacacatgaaaaaatgctcatcatcactggccatcagagaaatgcaaatcaaaaccacaatgaggtaccatctcacaccagttagaatggtgatcattagaaattcaggaaacaacaagtgctggagaggatgtggagaaataggaaaaattttacatggttggtgggactggaaactagttcaaccattgtggaagacagtgtggtgattcctcaaggatctagaactagaaataccatttgacccagccatgccattactgggtatatacccaaaggactataaatcatgctgctataaagacacatgcacacgtatatttattgcagcactattcacaatagcaaagacctggaaccaacccaaatatccatcaatgatggactggattaagaaaatgtggcatatatacaccatggaatactatgcagccataaaaaatgatgagttcatgtcctttgtagggacatggatgaagttggaaaccatcattctcagcaaactatcgcaaggacaaaaaaccaatcaccgcatgttctcataggtgggaactgaacaatgagagcacttggacacaggaaagggaacatcacacaccgggacctctcgtagggtggggggaggggggagggatagcattaggagatatacctaatgtaaatgacgagttaatgggtgcagcacaccaacatggcacatgcatacatatgtaacaaacctgcatgttgtgcacatgtaccctagaacttaaagtataactaaaaaaaacctcactattattaataaaacactctagaatacttattttaaaaaaaactttctagggaagaggtgataacttcttgattgttgtcatggcaagcgtaaactgtgatggcactggtgggagggtcttatgctaatgagtagtgacggcggctagggattgcgctcatcaccatctactggttcctgctagtttctttgcttcatcccgtctggagcagatcctgttttggtccgcagggttgtgaccagaaaacaagtcctgttggtctcccacctcaatctgacggatattattttgacacagtgtaagtatcttgttcctttacagcttttttccttgtggttttagaatctgtcagtaatctttgactgaaccaattatttcactgttgttacgttacaaaatgatacttttctaattctaaattcccttctatttttattagctggtattcacccataaagacgagctttttctcatcaactgtggatggactattttttctcccttaaaggcaggatacatgctttattcttttactttaattatcattttgcggaataaagagttggagtaatagaaatctccaattatgaaacattattctccctttttctatctttctctctctttctctgggtataactttggattcacggatttttattcatttaataatttacaatcatcaagtaagtaatcgaattatcccaattttggcccatgggatttctttcaaactggttcctgtatccttttgcatttctccattaatctttgagcacttccttgtttcctggaacaactagatgccccagtatctctttgtaatttttacttttgccatctgatccctggaatcacatatttctccaaagacctccggttccttttagcagagtatgatatttagaaccatacctgggcacatcatgacacattatttattatcaaaatttttattgaatagttgtagacatgcatactgttgtaatatataatacagagagatctcttgtaccctttatccagtttcctccaatagaaccattttgccaaactatagtaagacaacttgtatatttgtatatttttattgataaaatcgaccaattttgttcgaatttccccagttttaaatgtattcatctgtatgtgtgtatttgttctgtgaaacatatatatgtgatatatatgtgatatagaacaaatacacacatacagatatagagataagtgtattgcatgtatgtgtgcatatatatatatatattttatatatatataatatatatatattatatatatattttatatatatataatatatatatattatatatatataatatatatatatattttatatatatataatatatatatattatatatatatatatatatatatatatatatatgtaggttttataggttcatgtcccatcattacaatcagtaacaccggtaccacaaatctgtccaacatttccaatattttgtcatttccaaaattttatataaatgaaatcaaacagtaagtaactgttttgaattggcttttttctctcagaattatactctgagtatcatccaagttgttgagtgtattgatagttcattcttttttattgttgagtggtgtgtgtgtactataatttgcttaaacatttacctgtttaaggatatctcccagatttttagctatgacaaataaatattccacagacatttgtgtacaggtttctgtgtgaacataagtcttcattttgctaagatgaagaacgcgattgctagagcatataataattgcatatcttgttttataagaaactgccaaactatttttcagagtgactgtacaattatacattctcaccagcaatgcacgagtgatccaatgtctccatatcctccccagcattttgtgttgtcactgatttttattttagcaattctgatacgtatgtagtgatatctcattatgattttaatttgcatctctctcattgctaatggtgttgggcatcttttcaagtatttatatgccatctgtgcagccgtatgtctttgcccattttctaattgggtttttgttggcttttatttgtttatttcacatttttactgttgagtttaagagttatttgtattctgaatagtatttctttgttagatatatggcttgtaaatattttcttttagtctgtatttattttttcatcctcttcacaatggtctgagaactttttggttctgaatcacacagattttctcatgttttttttttctcaaagttttaatgtgattcactttcagttaattatcattattattacttttttgagacagggtctggctctgtcacccagactggagggcagtcgcccaatctctgctcactgcaacctcggccttctggggctcaaatgattctcccacctcagccacccgagtagctgggattacagatgcgccctaccatgccctgctaatttttgtattttttatagagatggggtttcaccgtatcgcctaggctggtctcaaactcctgagctcaagtgatccacccgcctcagcctctcaaattgctgggattacaggcatgagccactgcacccagcccactttcaactaatttttatataaggtgttaggtttagatcaagcctttattttcttactttctggtttttttccccataggaatgtccaatttccttagcaccattttattgaaaaagctatcctttctccactgaattgctcttccaccattgtcaaaaatcagttgagcatatttgtgtctgtctatttctggattctctattgtgtttcattgatctgtgcagccatacctgccccaataccacactgtcttgactacagccttattatcagataggtaattcctcaaatttttgttgtttttcaagattatttaagctattctaggacctgtgtctttccatacaaattttagaataagcttgtctatgtctgcaagaactttgctgggatttagataggaactacattaaacctatagatcagtttgtggagaattgacgcctttactgtactgagccttccaatcaactaacacagtgtacttcaccatttatttacttcttctttgattgttttcatcactatattgtaatagtgttcagcacacaaatactgttcatgttttgttaaattcatacctatgtttcttagtctacttgggctgccataacaaaatcccatagcctgggtggcttaaacaatataaatttgttttctcacagttctagagactggaaatcagagatcatggtgtcagcatggtcaggttctggtgagggctctctttctgtgctcagatgacctttctcagagaaaagcagggaaagagagtgagagaaagagaaagagagagagattccttcctattcctataaatccactaatcctatcaaattagaaacccatcattatgactcagttaaccttaattatcccctaaagtcctcatctctaaatatatttacattgggggttaaggcctcaacagataaatttggtggggagaggacacaattcagtccatagcactaagtagcttgttttctttgcagtaattgtgaatggtactgtttttaatttgctttcctcatgttcactattactataaagaaataggattaattttaatgtgtcgatcttttatcctgtgacatggctaaactcacttacactaagtactagaatttttctcttgtattaatactaagactttttggtagactccttggaaatttatacatagacaatcatgtcatctgcaaatagagataatttaatttttcccccaatttgtataactttttaaaaatcttgctttattgcaccaactggacctggtattatgttgagtaaaagtggtgagatcataaatccttgccctgttcccaatcttaggggaaaacatttagtctttatcattaagtatattagcagttttcttgtagatattctttataaagttttggaatttggggcttttgacaaactctctgtaactattgataggattttcctttttccgctctttgatgtgttgaattacactgactgacttttgaatgttgatccaggagcctcgaaaccctggaataaatcccactttatcataggcataatttttttatatttttgggttcatttggttagtgtttgttgaggacctttgcatctcaattcatgagagatattactctacagttttctcttcgcattgactttgtatggttttagtatcagggtaatactggcttcataaaatgtgttgggagcttttcttccttttctgttttctccaggaaattgtgtaaaattggtattagttcttcctttaaagattcataatgttccagtgaatatttattataagaaattgaagcaatctggctttggagattttttttttatcaggagcttttatagtaaaagttacttcttttttattgttagggcccttcagatgatcaattgcatactggtgagtgttggtaatttgtgtttttcaaggaatttgtcataaattatttaattatcataatatccattaattatactctttgtatagttttcaaagtggttactctagtcatttttttttattatttatttatttatttatttatttatttatttatttattgagacggagtttcactcttgttgcccagactggagtgcaacgacgcgatctcagctcaacgcaacccccgcctcccgggttcaagcgattctgctgtctcagccttcccagtagctgggattacaggcatgcgccaccacgcctggctaattttgtatttttagtagagacggggtttctccatgttggtcaggctggtctcgaactcccgacctcaggtgatctgccctcctcggcctcccaaagtgctgggattacaggcatgagccactgtgcctggcctactctgattattttaatattttcatgatctgtagtgatattcctatttaattactgatactgttgatttgtgtatttttttcttctttcgttcagtctgctaaaggtttatcaatgttggtgatttttttttttgaagaaccaactttttgtttcattgattttctctattattgtcatgttttcaatttcattaatttgtgttcttgtcttcttttttaattattattttttttttttgagacagaatctccctctgtcacccaggttggagtgcagtgggtgtaatctcggctcactgcaacctctgcctcccaggttcaagtgattctcccgcctcagtttcccaagtagctgggattacaggcgctcaccaccatgcccagctaatttttgtatttttggtagagacggcgtttcaccatgtttgcaaggctggtcttgaattcctgacctcaggtgatctacccgccttggcttcccaaagtgctgggattacaggtgtgagtcatcacccctggccggtgttcttgtctttattattcctttccttctgtccatattttaaattttagttttctcttgtttttctactttcttgatgtgagaccttaggttatttttaaaaacattttctcattcactgctgtaaattttctcagcatttctttagttgcatcctacatatattgatatgttgtcttttattctcatcagttgtatgtattttaattttaattttgagacttctctttgacccatttattacttagtagtgtgttaatttctacatatgtagagatatacctgttttaaaaaattgatttgatgattgattcctttatggttgccttttcactctgttgattgtttcctgggttttttttttttttttggctatgatttctacttcttctagaagtcttaaagtttggggtcttacgtttaagtctttaattcattttgagtttatttttgtacatattgtgagataagatccaatttcattcttttgcatgtggatagctagttttcctaatactgttttttgatgagaccgtcattttcccattgtgtattcctggcaccgttgttgaagatcacttgaccatataagtctggtattattttcggggtctctattgtgtccctttggctaatttgtctgttttttatatgtctggttttgggtttcattttgttttgttttatttttgagacagggtctcactctgatgcccagactaaagtgcagtggcacagtcacagctcactacagtctccacctcccaagctcaagctatcctcccacctcagcctccagggtagctgggaccaaaggtgcatgccaccacacctggctaatttttttactttttgtaaagatggggtctccctatgttgcctaggctggtctcgaactcgtgggctcaagtgatcgccccaccttagcctcccaaagtgctgggattacaggcatgagcgtccacatctgacctatatgtctgtttttatgccagtaccatactattttgattactgtagctttatagtacactatgaaatcaattttgtttttccttctccagattgatttgggtatttatggtcttctgtggttccagacgaagtttagaattattttttctattcccgtaaacaaacatgccattaggattttgataggtttacaatgaatctgtagatcactctgggtattagggatattttaacactattaagtcttcagatccatgaacacttccatttgcttgtttcttgtttaattttcttcatcaatattttgtaattttctgtatacaagtctttcacctccttcagtaagtttttatctatgtattttattctttttggtgttcttgtaaatgagtttgttttcctagtttcctttttagataattcgttattagtgtatagaaatgcaattgatttttatatgttgatttgtatcctgcaattttattgaatacatttattctaacaatttttagaggaatctttagggttttctaaatataagatcatattacctgcaaaagggacaattttactttttactttctgatttagctcccttgaattattattattattttttgattaattgttctgaataggactgctggtactatgatgaatagaagtggtgaaaggggcatccttgtcttgtccctgatcttagaggaaaagccttcactttttcaccattaagtatgatgttagctctgagcttttcatatacagcctttatttgttgagataattttcttctggaactcccataagtcatatattggattgcttgatggtgctctatgttgggaaaaagtcttatggggtgcctgtataaactggccataaaaacatggaacaataagttgtggaaagccacaagaggcctctgaggaggaaagccttcttatcgccattatgttcccatgctctgagcgagacttggtctcttatccataaacattgtgttcaaggagaaagacactcctttgaagcattggaatgtggccagatgtgcaggctcctagttaaggccgctcccactagccactctctgataagttaaagatatgctgtttgagcacaaaggagattcatttaaaccgctattgctatagattacgcctatgacgcactgcctccctttcactgtttcgccctgaacatctgcttcttagatttaagtgatcatactcaataaatagtgtggagactagaactctgggccttttgcagcctccattttgcaactggccccctggctcccacctttatgaactcttaacctgtctcttatcattcctttgtcgccaccagactttgggtaccctactggtggtgttgaggctggtacccaatagctctatgtatctcttaagctttcttcactttttcattactcttctgtctctgcttaagttcctgctggtaccacctggaaaaaagaaggtgcttccttttgccttccaagtatcataaagtgagttatggggaatccaaagcaatggtgcagaaagtgtttcccctgattttttttccagccccccatagccagcgaactttccactttatctctgccagtgcagacaggagtgggctgccttccgccattgtgtggaggagcaggagccatgagtctgggtggaaggttaggagaccccagcccaattcaccttctgccactgggtaaagagccaggagacaacaggcctggattgtcttaagccattcggtatagggccaggacccactggatgtaggtagcggtctaccaatgggtagaagatcaggagacactggacttaggctgccctctgcagttgggtggagtgctggaagacaccgggccagctggcattagcatttcaggtagaaaggctcatctctggcctcctggtatggggcagagagtatgttaacctacctgggtccccctgttactgctgtgggtaggtctgatcctgtcattgctgctggctggtgtaggtgtgggggatggattggtcttctctcctgcagctttgctggtgcagctactcccggcagatcagccagctgctgccactggatatgaatctccctgctaagttcctgctaagctttccctttcctgaacctttgttcagagaaagcaggcttttcttttgcatttctttatttgtttatctatttttggtctaccctattggcagtttctgggttgcacacctcccagacacccagtttgggatacacgagtgatataaagaaaacctggggagctcattatggtgtcttcttcaagtcctgaggctcctttccagtctaccttcttcctatatttgagaatctgttaaattattttcaagatatttagttgtatttagagggaaggaacagggaaaagtaagcctatgccattgtcccagagccagactaaaaccactaagttttgacatactacaatctaaatatctttattttttttctctctaggttacatttctggttccagctaagaaaggtgatgaaaagttgctttttagacaaaataagcccttaccctcaaaggaaagttgctcctgaaatacaagcagaaatcagtggtaagtcatacagcaaatatctaaagcattttaggtatttgtttttagaccgttgtccaggatctgctctactcacctacaagaaagaaggtgcttctttttgccttccattttagccaattgtccaggatctgctctactcactccagaaaaattggaaaccaagcttctactagttctctaagtattatactggagctagtagatttttattcaaacacttaaagtttcaggacatagtaaggcaagaaacagagaacataataaaaatgtgttgtttatctcagttgcaatgagaatatctaacacccagataattgtttctaagtatcatttcttaatgaaaggagccaggggtccttggacaaaccattgattccagggataaagtatggaaagcataggttaatgtggaacatcttaacgggacagaaagtaaggcagcactcaaaaaattacatagacttgtcaaaaggatatagaaccagcttgaatggggctcacattgcttaaacctaggaaatttgagctttagaataaataattataacaatgagttataaaaaaattgaataaaataagaatccattaatctgtactaaaagtaaataaaggaaaagctcttcgttacagtagaatcccatccaataaatgtagaagaaatgatgctgttagaaaaacaccattttataactatcatgtaataattgtctaggacaagagtcattaatgaatactaaaattagtgtatggaagctttgtgattaatgggatagttacacgttctcaacacctctcccacaaaacaggtaataattacaaaggaaaaataatttgcattggagtaagctggcagacaccactttaaccacgtgatcaggttgccagaatcaatattgggacaatccatatcatatgctggcctttatgatgtaacgagaaagacgtgtggcgctcctgccatatatgtctaacttacatagaatcatgagaaaacaatcagctaagccccaaatgaaggacaccctacaatatcattagcccgaactagcaggcgtgatgtagcccaaactacaaggcatgatgctgaaatggacctttcattaggagaaaaatcctataaaaggcattattagaaaaattggtgaagttcatttaaactctgtaacctagatattgtcatcaatgcaaattttcttattttgataactatatttattcttaggaaccataatgaattatttaggagtaagacataaagtctgcaacttattctcaaatggttcagaaaaaaaagttacatgtgtgcttatttgtgtgtatatatgtgtgtatagagagagagggagcaagaaagggagagataacatgataaatcagatggtaaaatgttaacaactaaggaatttgagtgaaggagtaaagggtaaatgtgaatttcttgtactatccttgtaacatttcttttttctttttctttttctattttgagatggagtctcactctatcacccagcctggagtgcagtggcgcgatctcagctcaacacaacctctgcctcctgggttcaagccattctcctgcctcagcctctggagtagctgggattacaggtgtgtgacaccatgcccggctaacttttgtattttgagtagagatggggtttcaccatgttggccaggctggttttgaactcctgaccttgtgatccactcgcctcggcctcccaaagtgctgggattgcaggtgtgagccaccgcgcccggccccttgtaacatttctatgtttgaagtcacctcaacatagaaagttcagaattttttttctaatcatacatcacagactgcctggatgggagcatatgtgtatacacacacacacacacacacacagagagagagagagagagagaggagtttcaggtaattttcatgctggaacaatgaattccaacttggtgatgctatgccaagtaaacagtaatgtctgaaacttttgaacacagatttcaaaccaattagctccaaacctatgtacacataaattcaaataataacatcaccatctttgagtacttataatatacttggcactgttttaaatgcctaaaatgaattatcttagtccttacaagaccattatgaggtatcctctgacatgagatagttgatatgattttcctaattccacaatagaagaagcagaagcacttgctgaggcatctcagataatgtgttgaaggtcatgttgccagaaaggggtgtggtgggatttgaacccaggtggcctgacactgtgcctgtgatctttaacttaaactaagcacatggtgccctaatagttttgaagtggggtgagacacgtaaacccatatcctttgcgatctgctacaggggccaggtaagaaacctgttccttgaatgccccaggctgtatctggcccacaggacctcatcatgcatgctgttcctctgtctggacaactcttcacacaccttcaactcagttaactgccactcacttttcacatctgaacttactggtcagtcacttggggagactgtaccccctaaacaagattatagtttcctgccacatgccgtcagagcccactgaattctgcctgtcacacaacatattcatcacagtcgaagattatttacttgtctgcctcccccagcagactgtgaattctctgaaatcagggttcatgcttgccttgctcagccctgaagccccagatccccactgcacagaagtgtgaggcccacagatctgagaggtgaaatcagggagttagtatgggaatactggggtatataggagtaattcatcaacatcctttttctattaattcaagtcaggctaaaacggatgaaaaggatttacgttttcctggaatggaaaatgatagaggataagattaattagcctgaatgaatcaagatcgcattcactattagggaagggtaagcgagaacagactgtgagggcaagatgtttatgggaaatgttttcttattcttaaaaacaaaaacaaaaacaaaaaaactgcactaaagggaaaaccagcgactcttattctgttggaccctattgtgcctggatatggtatctgaaactgttactatagatgaaagtatcataagtgagatatcaaccagatgccaaggactttcttcctgtgccatatggagaaaagaatccgctgcctgctgacttctgatcctcctcccagattctcatccgtgccttttggtgtccgcaaaagattcaaaactacacagagctatgtttgttcctacgaagttccactggagggcgcaatatcattactgttaccagctaatagaacgtaacctgttagggctaacatgaataatttacagcgcatttttataagctctcttagtataggccacccaagagagaaaacagttttgtgccttagatgaaaggacaacacaggaaattataacaatggtaacaatccttttcttcatcatcccccaggagtcctggttgcttcctctgcaaatcagtgatggcttatacaaagaacagtattaaagactccgcggctggacgcggtgggtcgcgcctgtaatcccagcactttgggagaccgaggtgagtggatcgcctgaggtcaggagttcaagaccagcctggccaacatggtgaaaccccgactctgctaaaaatacaaaaaattaccccggggcgtggtggcagacaactgtaatcccagctactcgagaggctgaggcaggagaatagcttgaacccaggaggcggaggttgcactgagccgagatcacgccactgcactccagcctgggcaacaagaacaaaactccatctcaataaataaataaataaataaagattctgctaacctgtggcgggtctgtttgggtccctgtgtattctttcctaggaaaagcatgaggattagggttgggccatagggtctcattcctccaagagtaatggaacaccagctgcagcagctccagtctgtagcaagggttcagaacttgtccatgacaaggtctcaaaacccatctttcaagaaaagccaggcttggcccgtggctctgcctgcccatacattattatcatctgccaaatacaatatagtagttgatcaggggacaacttccaggaaaacacagctgcaagtctctctgatatttcatggttcttcaccactagagagtcccagaggtgaaagctctgaggcaggcttccccactttccaggtaactgctatttctgggaacttttagtataccccacctagtgtacaggaacacaaagggaagctgctactttgagcaaagcatccctgtgtgtgggcctctgatgtagctgtcgctttctaatatgtctggtgtgattacgtgtattcattattctactttacaataaccagtataaaacagtatgctttcttttgcttcactctgaccttggacaagtcactcaccctctttgagtcagctttcttattttatagtgcgtggaaatgtcacctatctcacagtctactggaatttgccacagtacctacacatttgtaatagtcatatttttttctttcaacaatatatttcaggtatcaactgtatgcaagacattattctatgcacttgagatacagcagcaaacaagaaagacaagatccccatgcccatgtagcatacattctaaggggcagaaagacagacacagtttaaatatatatatatatttcagacattgataaatgttatgcagaaagtgaagtcagatagcgggatagaatgtgagaaggcatgaaaggagctgcttgagatagaatgtcctttaaagacctgtccaaagatgtgacactgaatgataaggatccagtatgtgaaaacttgggagatccatgtttcagcaagcataatggtcctgaagtgatttgattggcatgttttagggactaaaagaatttcaggctggctggagaatgttggatgagaggaagacttgtaggagatgaagttggaaaggtaatgagtggccagttcacatagtagtgtgaagacatttgaattgtatttcattttcagtgcattgaggaatcactggaagagtttgaaacaacagaaggatgtgatttgactttcattctaagaatctcatgaatggatgaaaatgaaggatcaaaactattttctgaaaatactaaaacaggattggccatttccattgttgttatttgcactaatggtacaaaagcaatgatgggtaaaaccgctagggtcagcacaaatcaaggcagtggcatcaaactacaccacactactgtactagttgtcgaattcctcattgccacatgaaaagaaacatacacacacaccccatacatgcatatatatgtagtcaaatctcaacccttgagtacacatctttttaatattcttgaggatgaacaaaaaagtgaaaatgtactggtaaagaccttctgttcagtaccaaagccagatgattgtctcaaggaaaagaaattgtgtgattatttgagttgctagcttaaccaggggtccccagctcccaggtgggggactggtactggtatgtggcttattaggaactgggccacacagcaggaggtgagtggagggcaagcaagtattatggctgagctcagcctcctgtcaggtcagcagctatgttacattctcataggagcaagaatcttattgctaactgagcatgtgagggacttaggttgcgtgctccttatgagaatctaatgcctgatgataggaagtggaagagtttcatccagacaccatcctcccctcacaaccccatccatggaaaaattgtgttccatgaaaccagtccctggtgccaaaaaggttagggaccgctgagcctaactagctgggattttctcctgtgaattacatttttcttgaaaggaccactgacagacaagctgtggttattcagacgtgggtatgtgaaagatgtcttgaagataaacaaagggagctttgtttcaacaaaaacgacttacagcatttactgccaatgataaaactggactcgaacaaaaattagaatttttggaaaacatgaatctgccatcataagcttgatatctgcacaatacttagagactattcggataatatcagggctattgtcaatgaatgtgactttaaattagtttgtataattctttttaattgattttttattgtggaaaaatatacataacatacagtttcccattttaaccatgttaagtgtagaattcagtggcattacctacacttctcttgttgtacaccatcatctctatccatacccagaatattttatcaaaccacactgaagctctgttcccattaacctataactccccattaccccagctcctggtagaacagaatcataaagatagactatatcatagagatggggggaggagccaagatggccaaataggaagagctctggtctacagctcccagtgtgagccatgcagaagacgggtgatttctgcatttccatctgaggtaccgggttcatctcactagggagtgccagacagtgggcgcaggtcagtgggtgcgtgcaccctacgcgagccgaagcagggcgaggcagtgtctcactcgggaagcgcaaggggtcagggagttccctttcctagtcaaagaaaggggtgagagatggcacctggaaaatcgggtcactcccaccccaatactgcgcttttccaacgggcttaaaaaacgcgcaccaggagattatatcccgcacctggcttggagggtcctacgcccacggagtctcgctgattgctagcacagcagtctgagatcaaactgcaaggcggcagcgaggctgggggaggggtgcccgcaattgcccaggcttgtttaggtaaacaaagcagccagaagctcgaactgggtggagcccaccacaactcaaggaggtctgcctgcctctgtaggctccacctctgggggcagggcacagacaaaaaaaaagacagcagtaacctctgcagacttaaatgtccctgtctgacagctttgaagagagcagtggttctcccagcacgcagctggagatctgagaacggacagactgcctcctcaagtgggtccctgacccctgacccccgagcagcctaactgggaggcaacccccagcaggggcagactgacacctcacacggccgggtactccaacagacctgcagctgagggtcctgtctgttagaaggaaaactaacaaacagaaaggacatccacaccaaaaacccatctgtacatcaccatcatcaaagaccaaaagtagatgaaaccacaaagatggggaaaaaacagagcagaaaaactggaaactctaaaaagcagagtgcctctcctcctccaaaggaacgcagttcctcaccagcaacggaacaaagctggatggagaatgactttgacgagctgagagaagaaggcttcagacgatcagattactccaagctaccagaggacattcaaaacaaaggcaaagaagttgaaaactttgaaaaaaatttagaagaatgtataactagaataaccaatacagagaagtgcttaaaggagctgatggagctgaaaaccaaggcccgagaactacgtgaagaacgcagaagcctcaggagccgatgtgatcaactggaagaaagggtatcagcgatggaagatgaagtgaatgaaatgaagcgagaagggaagtttagagaaaaaagaataaaaaacgaacaaagcctccaagaaatatgggactatgtgaaaagaccaaatctatgtctgattggagtacctgaaagtgacggggagaatggaaccaagttggaaaacactctgcaggatattatccaggagaacttccccaatctagcaaggcaggccaacattcaaattcaggaaatacagagaacaccacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatctctcagcagaaactctacaagccagaagagagtgggggccaatattcaacattcttaaagaaaagaattctcaacccagaatttcatatccagccaaagtaagcttcataagtgaaggagaaataaaatcctttacagacaagcaaatgctgagagattttgtcaccaccaggcctgccctaaaagagctcctgaaggaagcactaaacatggaaaggaacaactggtaccagctgctgcaaaatcatgccaaaatgtaaagaccatcgagactaggaagaaactgcatgaaataatgagcaaaataaccagctaacatcaaaatgacaggaccaaattcacacataacaatattaactttaaatgtaaatggactaaatgctccaattaaaacacacagactggaaaattggataaagagtcaagacccatcagtgtgctgtattcaggaggcccatctcacgtgcagagacacacagaggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggattaattcaacaagaagacctaactatcctaaatatatatgcacccaatacagaagcacccagattcataaagcaagtcctgagtgacctacaaagagacttagactcccacacattaataatgggagactttaacaccccactgtcaaaattagacagatcaatgagacagaaagtcaacaaggatacccaggaattgatctcagctgtgcaccaagcggacctaatagacatctacagaactctccaccccaaatcaacagaatacacatttttttcagcactacaccacgcctattccaaaattgaccacatagttggaagtaaaacacacctcagcaaatgtaaaagaacagaaattataacaaactgtctctcagaccacagtgcaatcaaactagaactcaggattaagaatctcactcaaaaccactcaactacatggaaactgaacaacctgctcctgaatgactactaggcacataacgaaatgaaggcagaaataaagatgttctttgaaaccaatgagaacaaagacacaacataccagaatctctgggacgtattcaaagcagtgtgtagagggaaacatatagcaccaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaactttcaaaaaattaatgaatcctggagctggttttttgaaagaatcaacaaaattgatagaccactagcaagactaataaagaaaaaaagagagaagaatcaaatagacacattaaaaaatgataaaggggatatcaccaccgatcccacagaaatacaaactaccatcagagaatactacaaacacccctatgcaaataaactagaaaatctcgaagaaatggagaaattcctcgacacatacactctcccaagactaaaccaggaagaagttgaatctctgaatagaccaataacaggagctgaaattgaggcaataatcaatagcttaccaaacaaaaagagtccaggaccagatggattcacagccgaattctaccagaggtacaaggaggaactggtaccattccttctgaaactattccaatcaatagaaaaagagggaatcctccctaactcattttatgaggccggcatcatcctgataccaaagctaggcagagacacgaccaaaaaagagaattttagaccaatatccttgatgaacattgatgcaaaaatcctcaataaaatactggcaaaccagcaacacatcaaagagcttatccaccatgatcaagtgggtttcatccctgggatgcaaggctggttcaatatacacaaatcaataaatgtaatccagcatataaacagaaccaaagacaaaaatcacatgactatctcaatagatgcagaaaaggcctttgacaaaattcaacaacgcttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacaacatgattgtatatctagaaaaccccattgtctcagcccaaaatctccttaagctgataagcaactacagcaaagtctcaggatacaaaatcaatgtacaaaaatcacaagcattcttatacaccaacaacagacaaacagagagccaaatcatgagtgaactccattcacaatttcatcaaagagaataaaatacctaggaatccaacttacaagggatgtgaaggacctcttcaaggagaactactaaccactgctcgaggaaataaaagaggatacaaacaaatggaagaacattccatgctcatgggtaggaggaatcaatatcgtgaaagtggccatactgcccaaggtaacttacagattcaatgccatccccatcaagctaccaatgactttcttcacagaattggaaaaaactaaaattcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaatctgagaaaaacaagcaatggggaaaggattccctatttaataaatggtgctgggaaaactggctagccatatgtagaaagctgaaactggatcccttccttacaccttatacaaaaatcaattcaagatggattaaagccttaaacgttagacctgaaaccataaaaaccctagaagaaaacctaggcattaccattcaggacataggcatgggcaaggacttcatgtctaaaacaccaagagcaatggcaacaaaagccaaaattgacaaatgggatctaattcaactaaagagcttctgcacagcaaaagaaactaccatcagagtgaacaggcaacctacaaaatgggagaaaattttcccaacctactcatctgacaaacggctaatatccagaatctacaatgaactccaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccataatgagataccatctcacaccagttagaatggcaatcattaaaaagtcaggaaacaggtgctggagaggatgtggagaaataggaacacttttacactgttggtgggactggaaactagttcaaccattgtggaagtcagtgtggcgattcctcagggatctagaactagaaataccatttgacccagccatcccattactgggtatatacccaaaggactataaatcatgctgctataaagacacatgcaagtgtatgtttattgcggcattattcacaatagcaaagacttggaaccaacccaaatgtccaacaatgatagactggattaagaaaatgtggcacatatacaccatggaatactatgcagccataaaaaatgatgagttcatgttctttgtagggacatggatgaaattggaaatcatcattctcagtaaactatcgcaagaacagaaaaccaaacaccgcatattctcactcataggtgggaattgaacaatgagaacatatggacacaggaaggggaacatcacactctggggcctgttgtggggtgggggaggggggagggatagcattgggagatatatctaatgctaaatgacgagttagtgggtgcagcgcaccagcatggcacatgtatacatatgtaactaaccttcacattgtgcacatgtaccctaaaacttaaagtataataataataaataaaaaaagaatatatcatagagatatattctatctctatgaatttgattgttctaggtgcctcatataaggtaaatcattctatttttttgtgactactttattttattatgttttcaaggttcattcatgttgtagtatgcatcagaatttcgttccttcctaaggcagaataatattctattgtatgtataaactacatttgatttgatttttattctaagaatctcatgggtggataaaaataaagagatctatctggtcaaatgtattttcttaaaatactaaaacattattgcgcatttccattgtgttgtcatttgcgttgatgcaaaagcagtggtgagtaaaatcattttgtttattcattcatccatccacagacattaggattgtttctaccttttggctattgtgaaaaatgctgctatgaacattggtatacaaagatttttacaagtctgtgttttcaattctttgcggtatatgcccagagctgcaacatggtaattctatgtttaaatgtttgaggaaccaccataatattttccatagcaactgcaccattttatattcccaacagcaatgaggcactgttacaaagtagccacttccttaccaacactccgtattttccctttttgtttttgataatagccatcctaatgagtatgaagtgatatctcattgtgattttgatttgcacttccctaatgactagtgatgttgagtatcttttcatgtattttttttttggtgtagcttctttggagaagtgtctattcaagcacttcgcttatttttgactgagttatttgttgttgttgactataagagtattttatgtagtctggatattaatctcttatctgatatatgatttacaaatattctcccctattttatgggttttgttttcattctcttgatagtattcgttttttgttttttttgttgttgttgttgttgttgttgttgttgttttagacagagtcttgctctggtgcccaggctggagcacagtggcacgatcttggctcactgcaacttccacctcccaggttcaagcgattctcctgcctcagcctcccgagtagctgggattacaggcatgtaccacaatgcctggctaatttttgtatttttagtagagatggggtttcaccatgttggctaggctggtctcaaactcctgacctgaagtgatccacccgcctcagcctcccaaagtgctggaattacaggcatgagccactgtgcctggcttcttgatagtatttgtgatgtgcaaaagtttataattttgatgaagtccaatatatctattttttcctttgttgcctgtgctcttagtatcatatctaagacatcactgccaaatttattgtcatgaagtttttctcctatgttttcttctacaagttttatagttttagcacttaacatttagatctttgatccattttgaattttgtctaatgttaggttttgtctgattaatgtaattttgtccaatatcaatattacctctcctactctcttttgcttattattcttgcttattatttttatggaatatcttttgtgatcatttcacttctaaactatgcatgccctaggtttaaagtgagtttctggtagacagtatatagttagatcctggtttttttttcctttgtattcaatttttaagtttttgttttatggtgtttggtttgtttgttttttgagacagggtcccgttggctctgtcacccaggccagatggcgcaatcgcggctcactgcaacctccacccacctcgccccctccccggagtcaagtaatcctcccacctaagcctcctgagtagctgggactacaggtgcgtgccaccatgcctggctaatttttttttctttttttagagatggggatttgccatgttgccccagatggtctcgaactcctagactcaagcgatcccctgtccttagcctcccaaagtgctgggattacaggcgtgagccactgggtccggctgttttacgggttttttaatttcagtttttcttttagatacagagagtacatgcacaagtttgttatatgggtatattgcacctagctagtgagtatagtacccaaataagtagtttttcaactcacagtcttcctctagccttctccctctagtagtctgtggtgtctgcttttctcacatttatgtccatgtgtgctcaatgtttagctcttacttatgagaacatgcagtatttgggtttctgttcctgcattaaggtgcttaggattacggcctccagctccattcatgttgctgcaaagtacatgaaacatgatttcactctttttatggctgtgtagtatttcatggtgtatatgcaccatattttctttgtttggtccaacattgatgggccccagagttgattctgcgtctttgctattgtgaacagcacagcgatgaacacatgagggcatgtgacttttttctataatgatctattttcctttggatattatattagtctgttcttgcattgctataaagaaatacccaagactgggtaatttataacgaaaggagttttattttatttttctgtaggctgtacaagaagcataacactggcatctgcttctggggaggcctccagatcttacaagaagtcactcactatcttgagtacagtaccaagagggatggtaccaaaccattcataagagatccacccccatgatccaattacctcccatcaggctccacctccaacactgtggattacatttcaatatgagactttgatagggacacatccaaactatatcaggtatattcccagtaatgggattgatgagttgaaccgtaactctttttaaagttctttgagaatagatcctgttttttaatacatcctgccaatctaagtcttttccttgacaagtttgatccacttacattttaggtaattactgatagggaaagatttagtaattccatgtttacctgtttttgtatgtcttacagctttccggtttctcatttctgtccttactgcctttttgtgtgtttgattaattttttttgtagtgatgcattttgattcccttctgatttccatttgtgtatattttgtagatattttctttgtggttactaggggaattacatacaacatcctaaaactagagcagtctattttaaatttataacaattatttgaagtagaaatgtgttaaatcccaagaatttgccccctggagatgcagccttgtgatttttcacatttatttgcgctggctttggctgttaatggaaatgtttctcaatagtttatcaattcacattttctacccaatataagaaagactttatcttactatttttaaagtggtcaattagattttgaaatcactgccttacaggacagttcactgaaatggtaagagtgtagctactgtggttgaaaattctctggatgaattattaaaatcctaaccaggataggattcatttgtactgagtgctcattgtgtgccaatcgtggaagcatagaaaatatgttgatggtggccatctcagtattgattcaattatttctgaagagatacatgtttaaaaaaaattttttttgagatggagtcttgctctgtcacccaggctggagtacaattgtgtgatctctgctcactgcaacctccacctcctgggctcaagtgattctcctgcctcagcctcccaagtatctgggattacaggcacgcgctaccacacccagctaatttttttgtatttttagtagaaatgggatttcaccgtgttggccaggctggtctcgaactcctgacctcaggtaatccatgcgtcttggcctcccaaagtcctgggattacaggtgtaagccactgtccccggctatggttaaactttatgttaacaggatttccattaaactgtctgacacatacatattgttcaaatatagttattgaacagataattttatgcaggatttgcttattcagtcagcatttatgaaacatataatatgtgtctgaaactgtcctgggcacacaggattcacaaatacattagacaggtttattgcttttcataggcttgtagtccaaaggcaagttcagccatctaaacacatataatgtataatcttctattaaggtctgaatagaaatctttccttcatgttcgctctagcttccaggatatcatacatgttgttcctattccttcttctaggacaattcttaccctttctcttaaacagataactctttctgagtccttctgaggatacaacttacaaatcactacctccatgaagcttcagaatcttccccactaccaaaccatcatcctgtcaactgtcaggagatcccaaattcccctatcataataaacatttatatcacagcttgttgcagtttcttgtgttactttatgttgcttccaatagacagtgagctccagaacattctcactatctaccttactcattgtcttactacttatctcagaccttagtacagtacctgacataacaggtgtgaggaaagatactaccatagctagatgtttcaggccatagaatgggaaataaaatagagccaaaataatctgccaacatcatctaatcttagatgagaaggcacagctaaagattttgcacttttactgaatggaatatattttaatacctttattgagatataattcacatactgtaaacttcacatgtttaagttgtcaatttgagaagttttgaagcttgcatgcatctgtgaaaacaccaaaataaaggtaataaagacatctatcatcaccaagagtttccttatggttctttgtagtctatacccctcacctctatttctagcctgctctgatcccagccccagataatcacttatgggctctttgtttgtataaattggttggcattttctagaatttcatataaatggaatcaaacagtgtgtcctcttttatctggcatcttttcctcaccataattattgtaatgatgttgttccacataacaaaaattcactcattttatttttgagtagtatttaattgtgcagatgtactacatttccctcatctgttgatgtttctagtttgcagctactaaaataaagctggtatgagtatttaaatgtacatgttcgttcacatggtaaataggtactttcattactcttggctaaatacccagagttgtaaagtctggattatatgataggtattggtataacttttttaaaaactgccaaaccttttaccaaagtggttgtaacattttataattcacaaacaatgtttgagagctcctgtttcttcacatcctcaggaacacttgatgtggtcaggatttgtagtttgagatactctaataaatgtagaatggtatgtctttgtgttggaatttccattttcctaatgactaatgatgttgagcattttatgtgctcatttgccattcatatatcttcttaagtaaagcatctgttcattttttcccatttaaaaaattggattgcttgttctcttattattgagttttgatagtttcttatgtatactagatacaagtcctttattaggtatgtgattttctaatacttcctctagttctgtggcttaccctttctttcatttaatgatgtcttttgaaggacagaagttcttagttttaatgaattccaatttgtcacttttcttttatcaagttttttgagtttcatataagaaattgttgcctactgtatggtcacaaagatttttccatattttcttctagaagtgtacagctttgcattttacatttacatgtgtgatccaattaatttttatatagcatgtgctgcatgggtatagacagcaggttcttccagcactagttattgaagagatatcctttttgcactgaattacctttgcacctttgttgaaatacaattggacatacatgtgtggtctattgctgatgtctattctattcattttttgcctatatttttgcccatattggtaccattactatactatctttattagtgtagctttctactgtaaattgtccaaatttgttctttttaaaagtcattttggctattttgcatcctttgtaatttcatttgaaatttagaattagctacaaaatagtctgttggagtatttatttaatctgtgtttcagatcagttcagggattaacaaaatcgagtcttccacataaatatgacgtaactatccatttatttagatcatcctcaaaaatatctcagtacaattttcagtgtatagattttgccaccttttgtgagatttatccctaagtatttcatgtttttaatgttatcatgctggtatttttatttaaatatcaaattgtttgttagtaatatatagaacggcaagtgatttttatagatatagcaagggggttttttgcagattctataggattattttatagagatgatcacatcttcatagacaaaagagacagttttacttaccgctttccaagtttttcttctgacccttttattaacattttttcttgtattattgcactagttagattaagcggtggacaacatatttgcccacttttttttcattttaagaggtaagtactcagtcttcatcactacatttcaagttacctgtaggtttttcatagatgccatttccttatcaagttgaggaagattgcttctgtttctagtttggtaagagttttaccaggaatgaatgctggatttgccaaatgatgtttctgcgtctattaaaatgactattttacaaatctgttaatattgtgaattacattgatttgtttttctaaggttaaactacctttgcattctttggtcatgatgcattatccttttccccaggtaatactggcttcgtacaatgagtcaggaaatattccatttctttaattttctggaaaaaaaattctgtgggtggcattatttcttccttatatgattagtagaatccacaagtaaatccatctgggcctttaattttctttgtggaagttttaaagtagaagcttaatgtattgaagagtgttttaatcacctcctatttatcccattagtgagggagggattcctgcctaggtttaggcaaatggctggcgtatgacacgacaccggacacatgagactgttagcaatttattagtaatgtatactcacaacctgagagaggaggataccatgcaccatacagtgacatatgaagtgttgcactcagaaataaagtggaaaaccagggcctgtgaaaggcagagtttgtagtattgttaaagtgccccaggttcacatgggaggatgtgattggcttgtttcagtaattctatagcctgacagagaactaagacctgctactcagagacgagcaggaactgcatctgttctgctcaataaggaggattgcttgcctagggaaccttatccatgggagcagagagggaagggaacttgtggatttaccattcaagatccttccaatttcaccacgtatcaaggtaatacacaatattggaccttaattttaggcctcacaccacaaatggatacagagctagtcagattatctatttcttctcaactagctgttgtctttcaatgaatttctctactttattcaagttattaaatgtgttgacatatagtttttttaaataatgtttccctatttttttttttttttttgagacagagtctcacactgtcgcctgggctggagtgcaatggcgtaatctcagctcgctgcaacctctgcctcctgggttcaagtgattctcctgcctcagcctcccaagtagctgggattacaggcgcccgccaccatgcccagataattttttgtatttttagtagagacggggtttcaccatgttggtcaggctggtctcaaactcctgacctcgtgatcctcccgcctcggcctcccaaagtgctgggattacaggcgtgaaccaccgtgcccggcctctattttttaatatctgtagaatctatggtgatatcacacttctcattcctgatcttgataatttttgtcttctctcttactttcctgatcaatctggctaaagatgaatcaatatttttatcttctcaaaaacctagcttttggttaaatggttttctctattgtttttctattatttcattgatttcttatctgacttttgctattttttattctccttaagctgagttttatttgattttttttttttttttgatatgaagtctcactctgttgcccaggctggagtgcagtggtgtgctctcggctcattgcaacctccacctcctgggttcaagcacttctcctgcctcagcctcccgagtagctgggattacaggcgcctgccaccatgcctggctaatttttgtatttttagtagagacgggatttcaccatgttggccaggctagtctcgaactcctgacctcaagtgatctgcctgcctcagcctcccaaagtgctgggattacaggcatcagccaccgcacccagcctttatttgacctttatattgcttcttaagatggaacttgatgttattagtttgagattttgtttaaataacatcgagtgctgtaaattctaatctaagtactgctctagctgcatcccagaaatgtaaacatgttttggataaattgttattcatttcaagataatttatgattatccttttgatttgttcttgtggctcatgggttacttagaagtatgatgtttagttttcaatgtaaattttcagaatatctttttgttattgatttctaattcaattccatttcagtcagagaatatactttctgctatttcaaaactttttaatttattgagacttgtttatggcctattatttaaacattccatatatgcttgagaataacgtgtattctgtagttgtttggttcagcattgtaaaaatgtcaataggttagtttggttgaacctgttgttcaagtcttctatatccttactgaatttctttgcacttgttctatcagtttttttgagaggaggtgttgacatctctattattattgtggacgtgtctatgattacggtataatcaattagtcagttctttatgtattttgagttctgttaataagtacatatttagaattattatatccccttgaagaattgagctctttatcatgatgaaatgactctccttatcccagataatattcattgctctgacatctactttgtttgaaattaatatagtcactccagcattattttgatgactgattgcatgatatacattttccatcctattacttttaaccttttatatcatttataaattaagtggatttatgtaggcatcatattgtatttccttttttttaatcttatgacaatcccagtcttttaattgggatatttatatcatttaatatgtaatgctattgatacgctttggtttaagtcacccatcttgctactggttttctgttgttcgcatctactctttgtattatactcctttcttattttttaatttgtacaaatatgtacaaaatagtcttatatatttatgggatacatgagatattttgatatgggcatgcaatgcatgatcatcacatagtgggaaatggggtgtccaacccctcaagcatttaccctttgtgttacaaacaatccttttatactcttttaactatttttaaatgtacaattaaattattattgactatagtcaccctcttgtgctatcaaatactaggtcttattcattcttcctaactacttttttgtacccactaacaattgccacctccccatgccaccctactaccattcacagtctctggtagccatccttctactctctgtctccatgaggtcaattgttttgattttcagatcccacaaataagtgaggacatatgttgtttgtctttctatgcctgatttatttcatttaataaaatgacctctagttccattcatgttgtttcaaatgacagaatctcattctcttttatggctgaatagtagttcattgtgtatacgtactccattttctttatcttttcgtctgttgatggacactaaggttgcttccaaatcctggctattgtgaacagtgcttcaacaaagtaggagtgcagataatcactttgatatattgatatcttatcttttgggtatatatccagcagtgggattgctggttcataaggtagctctatttttagttttttgaggaacctccaaactattctccatagtggctgtactaatgtatattccaaccaacagtgtacaagggttccctttgctctacatccttgccagcatccattatttcctgtgttttgaataaaagccactttaactagggtgagatgatatctcattgtggttttgatttgcatttctctgatgatcagtgatgttgagcaccttttcctatgcctgtttgccatttgcatgtcttcttttgagaaatgtctattcagatcatttgtccatttttagattagatttttttcctacagatctgtttgagctcattatatattctggttattaatccattgtcagatgggtaatttgcaaatattatctcctattccattctgtgggttggctcttcactttgttgattgttttcattgctgtacagaagctttctaacttgatatcatcccatttgttcatttttgctttggttgtctgtgcttattgggtattattcaagaaatttttgcccagagaaatgtcctggagagtttccccaatgttttcttgtagtactttcatagtttgaggttttagatttaagcgtttaatccattttgattatatttttgtatatggcaagagatagtggtctggtgtcactcttctgcatgtgaatatccagttttccctgcaccacttatggaagagactgtcttttccccagtgtatgttcttggcatgttttttgaaaatgagtgccctgtagctgtgtggattgattctgggttctctgtaccaaagaagaacaaagttggagaactaacactatcctacttcaagacttatataaagatacaataaccaagacagtgtgttactggcaaaagaatagaaaaatagatcaatggaacagagtagagagcccacaaatagacccaccctaatatagtcaactcgtctttcacaaaggaggaaaggcaattcaatggggaaattatgatcttttcaacaaatggtgctcaaaactgcacatccacctggggaaaaaatgaacctatacacagacattatgcctttcacaaaaattagctccaaatggatagtagacataaatataaaatgcaaacctataaaactcttagaagatagcatagaagaaaatttaggtgaccttggcttggtgatgacttagatacaacacaaaaacacagttcataaaagggaaaattgctaagctggacttcattaaaattaaaatgctctgttctgtaaaaaaagatgctgttaagataatgaaaacacaagtcaaagactgggaatatatttttgcaatatagtatcaaagggctagcataaaaaatatacaaagaattcttaaaactcaacaataagaaaataacaacatgattggaaaattgtcaaaagatctggaaaggctacatactgtatgattccaactatatgacattctggaaagagcaaaactgtagagacagtgaaaagaccagtgctttcaaaggattcccagggtgggaagaagggatgaattggtggaatgtaggtaatttttagggcagtgaaattgttatttcatgcgatagtgtaaaggtgaacaaatatcctacttttgtcaaaagccatagaagatacaacacaaagagtcaactctaatgtaaactatagactttagttaacaataatgtgttaatattgattcatcaagtgtaccatattaatgtaagttattaaaaataagggaaattgggtgagggtagagatatataggaattctgtgtactttttctcatttttctctgtacacctaaaacttctccaaaaaattaaatctattacttttaaaaaatatatgaagtcatggactgggaatataaaacaataatttccaagatattggacatgaagcaatgaaagagagtaatctgaggagatgagaaacaaattgagtgacatgtatttaaaaattctattaaacatgctcaatctctccctcaagcttcccgaacatatggaatagtgataataaccattttaatatccttgtctagtaattctaccatttgtgtcattctcaatttgtttccattgaatgcattttctctgcattaacagttgtattttcctgcttgcttttatagataagaaccattttatagataagaaaaccgagatcccaaatggtttattgacttgtttgacattgggctccccatctgtgtgctcctgcgggatcctgtactttgcctacctgtgcccctgtcacgtagtgttgaatggaaaaagctatctctgtttctcacacaatacattgagagatgttaagatctagagaaaataggaacttaatagaaccaagaggcctatattcttctctcctcctacctttttgtagctatgagaccttatcttctcatattgaccagatattgttaattctgattagttgaataataactatttttatatgtctgtagttttcctttttgttctcagatgtgattaagaaatttagaaactattaatattttataatttcaggttttatttttatgctggattagatatgagcagagtgatgttcactctgggaataattttcttccattcccaaagcaaagccttttgagtacattgcttgatgctctgtgaattgtgagcttttccactgtagctggtgggagtcacattccccaccctgtgtgagcttaattctatttaaccctttcagatggctttttccctaacctctagtagtcttatatgcaaacctctgtaccacttacttaaatactcaaagggaaatctctacaaaggtccaaagttctcgctctgtgcagctctctcctctctaacactctgccttgaaaactagagccaccttgactcccctacaatgtactccgcacagggagaccaccaagctctgcctgggttaccctttcctacagtaaactgaggcagtcatgttactcaatttgtttttgtttctcacctcttcagattactctttcactgctttatgttcaatatcttagaagttttcgtttcatgtatgctgcctagtttatttcattgcttcagggggaaaggtaaatctggtagccttttctgcatctttaccagaaatagaatctcatgaaacataatttttaatatcccatatttagcacgatcctattcagactaagaaaaagaaaatgggaaagagaatcttcatcaaagattttctagaaaagatttttgaatacccaagaagttatactaagttaagacggtcactctttttctattggacactgttgtacttgcatgtgatcctgaaacactttttgtagacatgctaatcctaactgggatatctctctgatgctgacagcaagctctcagggccttctacaggcaggaatctgccaccttgtaatgatgagggtttatctcagagaccatgttgtcataatttggctttccccagtgggtaccttcaactccttcgggctgttgacagttcctccaatgtccactcgtgggtgtgaagtcaatgttggttacatcttttacagcctgacccatgagaatagatttcattcacttcaaatctattattataagtgagagacaggaatgacatcaaccccccaccccaacctcacacctcatgcttgttccccgtgcttcctacatttggaagagcatgaagactgcgatagtgtctcagagccaagtctgagaaactgtgaaggaatctcgaaacttgtgccattcagagaaaaaccttgatctcctggtcacgatgggggaggggaaagatattggggtaactcactgacagatttactgctgagacccaagcagaaccaataaggtctagattttttttggtccaaatatctgggtataataacataagttacattagtaacaatatgtgacatttgatgacaatttgacacatcagggcatggagctctgtattcttccagcacttcacttaaaatactcaataaattaaaagatatgtagttctataaccattttatagataaggaaaccgagaccccaaatggtttattgacttgtttgacaatggactccccatctgtgtgctcctgctggatcctgtactttgcctacctgtgccccgtcacgtagtgttgaatggaaaaagctatctctgtttctcacacagtatattgggagatgttaggatctagagaaaataggaacttaatagaaccaagaggcctatattcttctctcctcctacctttttgtagctatgagaccttatcttctgaattgcttttttacttagttttaatgtcaaggaaacgtgggggacggctcctgagatagtggttctcaaagtactgcctacacctcaagctgtgtacagttgagacaaaagctgcctttgaatttttgctctaacagcaacagtaaaaataaaaagagctcacatgcagtattattttttaaaggtgcattgcctcatttaagcctcacagagacaatgagtgcacgtttttaaacacgttacaaattcagataacaataagtgacagatttgaggcacaaatcaaagtaaatgaatgtcagttcaaagcctctttcttcaaaataagtgtttcccaaactgaaatgtgaggatcatagtaattctgtaaatttaaacccgggataaagtataaagtttatttttaaaaagcatgttggtaccctgttgtagtagtttcagtcatcttgaggctctctagatagctatgccttcagatataaaatgtaatttgctttaaaaactattttttaaaatggctgacttctccctagatttggcaaaacaaaacaaaacaaaacatataagtatagattcaaggaaataagtgaaccccaaatttggtaatccaaagtaatccatgctaaagcacatgatatttaaacttctgaaacctcaagacaaaaaaaaatcaagaaacaaagcacacaaatatgatacattacttataggggaacataaattctagtgacggcagatttctctttcaaagcatggaggaaagaaggaagtgacatgacatttgttcgtgttcttgaagaataagttgacaagtgcaaatttcgtatctggagatattatctttcagaaatgaaaggagaataacgacatactcagaacaagaaaaactaagataccgtgtcactggcagacctacacttaaagaatggctaaaagaagctcttaaaaaagaaagaaaggcataactgaaaaaagctggaaacataagaaaggaaaaaagaaaaaaatgaataaatggaaataggattaaataatataagctacacttctcttcatgagcttctttgatcatgcttgacggttcaagcaaaaattataacatttgttttagtgttcaatccgtgtcagaaagtacttgagacaattatatttttaaagctaggaaagtgtacagacctaaatggaactttctatacttcatgcaaaagcataaaatatcaatacctatagatggtggttaaatatatatatctagagtagttacttaaaaaaaaagattcaaagtgatatacctaaacgtattataaagaaatggaaggggaattctttttttttttttttttttttttttgagatggagtctggctctgttgcccaggctggagtgcagtggcgcgatctcggctcactactacaacctccacctcccgggttcaagcgattccggaaggggaattctaaaacgtttccaagtaactgcatctccaaaaaaaaaaaaaggtctgtaaaactcataaaccttgggtgagacttatgaagataaaaggagtaagacacaaattggtaatatcaagaatcaatactgggaggcacatcgctagagaacttcatgccaataaattgaaaatttagaagtggacaaaccaggcaagctggctcatgcctgtactcccaccactttgggaggccgaggctggtggatcatgaggtcaggagttcaagaccagcctggccaagatggtgaaactccgtttctactaaaaatacaaaaattagctgattagctgagtgtggtggcgggcacctgtaatcccatctactatggaggctgaggcaggagaatcacttgaaccctggaggcggaggatgcagtgagctgacatcatgccactgcactccagcctgagccacagagcaagattcgtctgaaaaaaaaagaaaagaaaagaaaaaaaaaaagaagtggacaaacagtaaaatacttaaaatactgaaaacttaaaatactgaaacctgagagaatacgttaaaacatgatttcatctgtaaatgcgaaataaatgcaatcagtaattaaatacttttgacaaaaaaatctctagttccagatggttcataaatgagttctgtcaatgcttaatgtgagagatcactccaatactgcacaactttttcagagaatagagctagcgagtacactaccccttgtgttttaccaagtgaaccttgacacagaaactagataaggataatttaagaatggcaaatttcaaagcaatctgtctcagaaacatacgtgaaaatatcacatgcaaggtacttgtttaaaaagctagcaatatctttttatttttagttttagtttttttttttttttttgagatggagtttccctcatgttacctaggctgaagtgcaatggcacgaacttggctcactgcaacctctgcctctcaggttcaagcaattctcttgcctcagcctcgcaagtagctgggattacaggcgtgcgccaccatgctgggttaatttttgtatttttagtagagaaggggtttcaccatgatggtcaggctagtctcaaactcctgacctcaggtgatttgccctccttggcctcccaaagtgctgggatcacaggcgagaggcgcctggcctctagcaattttattttaaaagatactataaaagtataaaaatttttgaaaaaaaagatagtacatgacgtgatttggatgtctgtgcccactgaagtctcatgttcaattctaatccattgtgtgaagatggggcctggtgggaggtgactggattgtggggaccgagttctcataaatggtgtagcaccatccccttggtgcttttctcctgatagtgagttatcaggagacctggtcctttaagtgtgtagcaccacctcctaatctgtcttcctcctgctccagccttgtatagaggtgcctgcttcctcttggccttgggacatgattgtaagttttctgaggcgtccccagaaacagaagcccctatgcttcttgtgcagcctgtaaaaccatgagccagttaaacctctttcttttataaattacccagtctcaggtatttctttatagcagtgtgagaacagactaatacgctatattatgaccaagttatatttattctagcaaagcaaggttggtttaacattagaaaagaaatgaatgtaattcaccacttgaacagattaaagggaagaactaaactaaatgtgaccacctcaatagatacaagaaaataatttggtaaaagtcatcattcattcatgatgaaacaacctgtggaaaagacggaatctatgagcctctccgagagagtttcagatgcagtgttgcagttgacagtctttggaggtatgtcacaacaccggaattcctactaggaagaggtaataagtttaagtgcatgaagactagaagaagatactgcaagctaaatccacctaaagtaaagataaaattcaagaagcaaagttgaaaagtgcttgccaatcatatcgcagacaaagggtggatttccctaataagtaaataccatcagtggattcattttttgaaaaaaggaactaagcctactctattgtcattgataacgctagctgctgtaacagatgaactccaacctcttagtggcctaacactatgaacatttttcttgcctacatttttccaaaaggaaacaggactggggagggttggctcttctttttgaaaacaatctaggaccaggctgacagaagctctgccatcttcaacacctggctctataagtcgctctgggtgtcaacatctttccagcagatggggaagaaagagtaggaggatctcataggaggtttttatgaatcatgcttgggagaattgccactcgggcccaccatccattgcccaggcctcagtccaccagccacagttacctgccaggaggctgggaaaccccaggaggaaaagaaaacaggtctggaggacagctagtcagtctctgtatatgtatgcctgaacagttcacagaaagaaaaacacaaaaagctcccaaatgtatataaaacttcccagcctcactcctaataagagaaatgggtttctgaagcacaataaaatactgtccaggatctatcctatggacagatatgcaaatgtttgaaacagactgatttggtgaggatatgggaagagtcacattcctgcattgttagtatgggtgtaacttgatgtaacacctagagaaggcaatttagcagtatctgtccacattgtgtgtgctttacccccctcctccagaaatcctgctgctatgaatttgtcctttggatgtacttgcacttgtatggaatgatataacatgttagtttactcgatgcggtattgtctgtaatagcctaagcctgggcaaacccctgtgtcaacagggcaccggctaaataaagaaaaggatatatccgtatcaaaggataccatgcaggcatggcatagagcagaatgcttttacctctgtggagctacactgcatgggtgcaaatcctggttcttccctcgtttagaagtattacctacggcaagtaatgtcaattgcatgtgctcttcactcctcatgcacaaaatgaggaaagcacctacttccctaggttttggtgaggatgagtttaattgatttgaagcatttacagcaatggcatagcaagcacgctataacttttgcctgtattaagcacagaaagtactccaggatacattctttttcttttctttcttttttttttttttttgacggagttttgctcttgttgcccaggatggagtgcaatggcacgatctcaggtcaccacaacctctgcctcccgggttcaagtgattctcctgcctcagcctcccgagtagctgggattgcaggcgtgtgccaccatgcaaggctaattttgtatttttagtagagacggggtttttccatgttggtcaggttggtctcgaactcccgacctcagatgatccacccacctcggactcccaaagtgctgggattacaggcatgagccaccgcactcagctccaggagacattctgagatggaaaaaatgccaggtcaacacagcgtttggtacacgccttaatacagaaagaggagtttggatgatgtatatgcctgaataccagtgatgttcctccagaagggtatctaaaagcctggtgggaaagaggagtggcctttgggaatgagttctggatggttcagcaatggaggtgagaagaatccgttgcctgcacatagtttagaaactttggaattttacaccaagtgtgcatgtatcacctattccatttcttaatctttgctaaaggaaagaacagaaaagaaaaaaaaaaataacaggctttggagctatgcaagcctgaatttgtgacccttctctactaagcaggtcaaacgatataaggagggacctcatataacaggagcatgtggggtccactgttcagaagcagcaaaatctcactttcttttctgactcaatctctgttttgacctctcaggatttttgtagttgtaatttaatgtggtgctgcctcagttaaggggacacgcatagggtgagtggagatcctcccaggtgtccagagccctgccctgtggcttggcattcccaccctgcccctccctgcacccacacccaggccttctcctgagggtgaagtgcagcagcagtcgctgggttggcagagggaaggggagtctgagagggtgggtgggtgattgggcagcagagaacctgtcccagtgaggcctggaggtggtggaagctggaccacatgatagctgaggctccaggaccccagcacacactgcaccgtttcatcacacctcacctaccaagcacaaattcaaggaaagaaatagttaagaatttcaagacagccacactaaaccgcaagcccagggacccattctgagcatggagccgtgtgggaccactttagttgcagtttcgtgaaactggccgtgctaccacatgttacttgtgtgcaatgacctaacttctctgtggcctcagtttcctcatcagtgatatagatattgaaaaaaccatatagggtttttgtaagactcaaataacatactacgtgctaagtacttagcaaagcatgtggcatggtataagtctcgacatgtcaagtaaaattattgtaagccggaaataaaattctaaggctcccaaccatctgagtgtttcataggtaaacgttgtagcattttcatttgcccttgttccaccttctccctgacctggtggcggcattgcacccagcagcctgcatcccacgtgtggaaccctggtacctggttccggaaggagagagcagagcttatgcaaaaatcatggttttcattggttctaacccgtccaggggcttcctgaaggacagaagcaaaatgctcctctctgtttgacctaacagggaagtcagggcagaaaaagcttgggcagctcctgaaaaccttataaggcaaatcaaaaaacggcaactgcgtgaggcagaaactacagttgaaacctatagcagataacccaaaacctgggggatacgctggcggacaggccatttgggaaattagatcattcggaagcagtcatgtaccctggggattgtcaaaagccaggtgcgtgcccaggattggatgcatgctcaggaaagacccgagaagaccctaagctttcaccggctgatctctggactcagtctaaacaggaagtgacagccaagacagagttgtaagtggcctggctgaggtttgaaggagtgctgcagcccagagcgaatccacaaaggctgacagaggaactttttgctttttttttttttattaagctctgggctgtcaaggaaattgctgtcaaaatacaagcagaaaacaaactaaaggaacagagagttcagtggccacatgtgacaacgaatgcaggctctcccaaaagagtttggaaaaccctctagacaaatcaatgactgcagctttcagaaatcagcaactgcaaatcctggagaaggtagaggatctaatattcagtgttaccacattaccacaatcaaagacctagttttcagcagcaacaaaagaatccaaaagcctacaagggaacttgaaagtatggcccattcaaaggaaaattgcaaactgacaactcaatggtagtttctcaaaaagaagagtgtttcctcctgttcatagagttggagctataaaatgatatgaggacagaacattccattgtgctcaacattatgaacaccatggtgacctttgagagagccatttcattgggatttgggggaaaagaatgagttgtaggatgaataggtgatgaagtaatgacaagtgtggagagctccaagtttcattgtgaatggaaggagatgaggtagtgggtgcagggtaaaatggagaagacggagggtgctttgagcgtttgattgttgatttttaccattataaggttttcatgaccagtgcgtgatttagtgctattggaaagatatatttggaagggcaggttgaagttgacaggggcaatcaggggagtaaatggatgatggatgctataagattcctgggaagataggagcagtgagattcaaagcacacattgaaggatcacccggaaagagcaggagggatgttctgtcataaatggaggaaaggcaacaacttgtacctgtacatgcaggtaggtgtttacaattgctggtaggaaatggagagagtccttcctgaggtcttggattttctcaggaaaataggaggtgcggccagcttctgagaatgagggaaaggagatcaggggtttccagagtcgtacagttgtgtaataaatggtcattacaggtagttggagagagagctggttgggaaaatacagtagactaactgacccccatatagggcttggttgaggttgatgtctacgattgtccgtggtactggtctccggactcatctgacttttccccagtcttctgctgtttcttgacttcaggcctaagttcatccggtctttggtaagggaacgtttctgggttggatgactgagcaatgctagagtactcagttgaagcattaaatacaggggcgtgcacacatttgcaggtgaggggagtgcactgagagatagatctgcgtttgaggtgcttgtgaaaacatccaggatgtacagaaggcaactggatgtttcagtgtggtgctcagcaattactttcagaccaggaatacacgtttgtgaatcctctcaacaatcagtcaggcgaagccaggagcgtgagttaattcaccccaggatgtaggcaagatagcctgtaaagagctggccgaggaccaaacctagggaatagtaacactgaagaacacagggaaacagaagtccaggaaggagatggagagagaaatctccgaggaataggatagtaactaggagaaaaagtagtaccacagacgtgaaggaaggagggagggttatgctgtggagatgtaaggccagatcataagggagagaggagtccattgggattcattagttaggacatccttgttaccttatggacagctcggggttgggacagctcgggggcccacgtgaatgaagacagactacatgaaattgaagagtgaggaagagaagtccagggtacttcatttaaaaggaaatgaggaagagtttggtaggtagagcggaagacaaaggaaggttatttaggttgaaggatacttgaatacatttttagaatcaggagaaggagaccttagaaagggagaaagtgaaaatgcaggagtgacaaactccatttttatcattctaatctcttattctcagagcaaccctccagggaaggtagtagtatcgctgtggcagcgatgcagagttggcagaggtgagacaactgcaagggagaatttcagtcactcgcctgtggtcacacagctagtaagtgggatccgggacttgaacacagttataactccaaaatggttgcactcaccagggtaacttgtcacagataccttgaaccttgttctttcttggaaaaaaaaaaaaaaaagaaattgacatactagactcagtacattgtttaaacatttaccttcttaaagaatcctccccgtactctagtaagtaatatgagtttcacccttcctggagtggctgttaatcccaggcactcagttgaatgtttcatattcattgttatttaattcccacaatgtcatgtcaaagtagaagtaattacctcaaagatgaggaaatgaagtttcacagcggtcacagctcttgccaaactacacgttaaccattgatttctgcttctcatctcccaaaaatacatcaggttatcagtgcttttcaaaagtctcaaccaattagtggacatgaatgttactcatgtacatttggaaataaatagaggtaagtgtacataaagtggacgataaatggtagttttgaaaaaagactttgttggcatataatccacaggccataatcttcacccatttcaagtgtacaattcaggtgtttttcttttcattctgcatattcacaaggttctgcaaccatcaccacaatctcattttagaaccttataatcaccttggaaagaagccccatacacattaacagtcacttcccaccctgttctccttctccaagcaaatggaaatcaaatttcttagtccataagtttacatatactggacgtttttccaaatggaatcacataatatgtggtcttttgtgattttctttcatgcagcatcacgtgttctaggctcacgcatgttatggcatgtatcagtatttcatccctttttgttgccaagccacactcccctgaatggagaaactaaattccatccgtcagttcatcaactgatggacgcctgcgccactcgcaatctttgaccactaggaataatgataccgtgtatgtttgtgtacaggtttttgtttggacatagagtttcatttctcttttgtagaaagctaagagtggacctcctgggccatatggaaattgtgtttctggtactgaggagcagccaaattctttcaaaccaggctgccctatatgttatagtcccactagcagtgtatgaggactccaatctctccacatccttgtcagcagttgttatcgcctgtcttttttattcttgtcatcctactgagtgtgaagtggtagctcattgtggttttgatttgcatttccctactggctaatgatgattgtgggtggcttttcgtgtgcctattggccatttgtgtactttctttggcaaaatgtctattcagattctttgctcctttttgaattaggtcatcatttgactgttgattcatcagagtcctttgtatatcctggatacatctatgatcagatgcattttctacgggttgtctaaaactccacgttatctacttttttgttttgttgcttgtgctttggtgttgaatgcagacacacacaaaagcctttgcctaagggaaggtcacaacgtaagacttacggaagagaaatgtaagatttagtcttatatttccttataagagttttatcactgtagctcttatatttaggtctctgatctgctttgagttaatttttgtatgtagtgtgaggtaaggtccaatccattcttttgcgtctggcggtccctcgtcattttgtgaaattactttctttctttatttttcaattgacaagtaaacattgtatatatttatggtgtacctcaggatgcttgatatctgtatatgttgtggaatggccaaatcaaactaattaacatattccacccttcacatatttatcagttttttgtttgtttgtttgttttttgtgggtagaaacacctaaaagctactgtcttacgaattttcaaataaccaatctattgctattgagtataaccactatgacttacaatagctcccttgaacttattccccctgtctaacagaaattttctatccattgccaacactccctatgccccccaacccttaacctccagtagccaccatttgtactctctgcttctatgagttccaattttgagactccacatataagtgagatcacttgctatttgtctctctgtgcctggcttatttcacttgacctcacatgctccaggttcattcatgttgccacaaatggcaggatttctttcctttttaaggaggactcatgttcctaccacgtaccccacaactcggggagacaacgtggctccgcctgagttcctcctcccgccagtaggctgagacaggcgtgcggctcgacatgtctctttcttctgtcttgcagatagctctcttccattgcattaggtccaatatcttggaaaccattgtcatctcggttatttcgttgctttgcgggggaaggatcaatgtggtgtttttttcctccaatgtagccagaaatgcaatctcctgaaacatagtttttaatatcccatacttagcaagatcttattcaggttggcagaaagaaaatgggaaagagaatgttcgtcaaagtgtctctaggcaagattttccagtgtgcaagaagatatactcaggcaagacggtttttccggtggacacccttgtgcctgcatgtgatactggaaatacttattttagagatgcgagtcctaaacaactatctctgggatgccgggagcaaactccctgggtcttctagaggcaggaatttgccaccttgtgatgatgagagtttatctcagagaccatgcggctataatttggttttccccagctggtatctgcagctccccccggctgttaacaatttctccaatgtccactcctgggtccgaagtcactgttgcttacatcttttacatcctgacccatgagaacagccttcgctcacttcaagtctactatttaagtgagagacagtgatggcatcaaccccaccaaccgcacacctcacattgggaagagcatgcagactgtgatagtggctcagagtcaagtctcaggaattgtggtggagtcacagaaactgtggtgccattcccagaaaaaccttgatcctggtcataatagaggaggggaaaggtattagggtaactcattgaggcacttactgcggagtcccaggcaaaagcgatagggtctaggtccctttggtccaaatatcggggtataatgacataagttatattaggaacagtggatgacatttcttgacaatttgacgcatcagggcatggagctctatattctccttccagcacttcacttaaaatgctcagcaaattaagatatatgtaattctgtcgccgttgtacagatgaggaaaccaaggcccagaacggtgtactgacttgtctgacagagggtgccctatcgctgtgctcctgcaggaccctgtactttgctgacccgtgcccccgtcacacagttttgaatggaaaaggctatctctgttcctcacgccatacattgggagacgacagtgtctagggaaagttggaacttaataaggaactggaaggcctatgttcttccctcctcctactttttttgtagctgaattgctttacgctcagtttttacatcaaagaaatgtggatgacggctcctgagatagtggtcctggaagtactgcctacacctcaggctgtgtgcagttaagacaaaagctgcatttggatttttgctcaaacaacaagaagacgaataaaaagggctcatatgcagtaagtgcttatataggctaggctccatcattccttcatgggcatgctctcactgaagcctcacagagaaggtgaatgcaacttttaaaacttgttgccatttcaggcaggaacaagtagcagagttgggacacaagcccaggtggatatccgttcaaagcctctgtcctcaaaataagtgttttccaaactgtgatatgcaggttgtttgtggccatagacacaagtatattggcacatgaagaaacaacgtgggggctcatgaaatagcagaacatccaatctacggtcatttcagatttttataggaggcccgcgtcatggtggcgtgcactgggcagctggccacaggatctcggccagggatgaagagctgcttttgatgtgaggaggagatagggtgaaatgcgtagagagttggatccatgaaaacagagaggggccaggatgaatggggcagaagtgcctgagagctacttttttccccagtccttactgaccatggtatccaatcaccctggctttccaacttcttcctgccacctgccctcttggcatccatgggcttggtccttccattatcagcgtctcagtttctttctccaccaattgagattaacaataggtgttctgaaagactttagtgagaagtaaataaaggaacacacgtgaagtatttgtgagagagagagagtccttaggtctatttcatatttttcattttcaaaggcacatgtacaaattatgtatcacacctgtaatctcagcactctgggaggccgaggcagtcgggaagcttgagctaaggagttcgagaccagcctggttcacatggcgaaaccccgtctctacaaataatacaagagattagcgggctgtggtggcacgtgcctgtaatcccagctacttgggaggctgaggtgaaaggatcacttgagcaggggaggtgggggctgtagtgagccgagatcgagccactgcactccagcctgggcaccagagcgaatatctgtctcaaaaaataaaacaaaataatagaaattatgtataataataaacattttcattacatctatttctagttatattttatgaccagtgatcttgtcttccatttggtttcatgctgggaattttcctttttaaacacatttctaagtctttccttgacgcttgtcagaaaggaaattcaccttctagtctggagttcatcctaagatgtcatctgaagagccagcatacaaacaagcggcctttgtggatcggtgccagatgcgctcttccattctactgagaggggggtgtttccattcccttccctatggtattctatggaagagctgagctacattctaagaacctcgcttgagcatctttacccaactccactttttgtccatagccttaagtccttctcacattctgtttgacacattccaaacccactgtaaatgcttgtggaatggatgaacaagtgaacaacgggcttaaaaaggagaggggaagggacagtcagtggcgtggggctgaggcagtccagcatatgcaactagcaggaagttaaagatttctggggggggtcagaaataccgatggtcccgaagttaataagacttctaccctgggctgtgtttgcgtgggcatggccaaggtcggctccaggactaaccagccagcccccttctgactgtcgtcttccctccgtacctccagtcattcatttagtctgctcttggtcttgctcagagataggagtcagtcacctattttgtttccttattatgtcttcaatcatacacagctgtacacaaaaaaatatgtgacccgttaaacacatctgagtggccaccatgtgggagaaccgaatgaaacataaccagctccctaggagcccactgtgccagactgtatggccacaaaaatatctcccatctctcgtgctgtgataaaagttgccccgttcacaccgagacctgcgatttaatctccctcccacgcttgaatctgaaaaggctgtgactcacctctaatcaatagagtatgacacagttgactcaacatgacttctgagtcttgcctatgagaggtgatgcaacattcaccttggatatggaaaagtgccgcttggagcctgagtcatgaggtcggaagcctgactactgggaggcccaccctgctgtgaggaagccaaaggccacggagtggtaatacggaggccctccactcgccaggcctagtcttccagtcctctccatgcaggcaccagggatgtcagtgaatgagccttcagatggttccagtccccagccagtcaggtttctgcagctgaggtcccagactcatgtgaagcaagccatatccactgtgccctttctgaattcctgcctctgaaattccatgcatatgatacaacgctcgtcattgtatggactcactgtggggctgtttgttacacagcaagaggaacaggaatgcaggacaccctcccctccccccacccccactcaaagccattcctcctccatagagttaaaccctaatctgatgctggcttaaattatttcactgcctaattcatggttttcccatgtgtatggacgcccctaaacaatgcggtttcatattgtctgggtgccttgataggaggagttttgggggcctgaaattgagaaaacaagcattcatggatcaggtagtcaaggcaaggcactgtgtttaccccaagaacaaacactctgttagctgttaacattcttgaggaaagagcaagttgaggaatggggtttaatctactcgataccggttatacagcgagcaggcggcaggtccaggattcaaacacaggtagtgtgtccccagaggccaaatgtgtaaaccctctgctaattcccctcatcaaaaggtaggggaccctggggaagctttctctactacaaaagccagagtcaccaccaccttctgaaataatctgagaccaagtaccttcaaaaaccaagccttgccatacatagccaagccggactttatagacacaccaacacacatagtttcctagaaggtatttactgatttctatatacttaacacatgtacaagacaggtatttcaaaagattaaagagggcagacagtgcgcagatgtctttctcattcctgtgtgcacagatgtctttctcattcctgtatccccatctccttacccagagacacttcccaaacaacaagcgaaatagtaacagctttcgctgttacaggaaataaagagtaatgaggtatgtaacacgaccaaatcttgaaatatatcatttaaaaaccagtaaatagcataactcgaatctaagcagtgaaaatatgaacgtctacctgaaactcacaggtgcgggagcccacgcacaccataatcaatggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccgcagcttcctgaacgtctcccagcgctcccgctgtgcgcccaggtccagatccttgggggacggggcgggccccggcgggtacggggttggcgcggagggcagcaggtctctggggcccgccttccggacccgccgccagcggcgcttccgtcgccacctacccagccacctcttggccgccgcgtggctcccgaccccgacttggacccgggggcactgcgcgcggctggcgcccgtgaccgcgatggccgcgcaggcggcgggaggatccccgggccgctttcgcctccgccgctgagcagtggcgcggttcctcactctgcccatggcgcctgcagcctccggagcgcgtgcccacaccccaccctcatttccccgtcagtcgctgagcagcctccttgcctgcgccagcaggattggccccttgttgaatgcgatgtaaagagacccttcccttgaccctatcacaacagccttcgctggcctgaaaggcagtcatgaggcgttcagcaaacacctgccgggcaccagataccctcacctgggcgctgggatgtggagatgcatcaggctttccaaagcactcacattcatttaggatcaggtgtatgcaaatacagtccccaacaccttgggacactttgctctgacagaaataagaaccaggggctctgggaacagagaggaacgcccacacactgtaattggaggggcgtgtgggaggggcacggaaagactcttctaaagtcttcttgggggcttgattcttttattcggctgtagcgttttatttttcttgtaattttcgttgcgatgaagtcctctttacctaatgttgacatacctacttctgctgttttaattaatgtttacctgatgtgacttttcccacccgttgtatccttttcatttacccagggcgaccgaagtggaactgagtttcatataaacatgggataatcagaccgtgtttctcactgactctgccagtatctaccttttcatacatgtttctagttcatttccatgatctctgggctagtgtttaggtccacagatttattgtttgttttcttttgtttcctccgtgtctcggctaaccgagacctcctttttttgcccttctgtggcttacgtgtacaccttgcaggatttatcctgatttccgaaagtgttttcgagtgtttggctttgtaaaattgtctcagtggttgctctgggattttcagtgtgcatatgtgacttaccacaggctcctggtatccagttctcatcacttccattgaagtgtagaagcatcagccccttttagcccctctgccttcctgcttgtagacaacgttgtctggagtatcggatggtttcatagtttttgctttaatcgtcaaacatgacttccacaattcacaaggaaaacggtggcttagtgtttgtcccctaagggtgttttttctactggtcttgactcctttctgatagatacttccagaggccatcttttattctttcctcttttgtttcaagcacctactctagccattctttcaccgtgggtctgctcgtgacaaaatgctttcctttacctgagaatgtcttgatttccccttcgtccatgaaggatggtatcactggatacaaaattcacagctgacaggacttttgttcaacatctgaaacttttcgggacacttcctgatgaccgccactggtcagaggagacatttgccctcattaaaactggtgttctcctataatcaatgaaccacttcggtcttgctgctttcagtgattttatcagcttcaaaaactgactatgatgtgtgtgttggtgtgaatcgctttgtggttgtcttatctgaagtttgctcgttttccagaatctatgggtttatggttttcactaaaatttggatattttcagccttcttttcttatactcctctttcagtccactctctacttttggtactccagtcgtagggatattggaactttgttattgtcctaacttcgctgaggatccattcagcttttaatcagtccacgatctctctctctcgctcaggcacagtcagtcctattttctgtttgtttgttttgtttcttgaggaagagtctcgctctgtcacctaggttggagtgcaatggcgcaatctccgttcactgcaacctctgcctcccgggttcaaacgattctcctgcctcagcctcccaagtagctgggattacaggcgcccaccaccacgccaagctaatttttgtatttttagtagagacagggtttccccacgttggcccgcggtgatctgcccgccttggcctcccaaagtgctgggattacaggtgtaagccaccatgcccggccgtcaatcttattgattgggcctccattacgatgatggtatcttttgtcatcacaggtctcttaccgagtgcatccagcaatgtttccaaattctgttattgttttcgttttctgttccatcatttcttttttatacatcttctactcattgctgagattttccattttctagtctggttccagactatttgcaattacataatgaagcatttttatgatggttgctgtaaaatgtttgtcagataatggcaacatctgcgtcgtctctatgttggtaccactggattctatttcctcattcaagctgtgttattcctggttcttcacatggtgggctatgctctatggcatacaatgtattttgcttgttactttaggagtctctggacaggagacaaatatttgatgttagaagtcagctactttctttaggtttagcatgtagattctggtgtccatttttaggttctgggatttttaaaaagtttattttcagagcatttgcggtgctatttttgtgtgtttggcttacctgccgacacagcagccccaactgctccctactggtggtatttgagaggcagaaaaaaactaaagtccacactttattccaggtttcctacttacttcctacctaatatcattttttttttctgttcccagataccatgcagcctaccacactacatttaatcatcatactgccttaggttcctcttggctgggacaacttctcagactttgcttgtttccatgaccttgagagttttcagggtcactagtgaggtattttctagaatatctttttttttttctttttctttttcttttttttttttttttttttttgagacagggttccttgcttcccaaagtacatgggactacaggcatgcgccactatgcccggctaatttgtgacttgtgtgtgtgtgtgtgtgtgtgtgtgtgtgtgtgtgtgtgtgtgtgtgttttgtagagacaaggttttgccatgttgcccaggctggtcttgaactcctggactcaagtgatctgcctgcaccggcctccctagaatatttttcaactcaagtttttctaatgcttgtctcatgattagactgatgttgtgagctaccggagaatcaccacaaaggtaaagagctgttttcgtctgatcgcatcaagggtacataatatcaacatcagttttgattgtgtaagttgaccttggtcacctggcagaagcagtgttggacagggtgctcccatgaaaagttgctcttttaacccctgtccacatgctactctttggaaggaagtcattaagcgaagttcacacctaactggtgctaagttttaaatcctttctttgaggcagagtatctacatacattctttggaattctccttcatggcacagctatctatgctcctgcatttatttccttattcaatcgtttatgtatatcatgatactttcacggatatttacttgatactttagattataatccaatactttgctatttctttttcattattatcattcttgcagttgtggccactgggtgcacgttcagttcacccctaggtcccgttggtatgctcccattatttggggctccattttgtgtaattccttgctttgtggctcatcctgcacatttctgtcttgcatatgttctaggctggtctggcctatttactagctcctaggatcagccaattctccaaggatttctgtttccttttattagaaaatggtatcagagaccaacgtctggcaactaggtgtgctcgtagctgccagagtctagtggttcctaggccctctctgctgaagcagaaaggaaatacgtatgtatgtatactaacccacgtatgtacacatttctataaatattttgatacatgaccatgaggatctataataagctgaatatgagttcctacccatgtctgcaactctattccattgcagcacgaatcattcttgcccctgccacattacgatctgcacctccctctccagcagtgaaaaacctgcctctcaccctccaccatccatttactcattgcagttccagtacacatggagaacggtgtcagatttttcaacctgtgtccataccggcaacaggtttgtctagtcgagtatgctgcatatgtacaattgcctttgtctttagccttacacacttctttcatttccaaagttgcttagatcagcactttgtacttcacagccttcagtgaagcttttcattcattggtaaggttagaaccttttgtcacattctgcatttcaacctgatagttccctacctccctaatgatgtcttaaaagattaaacacgttaagtttcattctgtgtcctgtcagtttccacggattctgacaaatgctttgtctcatacaaccatcattagggtatctcaccctgtcctcacacagagacagctatttttatttcctcttcttcggaggacacgaaccctatcataaagactccaccctcatgacctcataacctcaaaccccattacctcccagaggcctcacttgcaaataccatcacactgggagtcgggacttcaacacgtgaatttgggcgggaagcaaacattctgtctataacgcacatgatggtttcactgccctaaagcattacctgtgctttacctactcatgtcctcctgtaaaagtcccctccacatagcttgcctccttctactcatccttttgaataaagtttctctttactaatcctggatttgtattttgtttgacaacacgtacgttttgaagcaaactgggcaaacacttaatagcgagaatgctggaccaccagtgtggcaagactattgagccttgttaaggaccaagcagactctcttccaaatttgctggaagatagagacttcccactttacatgaatggacgttcctgttctgcatccttggcagcagttggtttgtcagtttgggggtcttggccgttctgttagatgtgtagtgtcatgtaattattatttgagtttgcatttatctatcaatgccaaataacagtaaacattctttcacatgctcatttatcacttccaaatctttggtgaggtgtctgctcagacctttagctcatttttaaattgggttatttgtggttgtttggtttttgaatgtccacagttttttgaatatttggaatcaagtcttttctcagatatctctttgaaaatattttctttcagtccttaggttatctttcttccttaacagtaatgtcttccacacagcagaagttttaagttttaacaaactccaaataattgctttttgttcacagactctgtggtagggtttgtgactaaaaccccatcaggaaacacaaagacatgttgatgtttttcctgtgttttcttccctgtgttttatatttctatatttctttttttattttatatatattgtttgtttgcttgttttgttttgttttgagacagagtctcgtcctatcgtccaggctggagtgcagtggcgcgatctcggctcactgcaacctctgactcccaggttcaagcgattctcctgcctcagcctcccgagaagctgggattacaggcgtctgccaccatgcccggctaatttctttttgtagttttagtagagacggggtttcactatgttggccaggttgttctcgaatgattgacctcgtgatccacctgcctcagcctcccaaagtgctgggattacaggcgtgagccaccgcgcctggcctataatttatatttttatatttcatgtgctttataatttgaattttacatacgggactttggtcctttttgagttaatttttgttaaagtgtaagttcttggtctaggttaatgttttttccatatgggcccgaaatctcccaccaccatttactgaaaaggctatccttttcccattgtattgtgcacgtgcctttgtcaaggatcagttgagaaatatttctgcagttcgattattgggcttgctagtctgttgcattgaactgtgtgtgtattcttagtaaatgccaccctgtcttgattactgtagttttatagtaggtcttagaatcgcatcttatgacttttgcaactccattctcctttttttagaatggcttttctattctagcacatttgtgcttcagtacgaaatttcgagtcaatatgttgatatctacaaagtgaatgctgtaattttgattgggattctgatgttacaatagatcagtctcagaggatttgaaatcttctaacaattacaaatcttccagtccgtatatatgacatctctctccacttattcagatcttctttgttttttctttcctcatcaatatttgtagtctctgcaagcagatcctatgcctgacatttagatttagacctaagtacttaataggtacttaagttgccctttaaaaaaatcaaattctcattgttcactagtcatatacagctaaacagtcatcatcaatatatcgattgtgtcctgtgaccttgagaacctcatttattaattcagcagtttgttgcaattctttggagttttctacatagataaccatatcccctgtaagcaaaaagtccctctttctttatgttgttgtctcttcaggttttacctgggcattggtagcctctcttagcatatggatcatatggcttttagaactgctttttgccctaggctttacaatatacatatttacctatcccagtccaccgtccagtaacagtacatcacttaatgtgcagtgcagctacctaacccgacagaattcccaattaacccctcatgaacttatccgtatgctatatagtcaccaaatacattgtcagtattattttaaacaaaccgtgttcctttagaccttgcaagaataagcaacagaaaaggtgcgattttacctccacttgttccttcactgattctggccctgcctttatgtagattcaagtgtctcatctatcttattttccttctgccttttaacatttctcccagagcagagtttctgaaggttaatttgcttgattttaatttgtctgagaaagtctttgtttcctgttcacttgctaatgataattttgcaggacatacaattctagctaggtgatatttttcttcactcaacactttagtatttcagtctacgctcttcttttttcgtgggttctgacgagaagttggccataattttcttccatgttcctctaccagtaaggtgtttttattgaggttttcagactttctcttcctctttagttttctgcagtttcactatgtctagacgtgagtttgtgttgtgtgtgtgtgtgtgtgtgtgtgtgtgtgtgtgtgtatttggtatatatgctgcttgatatatgctgagagattcctgactctgtgctttggtgtctgttattaattttgacagcgctaggcccttattgcttccaacgtttattctgctctgttctctctgtcttctttctctgtctgggattcagattaataggtcgaaccttttgcaattttcacacagtaagatgttcaattccatttcttcccctctttttcctctttgcattccgttttggaaagtgtctgttgtcctctgacctttcagcatgctttccaattcttacctttgttgtgctgactctactgatgagcttctggaagacattcgtcatttctgttagtgtttttgatttctagtatttccttttaattctttctgagaattcccatctctctctccctttgtcctcccacttgaatctgaggctaacagagtgctcctgctcagggagagcctgtgtcttgcagcacgttcagttgtaacccgccgttatttccctggagcctggttgtagtggtggtaaggtgtaggggcaggaaagcattccacagctttatgactggatctctgcctttcaatgggactgtgtctctgggctgtgaccttgacaagtgtttctccagtggtattaccctctccccatgtccgtggtcctttccctggcttcagcattcccaaataatacctttacacacttgagccctcttgatttgtttttcccccacaggtgacactggaagcctggaggggcagacgatggaggaatacccttcctgcacctaagataaggctttggtcaagtcttttgctctgaagactgggcctttgtcttggagaaggcactgggagtatttgacaacgattactcttcctctctcccagccagaaaaaccacggcgtctttttcagatcttcaccatgaaaacccatgtgttgagccaaaggccatgaacatgtggatgcccctgagactgcgggcccccagcgtattctcacactaatgccagtccacacacagcctcaagcacttcatcgtatttactactgaagcactcctacaggcttctgtctgcagaagctgctgattcaggtaagcagatctcagctgtgacactggatttgacagtctctcaagattccagggtggtgtcttgctgtcccctcttggttctctgatgagtccaaaagatacctgaatccattttccagcattttcttgttgtaaggatgggattggtcatttgtctatttacacatagagctgaaagtggaagtctcatttgtggccatttttgaaacatgtcacaatcagaataagtctatggcttgcaaatatcttgccaagtcctaggagaagccgatgacagttgaaagtagttgtcgcagggagccagcaggagaagtaggtgtgtgtggtgggggtgggaggttttcagaaccaaatgacttctgttctcattgaatgcaaattactattacattgtttagtaatgtaattactaaaaggtatgactgtttaactcttaaaatcctatatatatataatatatatattatattatatattatatattatatatattatatataatatatattatatattatatatattatatataatatatattatataatatattatatattatatattatatatattatataatatattatatattatatattatatattatatattaaatatattatatattatatataatttatatattatatattatatattatatatattatatattatatattaaatatatataatatattatatattatatatattatatattatatataatatattatatatatatacgatttgagaaaattaaataatggacagtgcattttatgtagaaattgtctagaaattttgcatgaaggaatgcacagaaattgtaaacataatttgaaggttaaataaatgccctcaaatgcatacaatttctaaaactgttattacctcttgcttgctggttgatgtcagctgtcagtattacctcctcactaggcatgcattgcctaggatcacagcagctttacacaccaattggccagggcgatgatgttaaaatcggcctctgccaaatcatgaggaggcaatgacgtagaaggggaccttatccccatttcacaaatggagaaaccaaggctaaaagagactaagtaacttgctgaaagtcatacactatgtaagtggtggatctgggacagtctcccaagctgtgtctgacatcagcacccatgtcctttctggtatacttctctgcctatccaagggtgggcagcattttgaattgtcacacctttttcggataatggtgttctttttttgttttcttttcatctgagcttggaaaaaaagtactcacaaatacacaagtagagatgaatacaatcatctgatactttttagaaaataaaaacccataagcctcattaaattgacttagaagctggaaacaaagataaaaatcttccaaatttatttactgaaagtagcctgataccaaaatctggaaaagacagtacatgcacaagggaccccaggtgcgcacgggcacacaggcacgcacacacacacacacacacacacacacaaacacacacactcacaggcatgcacacgcagagagaaatatggatctatatcacttatgaaatctatcactaataaatttcattttgtgcccctaaagtttcagtggataaatagcaatgatatgtagaaaacctaccacacatctggtaggttttttactcatgagaagatgatgtcatatttagaaatatatatgtacaacatggtgactactgtgaatagcaatgcattgcatacttgaaatttgctaagagagtagatctccagtgttcacaccatacacaaaagggtaactgtgtgagatgatggatatgttaattagcttgatcttggtaatcatttcacagtgtatacacatatcgaaacatcacattgtacttcctaaatatacgcagttttatttttcagtcatacctcagtaaacctgggagaaatctcatttgctgtagaggaacacttctcatccaggggcattttgcctcccagggaacatctggcaatgtttggagacatttttgtttatcgttactggggaaaagaggaggtgcttctggcatccagtggatccaggctagtgatgctacttaactccctgaaagcacaagacggccacgcgctataattatctcgtccaaaatgtcaatagcatcaacgttgacaagctctgtcgtagggtatttacataactcagaaaagccagaaacaaaatttaactcatgtgcagtcctgccagtgatccataacaattgctaaacatttgatatgtgtgtgtgttaaattttctgctacagttttttacctcataatcaccaaaagactatggttggaggaaactattttatttcaaaggttaattcttccaccacattctacaagtgtttttcaaatattccacatattagtctgtgcttaagaacacatgtcccttaagatttgtaatttcagctgacttacatggaggggtattctactagtatcaatccaccatcacctgtctcctgattttcacctttctgaacagaggtatcatttccatatatttggtgaaaataaagaaaagcagtgcctcataccacaatgcatgtgatatacaaagggctgcgtgtttgactaactgcatcaaagcaatcccattaccccaccagtgactggctttgaaatgggcctttcccagttgccatccatgagatatgggtgtttgttggcttacagtcttcgaagaatattttctcagctcttagagatatagaagagacacaaaagatggtacacacgcacgcacacacatatggttgcacacacacagtctaaaagaatatctaggattataattaacaaatgaatttagtgtgatattgctgggtataaggtcaatatcacaaaattcaattgaatttgtatatcctggcattaaacatgtaaagagacaacttttaaatgtcatttctcatagtatcagaacacatcaaatgcctaggaacaaatctagcaaagattcccaagacctctgcccggaagtctacacaacattttcgagagaaattaaagaagacctaggtaaatcagagctatatcgcacttatggactggaagacaatgtcatgaaagtaaaccgaagagagaattctaatgaaaatgatttatagattcaatgtgaccccagtgaaattcccggctctttttctgaaaagggaaataaatgggcacgccacttctaagttctataaggatgtccaagatccaagaaaagccaaggccttctaaagcaagaacactttttagaaccctcacagccagatagcaataccaaccataaaggtatcataattaaggaagtgtggtacgtgcacagtaatagacaaatagaccaatagagcaaagagagggtcccacaaacacaggtgcacatacatacgtatatggtcacgctcatttacaaaaaatgtgccacctcaatgctctggaggcaagatggtctattaaataagtggagctggactaatttggatatccatatggaaaaagattaacattggcccctaagttacaccatacacaaagattaactccagaggttatggcttgtacaaaataatgcataagcatatctgcatgaccttgggggtgagcaaagatatctgaaataggacacagagtcactaacgataaaggaaaacattgttcatctttacgttatcaaaaggaaggacctctgttcatcaaaagatgaatttagagaatcaaaagataaatctcatgatagaagaaagatatttgcaatatacatatgtatataccacaaatgtctgatgtacagaatgtaataccccctaaaatcaagaggggaaaagaataatgcaacaaaacattggcaaaatatttgaacagcaccttcacaaaacaggacatccagcggactaatagacaaacagacaaacagctgctcaacctcagtcaccagggagaagtcagctaaagtcccaatgagatctccccaaacacctgacagaagagccaacacaagcaacaacatgaagccttggtgaggatgtggaagagccctctacggccggcaagagtgtaaacaggtacttgcactttggaaaactgtttggccatagctatgaaagctgaacatgtgcattttctataagccagcaattctgtctgtgttagttgcctattcctgcaaaacaagctgccaagccttagtggcttgaaaacagtgtgtatcttccagcttacagttctgtaggtcagaggctttgttctctgctccatgtatcacagggtgaaatcaagctcagccaggcagtgtttctctgcggaggctctgaggaggaatccgattcccagctcattcaggttatgggcagaattcagtcacgctctcagctcctaggcaccgcctgcagttccttgccatgtagaccaccccgtacaccctctcacacttgaatgtctcaggaagagcccaggccattttaagagctcacctgattaggtctggcccacccaggataacctccttatgggaaagtctcctgatcgggaccgtgatacatctgcaacatctatttccacaaataatgtgacgtaatcacaggagggatatctcatcatattcacaggctcttctcacactcagagtgagggggttatacaaggccaaggttagttagggtcaaccttggaattctccccaccacagtttgccctctggcccccagggatccatctgtctcacatacaagatactttcaccccatcccagatttctcatgatattccagcatcacctcaattcctgaagttcatctaaatcttatcagttcaaagtcttgactctcctcatctccaccatctaaatcaggcacggatgatgttcctgggtgtgatccactcagtacaactccgggaacagagtccctctccaactttgggtcggtgacactaaagtgacaagctatcttcctctaacactcccaaaatacagtgatgggagaggcatagggtaacagctgtaaacattctggtttgatgcctggggaggggaagaggaaaggtaggaaggtgttagcattctaaagcagactggaaatccaactgggaaaacaccagaattctctgataaagtttcaaagcctggaacatcctcggcacctctcggtcctgcctgtgggcccttggttcttcctcctgggtcatgtttccttcttcatgaatggtagcaggtgtgtgcagctgagtagtcgtatcagcctgctccctgcccttagcatcttaggggtcccacagcccgtctctcttttcctttgaggccagtgggtctggcatccagtggatccaggatagggatgagacttaaccccctgaaagaacaagacagcctcccacaagaattatctgaccccaaatgtcaatagtcaataatgcagatggtccaggctgacagtatttctgctacctgaagtttctcaagaaccttgtgtgattcatgtggattttactggcattcactgtattacacacaagccgcgtcgcccatttgttcaagatactgccttcttcatttgcggttattgcggagatgatggagagacagcacccttaagcttcccagaggcctgctgatatagttgagacaatctctgaggcacatctttagcttcctgaaaggggttttttgtgggactgaatactctggactgttggccttactgagctctcagcaaacgttgaaccttgaacagccacactctctgagttctccctaggccacacactcagaagcattctcttcatttagcgcccccaaccccacccccacagggattcctctagcatggctcagtccaagtcccaaagcctctgaaccagggaagccgatgtcgtaattctcagtccagagctgaaggtctgaaaacccactgggccactggaataagtcctgaagtcccgcccctccccccccccaacatctacatagcctgaaaatttcccaaatcatcccatccctgttccttttgtttaacatctcttcccacaatttctctttcacctttcactttctatattggcatcaagaagtaagcaggccactccttccgcaatttgcttggaagggtcctcagcaatataataaatataacttcataattttaaagttcagctttccccctttccccattaccgtggaatacaatcctgccaagctctctgccactctctagtgacattcccccttcccatagtttccagcaacatgctcctcactccttctgcagcccttacagtcggaaactttcaagttcacatttgtactagaagtctgtacaccgtgattttggccttctcagaggcaatgtagggtctcccgaaagtcctccttattgttggagagctcccagcagcagatattttaaattccagatttgtactgactgtctgctcaaggcaaccttggtttctctcttaggctccccaaatcctgccaacctccacccactgcctcggccatatatccaagtttgtcgtttatatttttcttctttccacaaaactgtgggcaataatcttgttaaactttcggccactacctagcagggatctccctttctccagtttacaatgacgcgttccttcctccttctgaaccctcatcagcagtgtcctgaaaagtcagacttctactaactgtctgtccatggcaatgaaacctttcccaaggcgatttaggcattctatcttgtgcacttaagaattcttccagccttcgccaactacccagttccaaagccacagtcacacttttaggtgtttgcagtgtgtgatggttaattttacgtgtcaacctgactggaccaaggaatacctagagaactggtaaggcattacttctggctgtgtctgtgagggtattttcagaggagattgtcatgtgagtcagtggactgagtggccaacattcgcccttgacaaaggcaggcatcatccagtcagccaggggcctggagagaacaaaaaaaggaaaagaaaggatttcttcccttccccttccccttctccttccccttccccatccttttccctttctccttccccttccccttcccctctctctctctctctgtctcacagagctaagacactctccctctcctgatcttgaacatcacgacttcagactctctggcactgggactccaggacttacaccagtggcccaatgggttctcaagccttcagcttcggcctgagaattaaaacaccagcttccctgcttttgaggctgcgggacttggactgagccagcctccatcatcacgtgagtcaatccccctaataaatcacctcttgtacatttatatctatcctattggttctgtgtctttggagaaccctgaataatacacagtgtagcaccgcacattcaggtaccaaaacctatactggttttctgttggtgcagaacacattactgcactcttagcagcttaaaccaacactcattagctcacagtcacgtaggtcagaagtctgtgcattgcgtcactggcctctcagctcagggtctcacagggtgggatgctgttagacttgctgtgttcttttctggagtatctggggacgatgcccttgctgacccatccatgttgcagctgaattcagtgccctgcagctagaggactgaggtccccttctcttgctggctgtcagcggggggacagcactcatctcctagaggacacctgcagttccttgtcatgtgccccctccaaacgctttctctgcttcaaatctctcagcaaaaacctagacccttgtaaatgcacatccgattaggtctggcccaccccacataatctccttatcttaaagggcaactgattgtgaccctcattccatctgcaaaatcttcttgccctaaaagtaatataagtctactaaaagcaggcaccctgtagtcccagctactcgggaggctgaggtaggagaatggcgtgagcctgggaggcttagcttgcagtgagctgagatcgtgccactgcactccagcctgggcgacagagcgagactccgcctcaaaaaaaaaagtaatataagcatgggagtaatatcctgtcatatgcacagtttccaccccaactcaatggaaggggactcgaaaattcaagggtcaatgggagtcatcatagaatgctgactaccacacaatccaagaatatatgcaacagaaatgcataagcatcttctccataagtcatgaatgaagacattctcagcatcatcactgatgtgagtcagaaccagaaaacaatctgaaggactcatcacagttgaatcgatcaatagattgtggtatattcatacaacagaccattatacaacaataacacaagcaaacatctctacatgcaccagcatgggtagacctcaaaataagagtattaagcagcaaaacaagccaggcataaaaatgtccatgatttataattctgtttgtgtagggttttaaaacagacaaaaaaataaccacactgacagagatcagaaacctggatactttcaggggtgatgactagatagggacataatacaggtttctggggtgccaccaatgttctatatactactacacatctaaaatcccgaatgttgtgtaaaccaattatttttcctgactcgtttgtccataaaacatgacctgagctgatatgatgttgtttgtagtcttttggggtcttatctttctgggtaaaaatatttacatttctcagtggaaatattgttttatcgggttcagctcactagtccagaccctgccatggttcttatgtaaagtatggtttatgaattctaaaacatttggtcccaagactttcaggtaagggattgtggataggtggtattagaggattttaacataattctgccaacccaacacagatttagtagacaagagctaagaaagactgaacagagcttatcgaagacagattgaattttagcctgtttttttcttttttttccagcaacatttcagatgatatgttttttctccttggacctatcaatataatggactaacaatatatttctaaatatgacatcatcttctcatgagtaaaaaacctaccagatgtgtggtaggttttctacatatcattgctatttatccactgaaactttaggggcacaaaatgaaatttattagtgatagatttcataagtgatatagatccatatttctctctgcgtgtgcatgcctgtgagtgtgtgtgtttgtgtgtgtgtgtgtgtgtgtgtgtgtgtgcgcgcgtgcctgtgtgcccgtgcgcacctggggtcccttgtgcatgtactgtcttttccagattttggtatcaggctactttcagtaaataaatttggaagatttttatctttgtttccagcttctaagtcaatttaatgaggcttatgggtttttattttctaaaaagtatcagatgattgtattcatctctacttgtgtatttgtgagtactttttttccaagctcagatgaaaagaaaacaaaaaaagaacaccattatccgaaaaaggtgtgacaattcaaaatgctgcccacccttggataggcagagaagtataccagaaaggacatgggtgctgatgtcagacacagcttgggagactgtcccagatccaccacttacatagtgtatgactttcagcaagttacttagtctcttttagccttggtttctccatttgtgaaatggggataaggtccccttctacgtcattgcctcctcatgatttggcagaggccgattttaacatcatcgccctggccaattggtgtgtaaagctgctgtgatcctaggcaatgcatgcctagtgaggaggtaatactgacagctgacatcaaccagcaagcaagaggtaataacagttttagaaattgtatgcatttgagggcatttatttaaccttcaaattatgtttacaatttctgtgcattccttcatgcaaaatttctagacaatttctacataaaatgcactgtccattatttaattttctcaaatcgtatatatataaaatatattatatataatatataatatataatatataatatattatatataatatataatatatatttaatatataatatatataatatataatatataatatataaattatatataatatataatatatttaatatataatatataatatataatatataatatataatatataatatatataatatattatataatatatattatatataatatatataatatataatatataatataatatatatattatatatatataggattttaagagttaaacagtcataccttttagtaattacattactaaacaatgtaatagtaatttgcattcaatgagaacagaagtcatttggttctgaaaacctcccacccccaccacacacacctacttctcctgctggctccctgcgacaactactttcaactgtcatcggcttctcctaggacttggcaagatatttgcaagccatagacttattctgattgtgacatgtttcaaaaatggccacaaatgagacttccactttcagctctatgtgtaaatagacaaatgaccaatcccatccttacaacaagaaaatgctggaaaatggattcaggtatcttttggactcatcagagaaccaagaggggacagcaagacaccaccctggaatcttgagagactgtcaaatccagtgtcacagctgagatctgcttacctgaatcagcagcttctgcagacagaagcctgtaggagtgcttcagtagtaaatacgatgaagtgcttgaggctgtgtgtggactggcattagtgtgagaatacgctgggggcccgcagtctcaggggcatccacatgttcatggcctttggctcaacacatgggttttcatggtgaagatctgaaaaagatgccgtggtttttctggctgggagagaggaagagtaatcgttgtcaaatactcccagtgccttctccaagacaaaggcccagtcttcagagcaaaagacttgaccaaagccttatcttaggtgcaggaagggtattcctccatcgtctgcccctccaggcttccagtgtcacctgtgggggaaaaacaaatcaagagggctcaagtgggtaaaggtattatttgggaatgctgaagccagggaaaggaccacggacatggggagagggtaataccactggagaaacacttgtcaaggtcacagcccagagacacagtcccattgaaaggcagagatccagtcataaagctgtggaatgctttcctgcccctacaccttaccaccactacaaccaggctccagggaaataacggcgggttacaactgaacgtgctgcaagacacaggctctccctgagcaggagcactctgttagcctcagattcaagtgggaggacaaagggagagagagatgggaattctcagaaagaattaaaaggaaatactagaaatcaaaaacactaacagaaatgacgaatgtcttccagaagctcatcagtagagtcagcacaacaaaggtaagaattggaaagcatgctgaaaggtcagaggacaacagacactttccaaaacggaatgcaaagaggaaaaagaacatcttactgtgtgaaaattgcaaaaggttcgacctattaatctgaatcccagacagagaaagaagacagagagaacagagcagaataaacgttggaagcaataagggcctagcgctgtcaaaattaataacagacaccaaagcacagagtcaggaatctctcagcatatatcaagcagcatatataccaaatacacacacacacacacacacacacacacacacacacacacacaacacaaactcacgtctagacatagtgaaactgcagaaaactaaagaggaagagaaagtctgaaaacctcaataaaaacaccttactggtagaggaacatggaagaaaattatggccaacttctcgtcagaacccacgaaaaaagaagagcgtagactgaaatactaaagtgttgagtgaagaaaaatatcacctagctagaattgtatgtcctgcaaaattatcattagcaagtgaacaggaaacaaagactttctcagacaaattaaaatcaagcaaattaaccttcagaaactctgctctgggagaaatgttaaaaggcagaaggaaaataagatagatgagacacttgaatctacataaaggcagggccagaatcagtgaaggaacaagtggaggtaaaatcgcaccttttctgttgcttattcttgcaaggtctaaaggaacacggtttgtttaaaataatactgacaatgtatttggtgactatatagcatacggataagttcatgaggggttaattgggaattctgtcgggttaggtagctgcactgcacattaagtgatgtactgttactggacggtggactgggataggtaaatatgtacattgtaaagcctagggcaaaaagcagttctaaaagccatatgatccatatgctaagagaggctaccaatgcccaggtaaaacctgaagagacaacaacataaagaaagagggactttttgcttacaggggatatggttatctatgtagaaaactccaaagaattgcaacaaactgctgaattaataaatgaggttctcaaggtcacaggacacaatcgatatattgatgatgactgtttagctgtatatgactagtgaacaatgagaatttgatttttttaaagggcaacttaagtacctattaagtacttaggtctaaatctaaatgtcaggcataggatctgcttgcagagactacaaatattgatgaggaaagaaaaaacaaagaagatctgaataagtggagagagatgtcatatatacggactggaagatttgtaattgttagaagatttcaaatcctctgagactgatctattgtaacatcagaatcccaatcaaaattacagcattcactttgtagatatcaacatattgactcgaaatttcgtactgaagcacaaatgtgctagaatagaaaagccattctaaaaaaaggagaatggagttgcaaaagtcataagatgcgattctaagacctactataaaactacagtaatcaagacagggtggcatttactaagaatacacacacagttcaatgcaacagactagcaagcccaataatcgaactgcagaaatatttctcaactgatccttgacaaaggcacgtgcacaatacaatgggaaaaggatagccttttcagtaaatggtggtgagagatttcgggcccatatggaaaaaacattaacctagaccaagaacttacactttaacaaaaattaactcaaaaaggaccaaagtcccgtatgtaaaattcaaattataaagcacatgaaatataaaaatataaattataggccaggcgcggtggctcacgcctgtaatcccagcactttgggaggctgaggcaggtggatcacgaggtcaatcattcgagaacaacctggccaacatagtgaaaccccgtctctactaaaactacaaaaagaaattagccgggcatggtggcagacgcctgtaatcccagcttctcgggaggctgaggcaggagaatcgcttgaacctgggagtcagaggttgcagtgagccgagatcgcgccactgcactccagcctggacgataggacgagactctgtctcaaaacaaaacaaaacaaaacaaaacaagcaaacaaacaatatatataaaataaaaaaagaaatatagaaatataaaacacagggaagaaaacacaggaaaaacatcaacatgtctttgtgtttcctgatggggttttagtcacaaaccctaccacagagtctgtgaacaaaaagcaattatttggagtttgttaaaacttaaaacttctgctgtgtggaagacattactgttaaggaagaaagataacctaaggactgaaagaaaatattttcaaagagatatctgagaaaagacttgattccaaatattcaaaaaactgtggacattcaaaaaccaaacaaccacaaataacccaatttaaaaatgagctaaaggtctgagcagacacctcaccaaagatttggaagtgataaatgagcatgtgaaagaatgtttactgttatttggcattgatagataaatgcaaactcaaataataattacatgacactacacatctaacagaacggccaagacccccaaactgacaaaccaactgctgccaaggatgcagaacaggaacgtccattcatgtaaagtgggaagtctctatcttccagcaaatttggaagagagtctgcttggtccttaacaaggctcaatagtcttgccacactggtggtccagcattctcgctattaagtgtttgcccagtttgcttcaaaacgtacgtgttgtcaaacaaaatacaaatccaggattagtaaagagaaactttattcaaaaggatgagtagaaggaggcaagctatgtggaggggacttttacaggaggacatgagtaggtaaagcacaggtaatgctttagggcagtgaaaccatcatgtgcgttatagacagaatgtttgcttcccgcccaaattcacgtgttgaagtcccgactcccagtgtgatggtatttgcaagtgaggcctctgggaggtaatggggtttgaggttatgaggtcatgagggtggagtctttatgatagggttcgtgtcctccgaagaagaggaaataaaaatagctgtctctgtgtgaggacagggtgagataccctaatgatggttgtatgagacaaagcatttgtcagaatccgtggaaactgacaggacacagaatgaaacttaacgtgtttaatcttttaagacatcattagggaggtagggaactatcaggttgaaatgcagaatgtgacaaaaggttctaaccttaccaatgaatgaaaagcttcactgaaggctgtgaagtacaaagtgctgatctaagcaactttggaaatgaaagaagtgtgtaaggctaaagacaaaggcaattgtacatatgcagcatactcgactagacaaacctgttgccggtatggacacaggttgaaaaatctgacaccgttctccatgtgtactggaactgcaatgagtaaatggatggtggagggtgagaggcaggtttttcactgctggagagggaggtgcagatcgtaatgtggcaggggcaagaatgattcgtgctgcaatggaatagagttgcagacatgggtaggaactcatattcagcttattatagatcctcatggtcatgtatcaaaatatttatagaaatgtgtacatacgtgggttagtatacatacatacgtatttcctttctgcttcagcagagagggcctaggaaccactagactctggcagctacgagcacacctagttgccagacgttggtctctgataccattttctaataaaaggaaacagaaatccttggagaattggctgatcctaggagctagtaaataggccagaccagcctagaacatatgcaagacagaaatgtgcaggatgagccacaaagcaaggaattacacaaaatggagccccaaataatgggagcataccaacgggacctaggggtgaactgaacgtgcacccagtggccacaactgcaagaatgataataatgaaaaagaaatagcaaagtattggattataatctaaagtatcaagtaaatatccgtgaaagtatcatgatatacataaacgattgaataaggaaataaatgcaggagcatagatagctgtgccatgaaggagaattccaaagaatgtatgtagatactctgcctcaaagaaaggatttaaaacttagcaccagttaggtgtgaacttcgcttaatgacttccttccaaagagtagcatgtggacaggggttaaaagagcaacttttcatgggagcaccctgtccaacactgcttctgccaggtgaccaaggtcaacttacacaatcaaaactgatgttgatattatgtacccttgatgcgatcagacgaaaacagctctttacctttgtggtgattctccggtagctcacaacatcagtctaatcatgagacaagcattagaaaaacttgagttgaaaaatattctagggaggccggtgcaggcagatcacttgagtccaggagttcaagaccagcctgggcaacatggcaaaaccttgtctctacaaaacacacacacacacacacacacacacacacacacacacacacacacacacacacaagtcacaaattagccgggcatagtggcgcatgcctgtagtcccatgtactttgggaagcaaggaaccctgtctcaaaaaaaaaaaaaaaaaaaaaagaaaaagaaaaagaaaaaaaaaaagatattctagaaaatacctcactagtgaccctgaaaactctcaaggtcatggaaacaagcaaagtctgagaagttgtcccagccaagaggaacctaaggcagtatgatgattaaatgtagtgtggtaggctgcatggtatcttggaacagaaaaaaaaaatgatattaggtaggaagtaagtaggaaacctggaataaagtgtggactttagtttttttctgcctctcaaataccaccagtagggagcagttggggctgctgtgtcggcaggtaagccaaacacacaaaaatagcaccgcaaatgctctgaaaataaactttttaaaaatcccagaacctaaaaatggacaccagaatctacatgctaaacctaaagaaagtagctgacttctaacatcaaatatttgtctcctgtccagagactcctaaagtaacaagcaaaatacattgtatgccatagagcatagcccaccatgtgaagaaccaggaataacacagcttgaatgaggaaatagaatccagtggtaccaacatagagacgacgcagatgttgccattatctgacaaacattttacagcaaccatcataaaaatgcttcattatgtaattgcaaatagtctggaaccagactagaaaatggaaaatctcagcaatgagtagaagatgtataaaaaagaaatgatggaacagaaaacgaaaacaataacagaatttggaaacattgctggatgcactcggtaagagacctgtgatgacaaaagataccatcatcgtaatggaggcccaatcaataagattgacggccgggcatggtggcttacacctgtaatcccagcactttgggaggccaaggcgggcagatcaccgcgggccaacgtggggaaaccctgtctctactaaaaatacaaaaattagcttggcgtggtggtgggcgcctgtaatcccagctacttgggaggctgaggcaggagaatcgtttgaacccgggaggcagaggttgcagtgaacggagattgcgccattgcactccaacctaggtgacagagcgagactcttcctcaagaaacaaaacaaacaaacagaaaataggactgactgtgcctgagcgagagagagagatcgtggactgattaaaagctgaatggatcctcagcgaagttaggacaataacaaagttccaatatccctacgactggagtaccaaaagtagagagtggactgaaagaggagtataagaaaagaaggctgaaaatatccaaattttagtgaaaaccataaacccatagattctggaaaacgagcaaacttcagataagacaaccacaaagcgattcacaccaacacacacatcatagtcagtttttgaagctgataaaatcactgaaagcagcaagaccgaagtggttcattgattataggagaacaccagttttaatgagggcaaatgtctcctctgaccagtggcggtcatcaggaagtgtcccgaaaagtttcagatgttgaacaaaagtcctgtcagctgtgaattttgtatccagtgataccatccttcatggacgaaggggaaatcaagacattctcaggtaaaggaaagcattttgtcacgagcagacccacggtgaaagaatggctagagtaggtgcttgaaacaaaagaggaaagaataaaagatggcctctggaagtatctatcagaaaggagtcaagaccagtagaaaaaacacccttaggggacaaacactaagccaccgttttccttgtgaattgtggaagtcatgtttgacgattaaagcaaaaactatgaaaccatccgatactccagacaacgttgtctacaagcaggaaggcagaggggctaaaaggggctgatgcttctacacttcaatggaagtgatgagaactggataccaggagcctgtggtaagtcacatatgcacactgaaaatcccagagcaaccactgagacaattttacaaagccaaacactcgaaaacactttcggaaatcaggataaatcctgcaaggtgtacacgtaagccacagaagggcaaaaaaaggaggtctcggttagccgagacacggaggaaacaaaagaaaacaaacaataaatctgtggacctaaacactagcccagagatcatggaaatgaactagaaacatgtatgaaaaggtagatactggcagagtcagtgagaaacacggtctgattatcccatgtttatatgaaactcagttccacttcggtcgccctgggtaaatgaaaaggatacaacgggtgggaaaagtcacatcaggtaaacattaattaaaacagcagaagtaggtatgtcaacattaggtaaagaggacttcatcgcaacgaaaattacaagaaaaataaaacgctacagccgaataaaagaatcaagcccccaagaagactttagaagagtctttccgtgcccctcccacacgcccctccaattacagtgtgtgggcgttcctctctgttcccagagcccctggttcttatttctgtcagagcaaagtgtcccaaggtgttggggactgtatttgcatacacctgatcctaaatgaatgtgagtgctttggaaagcctgatgcatctccacatcccagcgcccaggtgagggtatctggtgcccggcaggtgtttgctgaacgcctcatgactgcctttcaggccagcgaaggctgttgtgatagggtcaagggaagggtctctttacatcgcattcaacaaggggccaatcctgctggcgcaggcaaggaggctgctcagcgactgacggggaaatgagggtggggtgtgggcacgcgctccggaggctgcaggcgccatgggcagagtgaggaaccgcgccactgctcagcggcggaggcgaaagcggcccggggatcctcccgccgcctgcgcggccatcgcggtcacgggcgccagccgcgcgcagtgcccccgggtccaagtcggggtcgggagccacgcggcggccaagaggtggctgggtaggtggcgacggaagcgccgctggcggcgggtccggaaggcgggccccagagacctgctgccctccgcgccaaccccggacccgccggggcccgccccgtcccccaaggatctggacctgggcgcacagcgggagcgctgggagacgttcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaaactatgtgtgttggtgtgtctataaagtccggcttggctatgtatggcaaggcttggtttttgaaggtacttggtctcagattatttcagaaggtggtggtgactctggcttttgtagtagagaaagcttccccagggtcccctaccttttgatgaggggaattagcagagggtttacacatttggcctctggggacacactacctgtgtttgaatcctggacctgccgcctgctcgctgtataaccggtatcgagtagattaaaccccattcctcaacttgctctttcctcaagaatgttaacagctaacagagtgtttgttcttggggtaaacacagtgccttgccttgactacctgatccatgaatgcttgttttctcaatttcaggcccccaaaactcctcctatcaaggcacccagacaatatgaaaccgcattgtttaggggcgtccatacacatgggaaaaccatgaattaggcagtgaaataatttaagccagcatcagattagggtttaactctatggaggaggaatggctttgagtgggggtggggggaggggagggtgtcctgcattcctgttcctcttgctgtgtaacaaacagccccacagtgagtccatacaatgacgagcgttgtatcatatgcatggaatttcagaggcaggaattcagaaagggcacagtggatatggcttgcttcacatgagtctgggacctcagctgcagaaacctgactggctggggactggaaccatctgaaggctcattcactgacatccctggtgcctgcatggagaggactggaagactaggcctggcgagtggagggcctccgtattaccactccgtggcctttggcttcctcacagcagggtgggcctcccagtagtcaggcttccgacctcatgactcaggctccaagcggcacttttccatatccaaggtgaatgttgcatcacctctcataggcaagactcagaagtcatgttgagtcaactgtgtcatactctattgattagaggtgagtcacagccttttcagattcaagcgtgggagggagattaaatcgcaggtctcggtgtgaacggggcaacttttatcacagcacgagagatgggagatatttttgtggccatacagtctggcacagtgggctcctagggagctggttatgtttcattcggttctcccacatggtggccactcagatgtgtttaacgggtcacatatttttttgtgtacagctgtgtatgattgaagacataataaggaaacaaaataggtgactgactcctatctctgagcaagaccaagagcagactaaatgaatgactggaggtacggagggaagacgacagtcagaagggggctggctggttagtcctggagccgaccttggccatgcccacgcaaacacagcccagggtagaagtcttattaacttcgggaccatcggtatttctgaccccccccagaaatctttaacttcctgctagttgcatatgctggactgcctcagccccacgccactgactgtcccttcccctctcctttttaagcccgttgttcacttgttcatccattccacaagcatttacagtgggtttggaatgtgtcaaacagaatgtgagaaggacttaaggctatggacaaaaagtggagttgggtaaagatgctcaagcgaggttcttagaatgtagctcagctcttccatagaataccatagggaagggaatggaaacacccccctctcagtagaatggaagagcgcatctggcaccgatccacaaaggccgcttgtttgtatgctggctcttcagatgacatcttaggatgaactccagactagaaggtgaatttcctttctgacaagcgtcaaggaaagacttagaaatgtgtttaaaaaggaaaattcccagcatgaaaccaaatggaagacaagatcactggtcataaaatataactagaaatagatgtaatgaaaatgtttattattatacataatttctattattttgttttattttttgagacagatattcgctctggtgcccaggctggagtgcagtggctcgatctcggctcactacagcccccacctcccctgctcaagtgatcctttcacctcagcctcccaagtagctgggattacaggcacgtgccaccacagcccgctaatctcttgtattatttgtagagacggggtttcgccatgtgaaccaggctggtctcgaactccttagctcaagcttcccgactgcctcggcctcccagagtgctgagattacaggtgtgatacataatttgtacatgtgcctttgaaaatgaaaaatatgaaatagacctaaggactctctctctctcacaaatacttcacgtgtgttcctttatttacttctcactaaagtctttcagaacacctattgttaatctcaattggtggagaaagaaactgagacgctgataatggaaggaccaagcccatggatgccaagagggcaggtggcaggaagaagttggaaagccagggtgattggataccatggtcagtaaggactggggaaaaaagtagctctcaggcacttctgccccattcatcctggcccctctctgttttcatggatccaactctctacgcatttcaccctatctcctcctcacatcaaaagcagctcttcatccctggccgagatcctgtggccagctgcccagtgcacgccaccatgacgcgggcctcctataaaaatctgaaatgaccgtagattggatgttctgctatttcatgagcccccacgttgtttcttcatgtgccaatatacttgtgtctatggccacaaacaacctgcatatcacagtttggaaaacacttattttgaggacagaggctttgaacggatatccacctgggcttgtgtcccaactctgctacttgttcctgcctgaaatggcaacaagttttaaaagttgcattcaccttctctgtgaggcttcagtgagagcatgcccatgaaggaatgatggagcctagcctatataagcacttactgcatatgagccctttttattcgtcttcttgttgtttgagcaaaaatccaaatgcagcttttgtcttaactgcacacagcctgaggtgtaggcagtacttccaggaccactatctcaggagccgtcatccacatttctttgatgtaaaaactgagcgtaaagcaattcagctacaaaaaaagtaggaggagggaagaacataggccttccagttccttattaagttccaactttccctagacactgtcgtctcccaatgtatggcgtgaggaacagagatagccttttccattcaaaactgtgtgacgggggcacgggtcagcaaagtacagggtcctgcaggagcacagcgatagggcaccctctgtcagacaagtcagtacaccgttctgggccttggtttcctcatctgtacaacggcgacagaattacatatatcttaatttgctgagcattttaagtgaagtgctggaaggagaatatagagctccatgccctgatgcgtcaaattgtcaagaaatgtcatccactgttcctaatataacttatgtcattataccccgatatttggaccaaagggacctagaccctatcgcttttgcctgggactccgcagtaagtgcctcaatgagttaccctaatacctttcccctcctctattatgaccaggatcaaggtttttctgggaatggcaccacagtttctgtgactccaccacaattcctgagacttgactctgagccactatcacagtctgcatgctcttcccaatgtgaggtgtgcggttggtggggttgatgccatcactgtctctcacttaaatagtagacttgaagtgagcgaaggctgttctcatgggtcaggatgtaaaagatgtaagcaacagtgacttcggacccaggagtggacattggagaaattgttaacagccggggggagctgcagataccagctggggaaaaccaaattatagccgcatggtctctgagataaactctcatcatcacaaggtggcaaattcctgcctctagaagacccagggagtttgctcccggcatcccagagatagttgtttaggactcgcatctctaaaataagtatttccagtatcacatgcaggcacaagggtgtccaccggaaaaaccgtcttgcctgagtatatcttcttgcacactggaaaatcttgcctagagacactttgacgaacattctctttcccattttctttctgccaacctgaataagatcttgctaagtatgggatattaaaaactatgtttcaggagattgcatttctggctacattggaggaaaaaaacaccacattgatccttcccccgcaaagcaacgaaataaccgagatgacaatggtttccaagatattggacctaatgcaatggaagagagctatctgcaagacagaagaaagagacatgtcgagccgcacgcctgtctcagcctactggcgggaggaggaactcaggcggagccacgttgtctccccgagttgtggggtacgtggtaggaacatgagtcctccttaaaaaggaaagaaatcctgccatttgtggcaacatgaatgaacctggagcatgtgaggtcaagtgaaataagccaggcacagagagacaaatagcaagtgatctcacttatatgtggagtctcaaaattggaactcatagaagcagagagtacaaatggtggctactggaggttaagggttggggggcatagggagtgttggcaatggatagaaaatttctgttagacagggggaataagttcaagggagctattgtaagtcatagtggttatactcaatagcaatagattggttatttgaaaattcgtaagacagtagcttttaggtgtttctacccacaaaaaacaaacaaacaaacaaaaaactgataaatatgtgaagggtggaatatgttaattagtttgatttggccattccacaacatatacagatatcaagcatcctgaggtacaccataaatatatacaatgtttacttgtcaattgaaaaataaagaaagaaagtaatttcacaaaatgacgagggaccgccagacgcaaaagaatggattggaccttacctcacactacatacaaaaattaactcaaagcagatcagagacctaaatataagagctacagtgataaaactcttataaggaaatataagactaaatcttacatttctcttccgtaagtcttacgttgtgaccttcccttaggcaaaggcttttgtgtgtgtctgcattcaacaccaaagcacaagcaacaaaacaaaaaagtagataacgtggagttttagacaacccgtagaaaatgcatctgatcatagatgtatccaggatatacaaaggactctgatgaatcaacagtcaaatgatgacctaattcaaaaaggagcaaagaatctgaatagacattttgccaaagaaagtacacaaatggccaataggcacacgaaaagccacccacaatcatcattagccagtagggaaatgcaaatcaaaaccacaatgagctaccacttcacactcagtaggatgacaagaataaaaaagacaggcgataacaactgctgacaaggatgtggagagattggagtcctcatacactgctagtgggactataacatatagggcagcctggtttgaaagaatttggctgctcctcagtaccagaaacacaatttccatatggcccaggaggtccactcttagctttctacaaaagagaaatgaaactctatgtccaaacaaaaacctgtacacaaacatacacggtatcattattcctagtggtcaaagattgcgagtggcgcaggcgtccatcagttgatgaactgacggatggaatttagtttctccattcaggggagtgtggcttggcaacaaaaagggatgaaatactgatacatgccataacatgcgtgagcctagaacacgtgatgctgcatgaaagaaaatcacaaaagaccacatattatgtgattccatttggaaaaacgtccagtatatgtaaacttatggactaagaaatttgatttccatttgcttggagaaggagaacagggtgggaagtgactgttaatgtgtatggggcttctttccaaggtgattataaggttctaaaatgagattgtggtgatggttgcagaaccttgtgaatatgcagaatgaaaagaaaaacacctgaattgtacacttgaaatgggtgaagattatggcctgtggattatatgccaacaaagtcttttttcaaaactaccatttatcgtccactttatgtacacttacctctatttatttccaaatgtacatgagtaacattcatgtccactaattggttgagacttttgaaaagcactgataacctgatgtatttttgggagatgagaagcagaaatcaatggttaacgtgtagtttggcaagagctgtgaccgctgtgaaacttcatttcctcatctttgaggtaattacttctactttgacatgacattgtgggaattaaataacaatgaatatgaaacattcaactgagtgcctgggattaacagccactccaggaagggtgaaactcatattacttactagagtacggggaggattctttaagaaggtaaatgtttaaacaatgtactgagtctagtatgtcaatttcttttttttttttttttccaagaaagaacaaggttcaaggtatctgtgacaagttaccctggtgagtgcaaccattttggagttataactgtgttcaagtcccggatcccacttactagctgtgtgaccacaggcgagtgactgaaattctcccttgcagttgtctcacctctgccaactctgcatcgctgccacagcgatactactaccttccctggagggttgctctgagaataagagattagaatgataaaaatggagtttgtcactcctgcattttcactttctccctttctaaggtctccttctcctgattctaaaaatgtattcaagtatccttcaacctaaataaccttcctttgtcttccgctctacctaccaaactcttcctcatttccttttaaatgaagtaccctggacttctcttcctcactcttcaatttcatgtagtctgtcttcattcacgtgggcccccgagctgtcccaaccccgagctgtccataaggtaacaaggatgtcctaactaatgaatcccaatggactcctctctcccttatgatctggccttacatctccacagcataaccctccctccttccttcacgtctgtggtactactttttctcctagttactatcctattcctcggagatttctctctccatctccttcctggacttctgtttccctgtgttcttcagtgttactattccctaggtttggtcctcggccagctctttacaggctatcttgcctacatcctggggtgaattaactcacgctcctggcttcgcctgactgattgttgagaggattcacaaacgtgtattcctggtctgaaagtaattgctgagcaccacactgaaacatccagttgccttctgtacatcctggatgttttcacaagcacctcaaacgcagatctatctctcagtgcactcccctcacctgcaaatgtgtgcacgcccctgtatttaatgcttcaactgagtactctagcattgctcagtcatccaacccagaaacgttcccttaccaaagaccggatgaacttaggcctgaagtcaagaaacagcagaagactggggaaaagtcagatgagtccggagaccagtaccacggacaatcgtagacatcaacctcaaccaagccctatatgggggtcagttagtctactgtattttcccaaccagctctctctccaactacctgtaatgaccatttattacacaactgtacgactctggaaacccctgatctcctttccctcattctcagaagctggccgcacctcctattttcctgagaaaatccaagacctcaggaaggactctctccatttcctaccagcaattgtaaacacctacctgcatgtacaggtacaagttgttgcctttcctccatttatgacagaacatccctcctgctctttccgggtgatccttcaatgtgtgctttgaatctcactgctcctatcttcccaggaatcttatagcatccatcatccatttactcccctgattgcccctgtcaacttcaacctgcccttccaaatatatctttccaatagcactaaatcacgcactggtcatgaaaaccttataatggtaaaaatcaacaatcaaacgctcaaagcaccctccgtcttctccattttaccctgcacccactacctcatctccttccattcacaatgaaacttggagctctccacacttgtcattacttcatcacctattcatcctacaactcattcttttcccccaaatcccaatgaaatggctctctcaaaggtcaccatggtgttcataatgttgagcacaatggaatgttctgtcctcatatcattttatagctccaactctatgaacaggaggaaacactcttctttttgagaaactaccattgagttgtcagtttgcaattttcctttgaatgggccatactttcaagttcccttgtaggcttttggattcttttgttgctgctgaaaactaggtctttgattgtggtaatgtggtaacactgaatattagatcctctaccttctccaggatttgcagttgctgatttctgaaagctgcagtcattgatttgtctagagggttttccaaactcttttgggagagcctgcattcgttgtcacatgtggccactgaactctctgttcctttagtttgttttctgcttgtattttgacagcaatttccttgacagcccagagcttaataaaaaaaaaaaaagcaaaaagttcctctgtcagcctttgtggattcgctctgggctgcagcactccttcaaacctcagccaggccacttacaactctgtcttggctgtcacttcctgtttagactgagtccagagatcagccggtgaaagcttagggtcttctcgggtctttcctgagcatgcatccaatcctgggcacgcacctggcttttgacaatccccagggtacatgactgcttccgaatgatctaatttcccaaatggcctgtccgccagcgtatcccccaggttttgggttatctgctataggtttcaactgtagtttctgcctcacgcagttgccgttttttgatttgccttataaggttttcaggagctgcccaagctttttctgccctgacttccctgttaggtcaaacagagaggagcattttgcttctgtccttcaggaagcccctggacgggttagaaccaatgaaaaccatgatttttgcataagctctgctctctccttccggaaccaggtaccagggttccacacgtgggatgcaggctgctgggtgcaatgccgccaccaggtcagggagaaggtggaacaagggcaaatgaaaatgctacaacgtttacctatgaaacactcagatggttgggagccttagaattttatttccggcttacaataattttacttgacatgtcgagacttataccatgccacatgctttgctaagtacttagcacgtagtatgttatttgagtcttacaaaaaccctatatggttttttcaatatctatatcactgatgaggaaactgaggccacagagaagttaggtcattgcacacaagtaacatgtggtagcacggccagtttcacgaaactgcaactaaagtggtcccacacggctccatgctcagaatgggtccctgggcttgcggtttagtgtggctgtcttgaaattcttaactatttctttccttgaatttgtgcttggtaggtgaggtgtgatgaaacggtgcagtgtgtgctggggtcctggagcctcagctatcatgtggtccagcttccaccacctccaggcctcactgggacaggttctctgctgcccaatcacccacccaccctctcagactccccttccctctgccaacccagcgactgctgctgcacttcaccctcaggagaaggcctgggtgtgggtgcagggaggggcagggtgggaatgccaagccacagggcagggctctggacacctgggaggatctccactcaccctatgcgtgtccccttaactgaggcagcaccacattaaattacaactacaaaaatcctgagaggtcaaaacagagattgagtcagaaaagaaagtgagattttgctgcttctgaacagtggaccccacatgctcctgttatatgaggtccctccttatatcgtttgacctgcttagtagagaagggtcacaaattcaggcttgcatagctccaaagcctgttatttttttttttcttttctgttctttcctttagcaaagattaagaaatggaataggtgatacatgcacacttggtgtaaaattccaaagtttctaaactatgtgcaggcaacggattcttctcacctccattgctgaaccatccagaactcattcccaaaggccactcctctttcccaccaggcttttagatacccttctggaggaacatcactggtattcaggcatatacatcatccaaactcctctttctgtattaaggcgtgtaccaaacgctgtgttgacctggcattttttccatctcagaatgtctcctggagctgagtgcggtggctcatgcctgtaatcccagcactttgggagtccgaggtgggtggatcatctgaggtcgggagttcgagaccaacctgaccaacatggaaaaaccccgtctctactaaaaatacaaaattagccttgcatggtggcacacgcctgcaatcccagctactcgggaggctgaggcaggagaatcacttgaacccgggaggcagaggttgtggtgacctgagatcgtgccattgcactccatcctgggcaacaagagcaaaactccgtcaaaaaaaaaaaaaaaagaaagaaaagaaaaagaatgtatcctggagtactttctgtgcttaatacaggcaaaagttatagcgtgcttgctatgccattgctgtaaatgcttcaaatcaattaaactcatcctcaccaaaacctagggaagtaggtgctttcctcattttgtgcatgaggagtgaagagcacatgcaattgacattacttgccgtaggtaatacttctaaacgagggaagaaccaggatttgcacccatgcagtgtagctccacagaggtaaaagcattctgctctatgccatgcctgcatggtatcctttgatacggatatatccttttctttatttagccggtgccctgttgacacaggggtttgcccaggcttaggctattacagacaataccgcatcgagtaaactaacatgttatatcattccatacaagtgcaagtacatccaaaggacaaattcatagcagcaggatttctggaggaggggggtaaagcacacacaatgtggacagatactgctaaattgccttctctaggtgttacatcaagttacacccatactaacaatgcaggaatgtgactcttcccatatcctcaccaaatcagtctgtttcaaacatttgcatatctgtccataggatagatcctggacagtattttattgtgcttcagaaacccatttctcttattaggagtgaggctgggaagttttatatacatttgggagctttttgtgtttttctttctgtgaactgttcaggcatacatatacagagactgactagctgtcctccagacctgttttcttttcctcctggggtttcccagcctcctggcaggtaactgtggctggtggactgaggcctgggcaatggatggtgggcccgagtggcaattctcccaagcatgattcataaaaacctcctatgagatcctcctactctttcttccccatctgctggaaagatgttgacacccagagcgacttatagagccaggtgttgaagatggcagagcttctgtcagcctggtcctagattgttttcaaaaagaagagccaaccctccccagtcctgtttccttttggaaaaatgtaggcaagaaaaatgttcatagtgttaggccactaagaggttggagttcatctgttacagcagctagcgttatcaatgacaatagagtaggcttagttccttttttcaaaaaatgaatccactgatggtatttacttattagggaaatccaccctttgtctgcgatatgattggcaagcacttttcaactttgcttcttgaattttatctttactttaggtggatttagcttgcagtatcttcttctagtcttcatgcacttaaacttattacctcttcctagtaggaattccggtgttgtgacatacctccaaagactgtcaactgcaacactgcatctgaaactctctcggagaggctcatagattccgtcttttccacaggttgtttcatcatgaatgaatgatgacttttaccaaattattttcttgtatctattgaggtggtcacatttagtttagttcttccctttaatctgttcaagtggtgaattacattcatttcttttctaatgttaaaccaaccttgctttgctagaataaatataacttggtcataatatagcgtattagtctgttctcacactgctataaagaaatacctgagactgggtaatttataaaagaaagaggtttaactggctcatggttttacaggctgcacaagaagcataggggcttctgtttctggggacgcctcagaaaacttacaatcatgtcccaaggccaagaggaagcaggcacctctatacaaggctggagcaggaggaagacagattaggaggtggtgctacacacttaaaggaccaggtctcctgataactcactatcaggagaaaagcaccaaggggatggtgctacaccatttatgagaactcggtccccacaatccagtcacctcccaccaggccccatcttcacacaatggattagaactgaacatgagatttggatggggacacacatccaaaccatatcatatactatcttttttttaaaaaaggacttctggcttttacagtatctttttaaaagatattgctagcctttttaacaagtaagttgtatgtgatattttcatatgtttttctgagacaaattgctttgaaatttgccattctcaaattatccttgtctagtttccatgtcaaggttcgcttagtaaaacacaaggggtattgtactcactagctctattctctgaaaaacttgtgcagtattggagtgatctctcacataaacattgacagaaccatctgggactagagattttttgtcaaaattgtttaattactgattgcatctatttcacatttacatttcaaatcatgtttttacatcttctctcagtttcagtattttaaatattttaccgtttgtccaattcctctaagtttttgatttattggcatgatggtctctaacggtgtgcctcccagttttgattcctgatattaccaatttgtgtgtttatttcttttatcttcacaagtctcacccgtggtttatgagttttatagactttttgttttttgcttcttgcttttgagacagagtcttgccctgttgcccaggctggaatgcagtggcgcaatctcagctcgctgcaacatccgcttctggagtacaagcgattttcctatcttaccctcccatgtagctgggacaacaggcatgtaccaccacacctggctaatttttgtatttttagtagagatggggtttcaccaggttgaccagagatggggtttcaccatgttgaactgtgctcaagtgatctgcctgcctcagcctcccaaagaactgggattacaggagtgagccactgcacccagctgagtttttacagacttttgaaggactgatgaagccctttgttaaaactctgtattgagtatttggtttctttctcatttatttctgtctttaatgattctttgtatttctttgtgtttattttgttgttatttttgtaatttctctagatggatgattaagtaattttcagctgttcttcctttacaattatatgcctttaaggatatatgtttccacctaggttaactgtattccctagctctatctgtgatatttgcattgccatccagtttaatgtattttataatttgcacacaggtgatgcaaagtcaggctacaagtgacagctgatttacttatgatttcctcctcctgactcaaaaagtgatggccattggggtctcagctaaaagtgaggaggtggtttaccaacatcaccacctttggtcagctctgagatatggctttcatctctagcggtgtcaccaaagcacagcttagttttacagctgtttcttttcaggtaggcattctgagtaaaagcagtttgaagtcctaggtttaatctgcaggtcctgccttcccttaagagatcctcactgtcctctgagtactgtatttgtttttgaatttttttttttttttgagcctgttgcccaggctggagtgcagtggcacaatcttggctcactgcaacctccacctcccgggttcaagcaattctctgcctcagcctcctgagtagctgggattataggtgcccgccaccatgcccaactaattttcatatttttagtagagacgggtttcaccatcttggccaagctggtcttgaactcctgacctcgtgatccacctgcctgggtctcccaaagtgctgggattacaggtgtgagccaccgtgcctagcctgtttttgaatttttaaacatgatttcacccaggctttgttcggttactattgccggaacattggcccttatgacctacttcccatttatgagagttaaagcctgagatcttggtgcaggtgcagattacaatatggagcagtcagacctatcttatttgttatttatgtagttctatgttcttattaattgcgtccctttgatctgagagggcctatttaaaatcctgtattgctaatttgtgtctgtttttccttgagtgttctgtatctttttctttaggaatgttggtgatatgttgctggtgcacagtaatcataagtgttatatctcccttggaaattgtactcttttgcaataaaatgtgcccttctttgtctgttttattgcattctaatcgtaattcattctggttagattttaagattgtgaatcacttttaaaaaattatctgcacttggccgggcgcggtggctcaagcctgtaatcccagcagtttgggaggccgaggtgggtggatcacgaggtcaggagttcaagacaagcctggtcgagatggtgaaaccccgtctctactaaaaatacaaaaaaaaaaaaattagcaggcgtggtggcgggcgcctgtagtcccagctactcaggaggctgaggcaggagaatcgcttgaacccgagacgtggaggttgcagtgagccaagatcacaccactgcactccagcctgggcaacagagagagactccatctcaaaaaaaaaaaaagtaattaattaattaattaactctgccaatctctgcctttaattggtgtatttaggcaatttacatttaaagtaaatattgatatggtagggtctcagtctgccattttattatttgttttctgttccctgtgtttctcattcctgtgtttctttgtttgcatttgtttggtctagtcgaatatgttttaaaattcaattttcactgttctgcaatacttttgagcatatcgccttgtatatttttttgaacacacttgttcttaaatttttgtggatacatagtaggtgtatttatttatgggttacatgagatattttgatacaggcatgcaaaacatagtaatcacatcagggttaatgggatacccatcacatcaagcatttgtcctttacgctacaaacaattcaattatactgttttactgatttttaaatgtacaattaaatcatttttgactgtgtcaccctgttatgctcaccttgtacctttttttagtggttgctctaggtattacaatatacatatgtaaccaccatctttgttatttaaagatttggcatgaagtgtttgcataaccttacttatgaagtttgcataatcttacttatgttaatatggttaggagttaggctttgtttaaagtttgctgtagcactaggattcaaaggctgcaatttcctccagtgtagttgtttttgtatcctgtttgcactatgggcttctctaagtattccctctctgagagagttttctatgttgcagttctttcagctataatttaatattattttactgatgccttgtgttggaaagatgtggggggaaagagggcattctgtaatatcccatttaaatctcagtggctttagtgagcctatttctctggcttctgtttttgtttttttcttttcttctcttttcttttcttttcttttcttttcttttcttttcttcttttttgagatagggtctcattctgtcatccaggctggagtgcagtggcgcgatcacagttcactgcagcctcaacctcccggaccgaagtgatcctcccacctcagcttcccaaggagtagctgagactacaggcgtgtgccatcatgcccagctaattcttctgtattttttgcagagacaggctttcgctatgttgcccaggctggtctcaaactcctggccttaagtgatcctcctgcctcagcctcccaaagtgctgggattacaggcatgagccaccacacctggcccacaagtgtcttctggtatatcttcattcactccttaggtgagaatgtaaagctagaggccgtttgagtaacaatatcctcccccatggctctggacaaggctctgtaaagtattccccacgaacacttagcctttattatggagaaggtgttactggaaagggatcccaatccagaccacaagagaaggttcttgtatctcatgcaagaaagaattaggggacagtctatatagtaaagtgaaagcaagtttatttaaaaagtaaagaagtctgggcacagtggctcacacctgtaatcccaacactttgggaggctgaggtgggcggatcacctgaggtcaggagttcaagaccagcctggccaacatggcgaaaccccatctccattaaaaatacaaaaaattagccgggcgtggtggcaggcgcctgtaatcccagctatttgagaggctgagacaggagaatcacttgaacccaggaggtggacattgcagtgagcttagaagtcaccactgcactctagcctgggcgactctctctcaaaacaaacaaacaaaccgtaaagaaataaaagaatggctactccaaaggcagagcagccccaagggctgcgtgttgccaatttttatggctatttcttgattacatggtaaacaaggagtggattattcatggctcccccttttagatcatatagggtaacttcctgacattgtaaactgttatggcactggtgggagtgtagcagtgaggacaaccggaggtcacgctcatcaccatcttggttttggtgggttttagctggcttcttcactgcaacctgttttatcagcaaggtctttaagacctgtatcttgtgccaacctctatctcatcctgtgactaagaatgccttaacttactgggagtgcagcccagtaggtctcagcctttttttacccagcccttattcaaccaaaattgctttgcctcaaatgcctgggataaaggctctgggcatattccagaatgactattctttcctgtcaaaaccataaaggtatcattctgaaatcactgtcagaacctggtgggattcctagtggtaagaccatgatagtgtggatcctgcatctccaagaatgcagctctccaaagttaattcaccctcatactaatccacactcaacctcaagctatttgtcaaaattacagtttaaattttctaccagctatggttcaaccagtttctgttcctgttaagtggatcttagctgtgatctacttagctgagatctacttagctgtgactctctggattcacctgcttctcaaatttcaggatggtggtttgtcctgacaactcggttgtctgctgggacctagaaaaattattgatttttaattttgtccaattttattctgtttgaaggatgagtgtgacaaattccaagcacattacatgtcagaatagcttcccgtttcctcagcaatacttgagtattgtctttagctcccaaatacttattctctctttctgaagctctggtgattcaaatgtttgatcttttgttttaatcccacagttctgtccatttttgtttacttgtttttccctgttttcagattgagtatatcctattaatctgtactaatgtacagattatgctgcattactgtacatgagtacagtacttatatacagattaataggatatactcaatctaaaaacagggaaaaacaagatataatcaggttcactgattatataaaatataaaacagggaaacacagatataatcaggttcactgattatatcttccatcatctccattctactgtagagcctgtccagcaagttattaattttgtttatcatattttttagttttataatttccatttggtcctttcctataatttctataacttgccagggattttcttgttttcatttacttcacggtaatccagacttacttcttcaagtaattttacattggctactttaaaatctttgtgtgatactcccaaaatctgactcatttctgttggtgtcagttgattgacttttcttgtttgagttgtgatttcccagttctaggtatgatgaatgatttttttattgtgtcctgtatattgcaaagagatccttaatcctttcatagcttctatttttgcacgaagttgctctgttaaggtttggcctgttggttctggcatattttcatgggctgtagttccaatggcatttcgtttaatgagccttttcaatgcagttctgggcttcattgttttactaaccccacttgagttcccgatgaattgctgtgggagctgcctatagaggcagaaggtgctttcctgggccacccagtgacattatgtaagaggtgtgggattcaggatccatagaatatagattatttccctggtctctttttcagtcatctagtaccactggccttcctaatcaatatcgaccagtttccccaggagagggaagtatgtacctgggccatctgctgctgctggttggagggccaggagctacagacctggctctcttctactgggggaagcgttggatatctctcttccactgggggaagcgtcgggagattctgcaactggttcaccttctgttgcagaatagatgtctggaaaatgccaggcctagttgctttctgctattgggtggaagggccacagataacctggcctggatcttctgctgccaagtctattgatacagacaggaggcagagaaatactgggtagaagatggcggttccccagcaaaggccccaccctcaagcctggaaaccgcagccctaaatgagaacggttatccctgttttcccgcccgaatgctgctttttccaaaaccacccttgctcgccatgccccctatcctgtacccattaaaaccccaaactccactggcagaagagcagagcagtgcagcagagaaggagagaagagaacaaggggccgaatgtctagaggagaagaggcaactgagcatcagagactacaatagatgtggcttgacttcagatggcaggactttggggaggagcccggagatgaccaggcttcaggggagatcaccttctcagctccccttcagctgagagccacttccaccgcttaataaagtctccacgttcaccttccttgaagtccctgtgacctgattcttcctggacactgtagaaatacccaggtacaaagagggcagggtgtaacagactgtcaccctgactccccactgagctggttaacatttagccatccacagacggcaaccgctaaaagagcattaattgtaacacacccctagtcactgccacggggccagggctcaaaagtgctcaccccagcctggcacccgcttgcctatgtgctctcccccctactacaagaggtttgagcttggaggcagagcaaaatgagccaccccacccccacactccatcacaaggcccagagggggtcaggagggaactgtcaggtctcactatgtctggacggttcttttcccttggatgaagactagggagacaatggccttggattactttctgccactgaagggagggcccagaggaaatgaggcttgttggcatcacctgtgcatgtggaaccacccacctgtaatcagcctgtgaaggtcactgggtgagttggccctctggggattagctgtagctgcagggaaataagacatgctgtttccttcattttgggatgcagagtgggttattctgcccaccaggccatgaatacccgttgcagctgctgctgattggttgattaactgaatatttatttttttgaaatagaaaaaattatgtgtgggccactttcacatccagtcacgactgtgatgaaataacttgttacaatcctactcactacagggaaaaagtaaaaaagctcgatgaaagaaaaaaatgggccaggtgtggtggctcgtgcctgtcatcccagcactttgggaggccaaggcgggaagatcatttgaggtcaggagtttgagagcagcctggccaacatggtgaaaccctgtctctactaaaaatacaaaaaattagctgggagtggtggcaggcacctgtaatcccagctactccggaggctgagacaggagaatcacttgaacccaggaggtggacgttgcagtgagcttagatggcaccactgcgctccagcctgggtgacagaaagaggctctgtctctaaaaaaataaaaagaaaagaaaagaaaattttacttgaaggcatcagagaacttattttgtgtccaggacatcagagtggaagaatctggaggttagagaaactcactgaggggaattcaactatcttgtgctgctttttccctcagataatttgctgaatcccaaactgcctgtgtgagaggacatcattccatatgcaaaacattagctaagaggtagagaagacatcagctcttcaggaaactcacggggctatggaaacaaaacttagagttcagacaaccaaacttgtgaatatttgagaagtcaagatctcaggaaaaagaaaagcagacaaaagtgagaccaatatggggtggttttcttcctaaaggcatttgtccacacttaagctacagaaaacatgtgactaagaagctcagcagacatcacttaaaagtctcaacagatttctcagaagtccccaggcatcagagaacttattttgtgtccaggacatcccctttgaccttccctatgatatgacacagtataaaagcccacaccagaagccaagcagattccagcaccatgccccttgagcttcccagcctgcagagacatgagctaagtaagcctcttttctttataaattacccagtctcagatattctgctataccgaatggactaagacatcaatcaaatggatacactgaaacatggagaaatgaaaattttaaacctgaaactaagaactcaatatttgagtttaactgagtactggaaacagaagaatagaaggagagggaaaggccaaacaggaatcacacatacgtgtaaagtttgttcctgagacatcacagatacaccacctgcatagaaggggcaaggacaaataatggtgaacatggtagctaatacctatggcaactaataccaataccagcactgtgtgatggacactgtctggactccattatccagagacagaatatacgtgtcacatatgttcaaatcattacatgaaatatgcctcacactgtgctgagcaaacaacagacctctttcccttcctctgttgatgtgtcccatggtgattttgggaatcttcagaagtggttatgaccagtggcacagggaaaaactaatatcccatgaagtcaccaatcagaatgctgagtaaaccacgtggcccctcctatttgagctcctagtccctcatacataacatggatataatgccaaattcttgctttgcagaactgttgtgagtactgaacaatgtagcaggttaaaaaaaaaggttgcctgaacacagtatgtggctcaattactatgaatttattcccttcagtccatattcaatccttgctcctgactgtgtttttgattctaggagttctactcctctctcactggctttgttgattgctgacccaatagcctttcccaccaatatcaggtggtaaaaacactgattttgttcaaggaagcaatctgtccaatcatggggggcccccttaagattcttctaatcatggatatcacaatcccctttgtccaatgatggttttcaacctcccttgcagctagtagtggatatgggacccagttctgcccagtgaggtgtacagggagtgtctgggaggcttctgtagaaaaagactgtttcttaaaaaggacagatgtgaaagaagagaatggtgatacttggaatgtaacagagatgcctggagccatgctatgacaagcatgaaatcaatagagtcaacttgttgaaaatggtgaagcagtatggaagccttgatgttttgtgggtctctgagcagctgaatcaggacacgtgtactttcaaccttcttatcacagaaattaaaagaatgaggccaggttgatcattggctttaaactttaatttaaactcatttgaaggtagttttagaaatactaatgctctggctccatatccagaaactctgatttcagcagtctatattgtgatggctttggacattttaaaaaaacattctgttttaaacactgtcaagcagacacatgacaagctattatgtgataaagaacctacatatagatcacgctccacttcaacagtcataaactcttggtcaatcttattcatctatacccactaacttcccccacccctccagcttagcttcatggaaattccagacatcctatcagttaacccatatatactgctgaatatatctgtcagagaaaaagacaacttaaaaacactacttaaaaatataatgtatgccattatcatgcctaaacaataatgaagaagtgccaaatatcttcaatatttattcacagataatatttctcttattgtgtcataaaggctaattttttcctttgagtttttcaactccagaccccatttagtctcacgcattgtaactggttgttatgtctgttaatctttggtaaaatccactctctccctctctttcttttgagaaatgagtcctttattctataatgtctcccacatgctgggttttgctgatttcttttcattgacattgtttaacgcactcctgtttcctatctttccagtaaattcagagttagatctagagtctccatcatatttagcttgatattttagcaaaaatacctcagaggcagagttgcataaatccatcaggggatgcatagtgaatgattgtctgtcctttgcaatgggagcagatattggtggtcattgcctagatcacttgtgtcatttgaggcttactgtgaagattattaacttctgtctatccttctttgttagacagaaatcttctctgataagaaacttctctcatcccctacttggtaatcaagtattatagtttatatgccaaacacagttaactgtttcaatttttgcctctgtttacccagtttcaaaataatgaatttattccctagcatctaatattttttagatatttttctttatttttaattgcctaataaaagttgtattgtgtacaacatgttgttttaattatgtattcattgtggaatggctaaattgggctaattaacatacgaattacctcactacttatcatttttttgtggtgaaaatacttataatctattgtcttttttttttttttttttttgagatggagtcttgctgtgtcgcccaggctggagtgcagtggtgcgatctcagctcactgcaacctctgcttcccgggttcaagtgtttctcctacctcagcctcctgagtagctgagattacaggcgcatgctgccatgctggctaatttttgtatttttagtagagacggggtttcactatgttagccaggcttgtcttgaactcctgacctcaagtgatctgcccgcgtcggcctcccaaagtgttgggattataggcatgagccaccacgcccagccataacctattctcttagcaattttcaagacctagaattttatgatggaggaaatgatattttcctttagagctaactatgcactcaaaattcaattgtatttgaatgcatgtcagttattatttttattgacactaaaattttccccacatgatgcaaacttcccatctgaatctgcctactagaacacaggggcagtcacaaagcaggtgcttagcaaatgtgtgttcaaagtatatcaaatgacttagtgaggtatgtcgacatcatacttgattgttttattataacattactgttctggtccttccaccagatgtttaaaactgacattaccactttgctgtctttggcattattcaggtattactgcatttggagacagaaaaactaagactcactctcctttactggatcttcctacttattagggaacaagtgacctccactaggctcatagatttgattatcttttggcttgcaaaattcatttcttcacattaccattaattatcattcacgctgtttgctctatgctagtctatgcagtcacctgctattgctctacttcccagcgacttgtacagctcaaattagcttgttccctaacatacttcctctttactgtagtaccagagctcctatgattgtagtttgtcaataaatcaccaagttcctcttctctgcttcttaatctctatgttttttattttccattatgggtgtgcattttgaggactaataagtgtttgggccttggccacatcaaagaatattttgtgaccagcctttttttccctcaaacttcaattttctgattgctaacatggatctaggagtttgctctcctgtgttattgtatgcaaattctgggatgtgtaagacatatatgcacatgtttacttggtgacttagtccattagtactactataacaaaatacctgagaccacataatttataaagagcaaaaatttgtttttcacagttctggaagctgaaagtccaagatcaaggtgtgggcattgcaagaattggggactgcctcagaatggataatatggtttggctctgtgtccccacccaaatctcatcttgaattataataatctccatgtgtcatgggagggacccagtaggaggtaattgaatcatgggggtgggatcttcccatgctgttctcgtgatggtgaataaatctcacaagagctgatggttttataaagggcactttcactacacatgctgtttctcttgcctgccaccatgtaagacgtgtcttgctttcccttcaccttctgccataattgtgaggcctccccaggcgtgtagaactgtgagtcaattaaacttctttcctttataaagtacccagttttgggcatgtctttattagcagcatgagaacagagtaatacaatggagatacaatttttcccttttaacctcaaacttgagctgtatttgggtaaggtattctcatgcttggatatcagacatttcagccctagctaagatttctgtcccatactttcctgtggtagtggtaggtactggtatttgaaaatgatgaagtttcttaagtgacatataattcccatctctgtggttctttgtagcttccacacatccttgcatctagcaccccagggccatacctatgaatgtgggttcacctcttagatcagaaaattgaggcagatagtggttaagaaaattaaacaaaacacaagattacatatggtaagtcttgcatttgaaccccagccatgtgacacttgtacaagtcagtgtttggttgatgttaacagaatgtactctgttaattagcacagggactaacatggggagttaggggtttataaatagtatacttctagggttcagagcaacaggttgttttgttttgttttgttttgttttttcccgacctctcagaataattaccacaatcatacagcacagttgactctcaagtagggctgccgcctctttcacagttgaagagttggggaatcaggaggcttccactgcaactgcaggttcttggcaaacagtaccttagttgatctcctggaaacaggaaactccaccagaagtgttggcccaagggagatatttttcccagctaggtctatacctccaagttatgcttgccttacctcacatttctctacacttagattggctttaagtggaatctgtctaaggtgcatcagattgacagaaggtaaaacacatttggaatcccagcagcaaaactctaggaaatggaggcttaagctttctagccatctcagcacagagaagcttatttgtgaatggggctggaacatacgccaagagaaccaatataaggcacagtgttcttaactctatgttcactagctcctcaatatttttctgttctcctcctttcagcctaccatacaccactgttacctaaacctggatgaaacttaagactctgcttgtgccccaagttgctcagtgatgctagatgtaagatggggaaagagaggaatctcaaaacctaaacatattatgtcctccagtctagtgctgttttggtttacctaaattctttaaaaaataattttattactcccaaatcagccacctcccccataccataagggcctattataaatcttcccctattcatcatttttcttattttagtcttccttcacaatttccagtctcctacttcaggaaagaaacacaaatcctcatgaaagaactacagtgaattatcctttctctcttaaatttattatatttccattctttccagataatctaagatttaaccttcttcctctatttgtgatttaactctgccaaatctccctattcctttctttatatatatatataatagatgatacaagccagtgtggtcttagaatcatattgtctgtgtttgaactccaagtccgctatttactagctatgtgacgttgagtaatccctggcctctctgaatgttattttcttatctgtaaaacagtgataagattaccttcttcaaaggatgatagggaaaattaaatgagagaatccatataaaataattgaaatatgatctacgcttaggaagcactcaataaaattgactatcagatagatacaattcaactatgaaatacaggcagagaatagagagagcatttatgcaaagaaaaaatctgtttattttaaatcatattgatggtggtggtactgagacaactatatgtgtaggtgggataaatcaaatgagtaattattttattttctaattctatctatctttccatgttatcattgagaaccagtattcctggtttggcaaacatttgtataattggtctggtacatcttgtcaaaccatataataaataaaccatcaaggactactagcatagtctcaaaagtgttcagaactcaaccagaagaggcactggcaaatgatcatcaataagtatagtaagcaaaatttatcaaaatgcctcaaatatatgtaaatccaataattcacaattatcccttttaaaatccttatttgtcatgtgtgtaggattctagggaaccaactcattattttttaaagctcctaaataacacgaaagaatcaagcacttttcctgcatttcctttgcaatctatatctgaaagtaacaaaactgttgaaggtaaattttttggaacagcactccagttaataaaaacagaaagaatgacagaagtgcaatatcacaattttgcaacctctaatgatatgtctctaaacaagtatcaataattgtggctaactgtaaaaagagtcacaacccgacctcatgtgcctcttgatggaaataatcaaaattcccttgaagtattcttgttaaaaaattgcacctgaatctgatcaagctcatagatttaattattgataaacaggaaatacagagaacaaaggaatattctaaactctaccatagacatacagtcagcaaagctgagaatgtaaaaaaacaaaaaaacaaacaaaaaaacctctctaccagtcacatcatccactttcctcaataaataaatgacatgaaaaaggggaagataggttgggtatccagagataaaaaagacttaaaagaaatatcaaaaaagcaggccaaattgaactgtagtgtctgagtgtacacatttgtgtaataaaactatacggaaaatcgtataggttattaccataaatgtcacaatagcagttacattgagaggtggaggaagtcatttgtgattgaacagggcacaaggaagccttctgggctggctggcaaatttctcttgacttggatggttgttacaagtgtgtttcctttctcataagtcaataacctataatttttaatgtgactttctgtgtttgtgctatattttacaataaaaaagatttttaaaggaggaaaaagattgaattaagcaatggttggatatcacctacactcttttttaaattttcctctttggtgaggaaaattctctcatttactgatgaactcttaggcagaaagactggagacaagcatcccatcacacaaaccaaaagatttttgtccaaggccaatctctctggacacaatctggtcagtgcttctctctcttgcgttgaactgcctcccctggaacctcatgaatgatggattatgaggacattcacagactatttctgacttctcctttatcgttctaacagtgaagtatcctctgttctctgagatatcactaagtagcagtcataccaatatgttcatgaccaatgcattcgacccaggtgaaggaaaaatcccagatgtctcctgcttccttgcatgaattaccttatgtgaacacggctgccaaaaccttgacaggttctcccagaaatgtccattctaggttcacacaatgtccaagaaggctccagcacttgtgtggagggtctctctgcacattctacctctcagttcttcctgtttattgtgaataggtgtgcacattctctttatgtcactgtaaataattaatccataaccggaggcaaaaagaatgaaggtgtggaaacagtacagagctagtataatagtggcagccccagagtgaaaacatcaagggtccaagtctgtcttttttcctacccctaaagtctggagaacacaattctcaagttataatcaggtacttggttttataatattttgctttgttgttggatttaaatatccaactatgaggccaggcgtggtggctcatgcctgtaatcccagcactttgggaggccgaggcaggtggatcacctgaggtcaggagttcaagaccagtctggccaacatggtgaaaccctgtctctactaaaaatatatattaagaaaaattagctgagcttggtggcggacgcctgtaatcccagctactcaggaagctgaggcaggagaattgcttgaacccaggaggcagaagttgcagtgagctgagatcatgccactgcactccagcctgggcaacaaaagtgaaactttgtctcaaaataaaaaaataaatccatctatgtgacaccatcttgtactaagcagattgtttggactgaatagtctttctaggtatgtcacaaaacctgaattcataaaagcaaaaggtgacagatttgagtacatgaagactaaaaacagattcagagaataagtttgtattttctatgtcagtttgcactaaattaatttacaaacaaggtcgctgaggctttgactcaactgttaacactttctgagagtgagattcttttgattagggtcttaaggtctttgttcatctcagaagtcttaattggtttaattaggctgacacctacagccctgtctcattaccataaactgtagaggggttcaacatgacactgattgtttcttagagcaaagccagtgcagtgagtaggattccaggccccccggaatgaagcaggaaaacccgaggcctgtggatgcaggatgtactagggaggtgctggggagtagtgcagataaacccagaattcagttggttggtaaaacaagagtgatctgagtcctgtgcttgtctacgtgatccaccattgaatggcaggccagccattgtgcaggcatctgcatatgaagtgactggaagcttcactggaacaaggatctccttggaaattctctcccctcagacagccagggtgcttaacatgaaaagaagttgtaaccctatccttaaactatagaagccatcagcagaagttacaggcttatgggggcccactggaaagggaaaatcaaaaggcctgtggatttcaaattaatgagtgatcttaagttgcatttcctaagttcggctacagactcatatatttcatgagtccctccctacccattccttgcctctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaaaatgaaaggctcaggccgtctttatttgtatagcagtagttcatgtaacattatccataggttcttgaagactacaacattaagcaaaacaatgtacagcaggtgtacatcgtacaacaatgcacaatgtatgacattgttcaatgttgttatgacattgttcaatgttgttatgacattgttcaatgttgttatgaccttgttcaatgttgtttagttatgacattgttcaatgttgtttagttatgacattgttcaatgttgtttagttatgacattgataaggggaaaaattcattttgttagatgttatttcacttgaagtcacaatttccaagaaccagtggactatgttaagtgaggacttactgtattccatcaggtcccatcacgttaagcatggccaaattataggagatttggaccataggtttacaagactctttatttttttaaaagacagggtctcactctgtcacccaggctggagtgcagtggtgcagtcatggctcactgcagcctcaacctcccaggctcaagcaatcctcccatctcagccccccaaagtggtgggattacaggcgtgagccactgtgcccagccttggctagactcttaactgtactccatcatcttaacaaacacagctcttggttttgttcaccatgaaacttgtgatatgggtcacaacccaataaggggtatggctattgagaagataaatgcttgcaatggggcctttggtcattgagtaaaaactaaggattagtgactcctgggctgggaaatgagatgatgtcacctttgtctctttcatgcttgggttgataggaaaggtgggaagtcatttttaaattcagatcatgacctacacttggggtcagaggcactggatacttctctgaacaacttcttgaggaaaacaccaattatggattctgaggtggctacatttattggcaagagagtggccttataacctgcaaataactgtcaacaactaaagaaccttctgtcttattaagtgggtagtgccttaggcacagcagtatacctggagagagagacagtttgctttgctgtcaaacctcatactcatgagctagttgaataggtgtggggactgctggcacaacaccctgggctcattcatgctcaggtaaaggcaatgtatccttctacattgtccctttgtgtgtacatgtacctccagggtgtctaacctgtcagagatagccacactggtcttgttggagcatcagtattttggctgtactgcccataggtcttcagggcacccatgtgggaaatgaggatttttattttgtcatacataagctaacctaatccacacggatgtgcctcatacgtcttggacccagttttttaatcattagaatgtcaatggcaagagttttatttttatcataagagctctatgcactgaacctcatacaaaatacaaaccatccagtacttggtaagttttgccctggaagccactttataagcaattatttttgctgctgcatcaatctcattgttttgtaattttagtgatttaccagtagtattttgtggctgtgttccactgataggccaaaaccacaagccaggacagaactctttgtctccatccaatttggatgatttcccatcaaaaactggctcctaaatgtctttctcattagccaattgtttagcaatttccctaccagacattctgaactgtttatatataaatacaaaaaccttcagagaaaaagacaatttttggaaatagattttagaaaccaattatttgcatttcagtgagaagcagatcatccaggtgcttggagatactggactgtctctttaacaaagtagatacaaattcgtggtaacatttctttctaacttcctggatacatttctttatagttgttgatatctgatggtgttctccaatactccaaattggggccattcacagagtactagtttccctagggcatccaactatttataaaaaccatgttcagggcagtttcctttcagagatcccctatttcctctaattcaggtcagtttgatttaactgtcctcagagtttcatctccaattcctagcagccaagataatatggaatcttctcaaatctggttgcatactgtaagtactttatgaggttcctacttcaggctttctcagtgtctacccatttgttcttggcaatttttctcccaattttccttctttattcctctggtcattatgggacaagtctgaggagatttaaggaaaggggccaacttattctatacttcagcaaagacctgaaaaggaaaaaagggggaatgtttgggctggatagaaggtagtagaccacattgctcactttgagcatctttccctagtacctaggaaaaacagccagtgcttttactatccactaaagcctctgttcctgtcctcaaaagacaaatcctctctcaaaatagaccctcctttcacaatatcatgattttgattcattgcagtgcaagaacttgccctttttatcatttacttataaacattttgcggtatacatactcattttagtaaaatggggctgtaaacaaactatccaacaaccacataagttctgtcaaaacctgagcatttgagttgctccagtgcctgttttcatgtccaatattactctttctatattttctgttaagacaattgccattttttttatttttctagttttcagttacagcatctactcattggccattgagaggaaggagaatttgaaccaaggcttctccccagggacaccactggttacttccacagaatggggaaagtgaacttaccttagaatttgggagaggctttttcaaaacacctcgtgtgtgtgtgtgtgtgtgtgtgtgtgtgtgtgtgtgtgtgtgtgttcagcaaataaccaaaatcagcaagggaaagggaaaagaaaagaagaacctgctaaatgaacatgccatgtatcagaacaaacagaagggaacaaaagctctacttacatacagaagacacagcttacaacgctacactacagatcctgtaaaatactgaatattggccccccacacagttcagtcctgcactagactatgccagactgttttagagaaaatttatctaaattctagagagattctcttttcccacacttagcctttaaaaattgtatgatttctttctataaatcagtgttgataaaagcttcaggctttaagactcagacatcaaacaaaagggatttctgcaaagccccttgttttctacttggattaatattaaacactaatactaaatttgcataaacataatttgcagacatttctcagccctctaaagaagatgtgtctctctttgattgctgaactttttccaaagtccaagcagataatattgaaacttggccttggttttggcatacaagtacagaaaaagatttgttcatagtcaggctgctgtacacaatcatgtcgttacgtctctcacgtggtaagatatatatacaaaatatatgcaattatagcccttctttcacatttggggcattgagtaaagggcctcctctattctctaacagaaacttagatgaattatctcctcctgagacttcttttacttgttctatggcagtgtaacagtgaccttttgccaaaccaataaattcacaaaagaaggacactttgtcacacggcaagtgaccaaaaaataccccaagtagcttctgtgggtttagctggcagttcctggattcaattttagtgtttgatctccacccttgaatctcttttttgtctcttctttaattgatgcttctatcactttctaaactgtcttaatttattttgccagtttggtagtgtataaacgaatggtgaaacaaaacatatcattacttttttttttttttttgagacagagtttggctcttgttacccaggctggaatgcaatggcacaatctcagctcactgcaacctccacctcccgggttcaagtgattctcgtgcctcagctccccaagtagctgggattacgggcatgtgccagcacgctcggctaattttgtattttgagtagagacggggtttcaccatgttgatcaggctggtctcgaacacctacctcagcctcccagtcattacattttttaaacatccaaagacttagatcctgagtgatgttggtgacagaatgctccatccccaaccacattcttcaatgcatgctaaattaaaaagaactcttgtctgagaggatctgagagggtaggtggtccacaagcataaatttgacacatttaagaagtgagtgagggtttgaaggtcaggaggtatatttgaggaagccctaaccttaaaggatgatgattgcagccagacgaaatgtggcttcccaagatcttcgtggggagtaaaacatcatagtgaccaaatgttaagtcaggaagaactgtttgcctccatggatggcacactattcaaggcctggaggaaaactaggggcatgagaaaaataatacttatttgctagcagaatctgagctgagcttggaggtggctagggaatgaatgtatatcagattcattccataagacaaagaagtcaaagctgctggcaatacagacagcatgggagccaactctgagggtggtgagattgccaagcctcacagacttccatgtacaagtattagactccacatatctaccaatgcctgactaagttagtggcacccaagataccacatatgacctgagtgtgcagcctgtcagtagctacaatgaagggcaagttctgctctgggccacccttgggccctcaactctgccaacagttcccaccatcagactgggggccaaaatcaaaatacattctcctcccaacatgaaatatgcctagcattgtgctgagcaaacaattgaccttttccctttccctgctggtatttctcatggtgaacttggtatccacagaagtagctatgatccatggcagagagaaaaagtaatgaatgccctgtggaaccaccaattagaattctgagcaaagcatctagcccctcccctatgagcctcttgtccctcctgcataacagtgatataatgccagttacttggtttgtagaactgttgtgaggaccgaacaaggtagcaaatacaaaaattgcctggatgcagtatgtggctcaatcgctttgagtttattcccttcagtccatattcagtccttactcctgactgtatttttgactctaagagctctgcttctcccttctcactggatttgctaattgcttacccaacagcgttttctactaatgcccagtgataacaaaaactgattttgttcaaagaaggaatatgttcagtttcggggcaagggtggggaggctcagaaattctccaatccaagcatggctatcctattctccttggttatatgatggtttttccagcctcccctacagctaggggtgaacatgtgacccagttctgcccaatgaggtgtacagagaatactttaggacttctgtaaaagaggctgtttcttaataagaaggacagatgtgagagaatggtggtacttggaatgtgatagagatgcctggagctgttgcagccacattgtaacaaacatgaggtcccagagtaaacttcatgaaaatagtcgagctggaatatggaaactgtggtgtccttcaggcatatttgagcaactgaaccagtgcaagcatacttccagacttcttatggggaggggaaaaaattaaggtcctgtttgtttatactgtttgctctaaactttaactgcacagtaaatttatttgaaggtagcatttagaagtgctaatgccttagccccatatctagaaattctgatttcattagtctatattgtgactctgtacactttttaaaactttctgttataaatagtgtgagatacatggcaagatattatacagaatgcatgtagattttacacagcttcattagttaataactcttggtcaatataattttatctaaaccctcaccaacttctctccacccaaagattagtttgcagctaatcttaaacatcatatcacttaataaaagattatttcagtatgtatctgtaaaagatgcagacactttaaaaaatataaacaataatattatcacatgtaaaaaattagttacaggctgggtgtggtgcctcatgcctataatcccagcacttggggaggctgaggtgggtagatcacttgagctcaggagttcaagaccagcctggcctacatgatggaacctcgtgtctacaaaaaatacaaaaattagctgggtgtggtggcatgtgcctgtagtcccagcaacttgggaggctgattggggaggatggcttaagcccagaaggtggaggttgcagtgagccgagattgtaccactgcactccagcctgggcaatagagccagatcctgtctaaaaaatattaattataattcccaaatatcttcacatactcattcctagttcaaattgtccaattgcttataaatatttaatttttgaaatttgattttcaactcaggattcaatttactctcatgcattataatttgttgaatctcttttaatctataagttgccccttctctgtttttttttccttgcaatttatttgttgaagaatttgggtcctttattctctagagtttcttacagtctggcttttgctgacatccttcctttgttactgtttaacatgtccctctgtgtcctgtcttctctgtaaattggttgttagagctacctgggaagtgtctggttatctccttttttagcagacattgatgattattggctagatccaatatttcatcacagattgtagaatgaagatgttccatttatctttctacatttattagctaagatatgtctttaagaagaatcttcccctcatttactatttggtgacacagtaaatagtatatatgcaaatagaaggctaattatttgattctttccttttatttactggttttcaaataatgaatttattccctatcagttttagagatgaccacaaagtatattttggagtcattatgaacacaatatttaaacacacttaatgtgtttaagtctgtttagttgttattcttatatatgctcaaactgttccatttttaggcattcaggctcttcaggttggctcttgaattctttttacattaccccagtagtctgtgatagcttcctgttttcttgtacatcaggttgttccagtctcaccttatacatttcccaaaatcagctcattcattatgtactgatttttttttttttttttttttttttttggtgagaaatgcttttttagagagtaaaatcatcaggcttaactgcatgccactgggttcatcatggtttctggtgctttgtagagtactgaactaagaaatacatatttaagcaaaatacatcatgagtttatactcataattcccattcaaatttagggctccagcatacgtactttatgtcattaattttacttcggtatatcctttctatgaagccacaagtactgactcccaatgatgccaacaaaattactcattagtattatcccccaatttacacctgacaatatctgaaaaacatgccaacactaccattaaaaatgctaattctgaaaacagtttaaatattttgtgtggttcttttgatcctcaggttgtatctcactaggaatagaatgtacagaacaaatgactatgtttataaaccatttgaaatagtttctctatgtatgataatgccaccaactaaatgtaaaataaaatcaattttgcttttcattgataggaattattttatattatttaattagtttttataaatatgtggaaagtttacatagtaccaaagtcaaacctacaaaacaacacatttgagcaaagtcccccttgtattcttgtccctctcactctgaaccttctttcccctgggtacatttttttctagtttgttgattataattccatatatggatttattcaccatttttgctaaataataatacactatgcagttttctccaacttgattttttttgtttaccaatatatcctggagagtgctccaaatcaacatatagaaatagttattttttataattgcataatattcaattattttatttgtcaagtcctctattaatggttatttaatcatcccaattttttccataacacatacttccataatcagcaacattttcatatttccccagtgtttctttgattttgagaattgggatttataggccaacatgtattcatatatgctagatcttgccaaattcccctccataagaattttgcctttttgtagggagtttagtctttttaaaaagtttctcaggtgattttgtgacttaaaccactggtttaagtcattgttactgggtttttgttgcttgttttgttattgatgctaaacacataataacctagtgtaaactacataattggaatcttcctactagatccaatactagtagagatcacggactgtgctgtgttcttaatacccacagtggctagcacagggactagaacaaagcttattaaatgtatgttgagtgttaaatgaggcagtgaaatgtagtgacatcaccgttaatctatttcttataaaaaatatattactgtgcctgcctctacatcagatgtttcattctctgaaggcatgaagtgggtattattgatacattaatgtagcaaacatttatttagagtgtaccatgtgacagtagtattctagatgatgtacatagaataaaaacaaaacaggcaaaaatctatgcccctttggagtattacattttagcagaatttaaagaatttaagaattgaatataagcgggatagtacttagtgttaataagaatattataacagtgtgaccatgagactgacagggattttaagctgtggctagacctgcccatgccttttaagcagaaacctgaattaagtgaaagatggcttggcatagagggcatctttgaatattcattgaattaatgaatatgactgccaagagaatcttctgcctctggctatgtaccagtcaccagattagggcatctctccctattcctgtatgctaagttcctccctttccatcccctaaaatgtcccataagaaatccacctgggacaaactggacctccggatcctgagtgataagctgggattacaggcatgagccaccgtgcctggccataattgacttagatttaaattaaatctttttacttccacttattaatgatgcaatagttttttcttgctctccttttccttgttcctttttcttctcttttaatgctctctttctgtctcaaaatctaaaacgttttcatattctttcaccctagtccccaaactttgtttttgtctttgtaaatgctgaaagtcacaattcccaatgaaggcaaaacagttatgaatatttatgcacaagataacacatgcatatttttataaagcacaaattataggagatgcagggaggaatatacaggaacatgccaataacagagtataacacaactgtccaagacaggccaaatggacaaaaaataagcaaggatatagaagacctatttcacataatcaataaggtagatcttctggatatatatcaaactttacaactagataattgaaaaatactttctcaagcacccaaggaatattcataaaactttaccatattccaggtcacaaagaaagtatcatcaaattcaataatgtagaaataacacagccagcattcatttgtcataatgtatagctaaaaaaataagtctttcccaggttaaattttaaaactctctacttaaagcaaaataaaataaaaactcctgagtgaaaggggaaatacaaaccaaaattgcagttttaaaaaacaaaacaatgttattagaaagtctacgtagcataatatgtgtgatacgtatttcaaccctaaagttaggcaaaggtcaacaaagtaaaccaaaagaaaacacaaggaagcaataataaagataaaaggaagcactaatgagacaagaaatggaagagcaatagaactaaattaatcaaaattctctttccttaaaataaattaacatcatgcttaatacctaatatattacttaatataataaaccactattactacttaatataataaaaaccactacttaatataataaaaaagagaaaacagagatacacaaaataaaaaatgaaacggaataactattaaaacagaaaaaaatttaaaaaataataataaaagactgttttttcacaataaattgaaaacccaaaggataagtacgatttcctaggaaaaaataattcatcaaaattgacaccaatagtgatgaaactcttaaggaccaattttaatagaagaaatcgagagatttattaaaccacttcctcaaaaacaagtatcaggctttaatatttccacagggtgattttaccaaaatttaagcaccaactaatcataacgctacatatgttattactctcagtgctacacaacattttccaaagcatagaaaataaagaaaaattcaaattactattataaagcaaatataacattgataccaaaacctgatggagacagtataacaaaagaagttacagatcaatttcaattttgaatattgatacaaatctcctaaattaaatatgagtggacagaatctaacaccacattaagaaaataatgcatcaggaacaagtaggatttattccaggtaatcaggggtgattcaataattaaggaatcaattaatgtaattcatcttatgataggtctaagaagaaaaagcatatgaaaatttccagaaatccttataaatccttataaatgttcattccaacaaaccaaaacaaaacaaaacaaaatgaaaaaatactcaataaaatgatgtatgcttcatatatattatgtatgtgtgtatataacaagtatatgatatatacacacatgcacataaagaagtacccactgtatgtctgaataactacaaatgtaaatactaaaatttctaatggaaaacacaagaggcattcctgctaaggttaaaagcagggaaagagttgcccagtctctcagctattcaatttgttggcggtattagccaacacaattaaaaaacaaaccctacaaaaacaagtataggcatgagaattacgaacatattgtaattctatttgtagattatatggtattttacttggccaacttgagaagtgtaaagatgaaactaacacaaacaataaaagatttgaaaaatttagaaggatataaattaaaatacaaattcaatgactttacatacttataaacaataacaagaaacaaaatataatgaaagaaaaaatctctgtaataacaataaagaagataacaatcttaggaataactgtgacaaataatgtggaaaacctgtgtgaggaaagatttaaagactcctgaatgctctaattcttatataggaaagttaacattattaagatgtcagctagtttataaacttaatgaaatcttaattaaaaatatgccagcaagttttcttttctctagagaaagacaagttgattctaaagttcctcttgagggtgagggaaacaccatgcaggaacagctacaacaatctctgaaaaaataatagcagtgaggaaagactaacccaaccaggaataaaacatgctattaagtctcaataattaaaattgtatggtactggcactccaatgaacagaatagaaatgtatgaaatacacccatacacatatggaaaattcatatataataaatgtgacaacatataactagggaacagaaaaacatttttaatgaatgctgttaggacaattgggtagccatttggtaaaagataaaatttgatccataactcgtagaaagaataatctccatgtggtttagagatcctcatgtaaaaaatgaagttctttaatactagaagggaatacagatagattctgtaataacctgggagcgtggaaaggacttctatcaaggaatccaaatccagacacaatcaaataaaaattgataaatagcccctccagaataaagaagaagacacattttggcctagcaaaaaatgaaaacaaaaacagagaaataaacaaataaaaaataataaatttggagaaaatattttcaaaatatattttaaaaaagctaatatcctcaataaatgtaaagcactctttaaaatcaaataaaaaaggtcataaacccattacataaattggcaaaagacctaaacaaatagtttacaaaacaagcccacacaaatggccctgaactatatcaaaagatggtcaaatctactcataattacagaaatgtaaattaaagctactttgaaataccatttctcacctatcaggttgtctgttctctgtttctgtctgttgcaattcaggcaccgttatttcaaacgtttattattttaggtttattatacagtacactgaagaataagctactgctaatcaagctacctataaagaacaaggagtagaatctactagatagaaagtgctcgaataagcactaactatctttatttcagttcatcccagtcatgaataatatatcacctgggtgctcctccaacagtttgggaaacaattggtgtcctccatccagtacacccccatcatgcaagcactccacatgtgcacacacctgctaacaataataaaatttccatatttgcataatcatctcccaattatggagccaaataacttataaggtagtgagtatctttgggaaaagaattttgttggctctattttctcactgagctgacaaagaagaggatgctggcagctcaggaaaagctgcctttggtgtgtcaagtctgaatgagactgggtcaagtgtatgagttaccatgacaacgacacgatcaggatgcatcatctcccatagcaactgcattgagggggcctagtgtctgagtcgaagctttctctcagcatcagaccttatttgaatccacatctaaagctacaccctggggtgctagctaaaaggatacatggagaatataaagaaccacagaggctagaattatataactaatttcagcagcttcatcattttaaacccgtcactactatagtaaacccaccactactatagtaaagtgtgggacagcagtctaaacgagggctgaaatgcctgaaatagccaagcatgggaatatcccacccagtaaatagtccagttttgaggttaaaagcaaaaaaaatgcatctccattgtaaggcagtctccatagcctgcaatgtccacaccacactcatctaatgcctccaatcctaggtgacaatggaactacaaaatcaaagctgactctataatccctgctgttttcagactaattcacacacaattaacgtggagaatatgaaaaatttccccaagtgggattattagtcatgcagcccttttcaatttctaccggtacccaaaactgctacaataaaatttagtgaaacaccctcaagaacagaattgcctgatagccaaatgctggactagcccaccagaaagtagcctacttttggagttaaaaggtggaaagagtatctttataggttaacatgatggcaagccaatccctgcatatatcctgacaaaccctgaagaaagtattgttctgttttctcagagtaatagggtaaatgcaagagattgtgtaattcccctacgttaaatccagcacttcttatgtgacaacctatatccaagcaatcatgggtacaaatgtcttacatatctcataatttgcatgcttcataatgtgctcgcatcttttgtagagctcgtttcacaatgacacagaagagtaaactcctagcctcatgtcaaaaatcagaaaattgaagttttagaaaaaagaggctgatcaccaaagggtctttgatatgaccaacacccaacacccaaacactcattagttctcaaaatgcatacccataattgggggaaaatatcattgaaaagcagagaagagacacttggtgatttactgaccaactacagtagtccctccataaccatggggaaacggttccaggactccctccatgaataccaaaattctcagatgttcaagtccctgatataaagtgcgtagtatttgcatataacctacacacatcctcccctatactttaaagtaccttctgattacttataatacctaatacatgccaaaacatcactcattcatgtggattcaacatagtattcagcatgtagcaaattcaagttttgtttttttgaacttggtagaattttattttttttcaagtgcagttggttgagcccacaaatgctgcgtaacccatggataccgagggctgactgtacttccataagaccactcgttctatggtaagaaggaaatgtactagggaatgaggaaatttgagttatgcaaggctcagcaatagcagatgactgcacagactagcacagagcaaacagcgtgaatgagaattaatggtaatgtgaggaaatgaattttgcaagccaaaagataacaaacccatgagtctagttgaggtcacttgttccctactaagtagaaagatccagtaaaggagagtgagccttatgcagtctccaaatgcagtaatactttaataacaccaaagacagcaaagtggtgatgtcagttttaaacatgtggtgaaggacaggcacagtaatgtaatgttataataaaacaattaaatatgatgccaatacatctcactaagtcgtatgacatacttcgagtacacatttactaaccacctgctttgtgattgcccctgtgttctagtaggcagattcagatgtgaagtttgcatcacatggggaaaattttagtgtcaataagaataataactgacatgcattcaaatgcatcaaatatgattacatctttagtccatagtaactctaaaggagcaatgaccacatgtctaccattataaaattttagagaatgaattcactatgccaaattgggtaaagagaggcaaatagtgaaacaattgtcctgtgtttggcgtatgaattgtatctcttggttaccaaatattagatgaggttagttctcactattgaagaattccagctaataaaaaaaaacagatataattaaaacatctcaattttaagtctcaaatgacacgaatgatctaggcaaagacggccaatatctgctctcattacaaaaagagggacaaccatacagtttgtgactcctgaaaggctaatgtgacactgtctctgaagtattcatgccaaattatgaagccaatagatagatataacttccaatttacaagaaaggcaggggacaaaagagagtgttaaacaacaccaatgaaaagaaattagcaaaatccagcatgtggaagactgtagaataaaggattcatttctcacaagaaagggattttaccaaggattaacaggcatatcaaccaattgcatgagaccagatgggatctggagtttaaaaaaaactacgtgaaaacattaatgatacaatacaggaaatattatctgtgaataatattgaagaattaagcaactattcattattgtttaggcatgataatggtatgtatcatattttaaagtagtatttttttaaatgtctttccctttgagagatatattctgcagtatatatagattaactaatatgtctggaattttcctgaagctatgctggagtggtgggggaacttaatgggtgtaaaagaaataatattgacaggccggtcgtggtggctcatgcctgtagtcccagcactttgggaggccgaggtgggtggatcacaagttcaggagttcacgaccagcctagtcaacatggtgaaatcccatctctactaaaaaaaaaaaaaaaaaaaaaaacctagctgggtgtggtggtgcgtgcctgtggtcccagctacttgggaggctgaggcaggagaatcacttgaacccaggaggcggaggttgcagtgggcagagattgtgccattgcactccagcctgggcaatagagggagactccatctcaaaaaaaaaaaaaaaaagatttagaaagaatttatgattgttgaggtaaggtgcgatctacatgtgggttctttatttattttttttgtttttttgagatggagtcttgctctgttgccaggctggagtgcagtggtgtgatctcggctcactgcaatctccgcctcccaggttcaagcacttcttctgcctcagccttccgagtagctgggattacaggcatgcaccaccacacccagataatttttgtatttttagtagacacggggtttcaccttgttagccaggatggtcttgatttcctgacctcgtgatctgcccgcctcagcctcccaaagtactgggattacaggtgtgagccaccgcgcccagcagtgggttctttatcatataatagcttgtcatgtatctgcttgatagaatttataacaaaatttttttttttaatgtccaaagccatcacgaaatagactactgaaatcaaaatttctggatatgggccagggttttagtacttctaaaagctaccttcaaatgagtttagagccaatgatcaacaaggcctcatattttttttcttgtaataagaatcagaggttaaaatacaaggagatacaccaggggcatacattcacagagggacaaccctgtgaagaggtaacagaggggaatcatctgcaagccaaggagggacacctcagaggaaatcagccaggctggcaccttgatcttggcttccagcctccagaactgtgagaaaataaactgtttttaagccagccagtctgtggattctattatggcagcccaagcaaactaatacgcttccccatactatccctgctgcccattctgtagagccgactcacacatgataagtaagattgcaggaactcagttgtgcactgacacaggagctgaaggcctaacactcttcctgggaggctgtgaggcttgacgattttaccatactcagaagtgctgccatgctggtcatgttgccggcaggtctggccataatcgcaaggaacgaatctgacaaacatttggttccatgagctccagaagagcccagcttacgccctgccagaacatcaaagaaagatcctagaaggcctttcttatgctccacaacttcccttcatgccaacaagagattgccattcatagaggcaaatagctgttatttattgtgttgatcccttaccatgtattttatttttacttattttttttgagacagggcctcactctgttgcccaggctagagtgcagtggcgtgatcttggctcactgcaacctccgccccccaggtttaagcaattctcctgcctcagtctcccaagtagctgggaccacaggcgcccaccaccacgcccggctaatttttttgtatttttagtagagacggggtttcaccgtgttagccaggatggtctcgatctcctgacctcgtgatccgcccgcctcggcctcccaaagtgctgggattacaggcgtgagccaccacgcccggccccaatatgtgacccttttgcttcctctggaacctactgtagacttactaacctttctaaataggaaatcaaagcacagcaagatgaaaacatttctgttcacagtagataatgtaggtaagagcaaaggaagcagaacggatcaaaggatgtcccttgtttattaatctgattatatcttgtcaatatttacatgcttacctattagttataaaatctgtttagcaatagatgaagtgaaccactcagatctgaaaatgagaaaagaaaagtagtggagtgtcaatcatcttggcgtgtaaataagaaaggtgttggccgggcgcagtgattcacgcctgtaatcccagcactttaggaggccgagggaggcggattgcctgaggtcaggagttcaagaccagtctggccaacatggtgaaaccctgtctctactaaaaatattaaaaaattagctgggcgtcatggcgtgtgcctgcaatcccagctactcgagaggctgaggcaggggaattgcttgaaccagggaagtggaggttgcagtgagccgagatcgcgccactgcactccagcctgggtgacagagggacactctgactcaaaaaaaagaaagaaaagaaaagaaaagtatcacctaaatgaatagaaacagtgaacaggttgtgtccacagggtttgacattggggcaaacctctttttttctctgtcccatctaaggtgactgagcttccctggaaatggctgggaggtgtaagacatctctgctctcatcttgaaataattcatccactaaggagagaaatttactatcaaagttccgagaaattcgtgtagataatatattatttcatttaatttaatctttagtagaaaataaatgatctatgacgaaaaaccctcttaactcttttctgcctggtagaattcagaacatctcactccctcatttattgaaacaccacatctattatttggcaggcttgtcagtgggagaagaatcttacttaatctttgcctcaacactctaaaatacccaagatgtgactgaaaatgcatacaataaattatgcacatgcctatagtgggctactaaaggttggttctaaattattcataccagctcaaatgaaaatggaaaactagttatttctatcctttcaaatatatttatgggaagaaaaagtgtgaatgtgattaatgccactgaattatacacttaaaaatggttaaaatggcaaaaatttttatacatatgtaaacaccataaatactctttaaaaaatctttaagagttttaaccaggaaccagaaaagtctgaaaagtcctagggccagatgcactcatctctaaggtgacacctacgttctgtctctggataatgattacagagtccagatgagtgtccagcacacagtgagggcttcaaaggtactagctgccactttatcatctgtccttgcccattctaacagatggtgtatctgtgatgtctcagggacaaacttcacgtacctgtaaacttttctgcttggtctttgcctcccgctctcttctgctgtttccaatattctgttaaattcaaatacatgaattcttagtttcagggtttgaaattttcagttctccatttttcaatgtatgatcaatatgattgatttttaaattccagttttctgttgaaatttaaattttgtcatccatatttgaacataccaattataattacttcattgtccatgtctgataactccaatattgaagggttgtgggtatttttctttgtgtttttattctcttgacctgttctgatatggacaggaggcaaggaaataccgggtacaagagggcagttccccagcaaaggccccaccctcaagtctggaaacccacagccttaaatagaacatgcattcccgttttggtgcccaaatgttgccttttccaagagcactctggcctgccatgcccctatcctgtacccatgtaaaccccaaaccccaggctccacaagcagaagagtggaagagcacaagagcagcagaatgacacagcatggaaggagaaaagagaaggagtggccatcccacagccaatctcctctccaaccatccctggaggagttggaggagttcggctggggatggttggagaggagattggctgtgggatggccagactccagggaaagatcatcttcccactccatcccctttccagctccccagcctttctgctgagagccacctccatcactcaataaaacacccgcattcaccacccttcaagtccgtgtgtgacctgattcttcctggacctcaaacaaggacccaggtaccaagaccacagagtgtaaaaggctgtcaccctgactctccactcagctggtttaacactttaaactgttaaactgtttaaactgtttgttaaactgttaaactgtttaaactgttggttaaactgttaaactggtaaaactgtttgtttaactgttaaactggttaaactgtttgttaaactgttaaactggttaaactgtttgttaaactgttgaacaactgttaaactgttaaactggtttaatagttgctggcaactgctaaaagagtattaattgtaactcacccttaaacactaccctggggatgaagccaaaaagcacttgccccggctcctgcacttgcctgtctgcgggctccccctcctgaaaggggtttcagctctccgaggctaagccatgacccctcacaagtcccgtgagggggccagggaactctcctgtttcatttattaataagtctggtaattgaattaaatgtcgggcattgttattgaaaaagtttatgggctctacatgatgttatccccctccctagaagattcatcctgtcttctggcaggctgctagtgtagggacaatcacattcatccaatcagagacttagctgacatagggatgcttcagactttataaagcttcatctatctatgatttttttttcctcccaagctgcagctctccaggacccccaactgtgagtctggggtgctttttgagggtcccattttgggtgacttctgaattcagtattttgccatgcaatgccatgagatggcagataaatctgttgagacttaagtgctatctgctgaggttcttagtggcatgtcctctgtagattaagtgtgaacaaacgcctccagaaagaaaaccaccccatatggatctcacttctgtctctccttcttcttcctaagatctttacttcttaggcactgactggtttggaagtctgagttccaaattttgtttccctagtcccatgaaattttctgaagagctgatgtcttcgctgcttcttagcaggtgttttgcatataaaattatgtcctctcaccagagaagtttaggattctgcatattccctaagggaaaaagcagcacaagattgtaggattttagccccataacctttggcaaattatttaaattgtatgtgctctagttccctcatacataaaataaagataaaacctacttcattgtattatgaggaggattagctcaatgcgtttaaagcactaaaaacaatggcaggacaaatactctataacttttgcccttattaagcacagaaagtactccaagacacattgtgagatgaaaaaatgctgggtccacacaccatttgctactcaccattgatatacaaagaggagtttggaatgatgtatatgcttgaacaccagtgatatacctctggaaatgtctctaagagcccaatggaaaagaaaggtggcctttggggtaaagttctggatagttcagcaaggtggtgagaagaatccattgcttgcatagttttgaaaccttggaattttataccaagtgtgtatgtatcacctattccttttaaaaatctttgttaaaggaaagaacagaaaagaaaaagaaatagcaggctttggagttatgcagtcctgaatttgtgacccttctctaccatgtaggtaaagcaatataatgaggggcctcctgaaaaaggaatatgtagagtcctttgtcagaaaagcagcaaaagctgactttcctttcttattcagtctctcttttgacctctcacaatttttgtagttgcaatttaatgtggtgctgcctcagttaaggggacatgcatagggtgagtggagatcctcccaggtgtccagagccctgccctgtggcttggcattcccacccttcccctccctgcacccacactcaggccctctcctgtgggcgaagtgcagcagcagtcgctggggtggcagagggaagggcaatctgagagggtgggtgggtgattgggcagcagagaacctgtcccagtgaggccaggaggtggtgggagctggaccacatgacagctgaggctcaagaacctcagcaaacactgcattgtttaatcagacctcacctaccaagcacaaattcaaggaaaaaaaacagttaagaatttcaagacagccacactaaacctcaagcctaaggacccattctgagcatggagccctgtgggactatcttggttgcagtcctatgaagctagccctggtaccacatcctacctgtgtgccatgatttacttatctgtggcttcagtttcctcatgagtaatgtggatattgaaaaaaaaagaaaaagaaaaagaaaaaaacctcacactttttttctaagacttaaataagatattgatagcgacaggaggcagccaaatgcctaggcagataggggtgggtccccagtgaaaccccaccttcaagccaaacacatcctgaaggctgaaagaccagactgctgtcgcatatgaaacatgcaaccagagagagaacttctgttcctgttcgctggccttttccgattgattgttgctgaattatgccttttaaccaatcgaatgttgccttttccaatactaccccatctgagtccgtaaaagccctggactcagccatattaaggggactttcctgcctgtggatacggggttcacccctgcataccctctctgctgaaagctgtttcatcactcagtaaaactccccaccttactcactcttcaattgtcagcgcatcctcattcttcttgggcaccagacaagaactcaggaactagtgcacaagccagactcggcctgggtgggccatctcctgccacaggtggcctggctgagctaggcccaggtcaggtcccactggccgaagctacccagcttgcaaagtgactgagaagaaaatcttgtgtcaatattaatgctaagtacttagcaaagtatctggcatggtgtaagtctttacatgttaagtaaaatcattgtaaaccaaaaataaaattctaagcaccccccaccaaaatatctgaatggacttcctcctaggccagagcactcttaaaatttaacttgaaagactagttcaggccatgacaggaagtagggttcagacaggcttcattatacctctctggcattcacatcaacacagaccttaagtctgataagaagtatttgcaatctattctctctgaggcctgctacctgaagccttcctctgcacaataagaactttggtatccaccttaacccagacatttcctttctactgatcccagatctttagataaactcaaccaattgtcaaccagaaaatttttaaatctacctgtaacctggaagccccctccccctagttcaaattgtcccacctttctggattgaaccaatgtatttcttaaatgtatttgactgaagtgtcatgtctccctaaaacgtataaaaccaagctgcatcctgaccaccttgagcacatgttcttaggacctcttgagggctgtttcatgggccatggtcactcatatttggctcagaataaatctcttcaaatattttacagagtctgactctttttgtcaacaataatttggcgcctgaacacgtggggcctcagaggagaagcctcaggatcccaaaatagcagtagcccaaactcggagctaaggtaccagcaagggcccattgaaagcctcccagactttgagcttcccttcagatggaactggtaagtccttctgagccttggacctccctttggttgatggtccttcatttattctaagctggatttttttctcctaggaaggtggttgtttagaacccaaattcttgtttggaggttcatcctaaatggtcttctccattgcttgtatctccccaaattaatcttgatttgacttgtgtgcacatttgcgtcaggaactgagctgccatttttgtaaatgagagactgagttttctcagttctgaagagaatgggcattttgttcctcccagccaaaggtgcccctgggtgactgggggccaactgggagtgtctggggtgttgaacccctgatcccacatacagcagccctataaggagctctcaacaaaattagcttaaaaaggcccctccaggaagcacatataggagatggcctttgctgtgctttgagccctcccagaggtgctaggcctccagaaagggaaactgagacacataagagactgggaatgactcagtggtgacacactgtgacgtcccacttgcaaccagcacactttgatccactccactaaaacccgaggccatggctcagttcctcctttttttttggagacagagtctcactctgttgcccaggctggagggcagtggcatgatcttggctaactgcaacctctgcctcccgggttcaagtgattctcctgcctcagcctcccaagtagctgggattacaagtgcgtgccaccacatccaactaatttttgtatttttaatagagacaggttttcaccatgttggccaggctggtcttgaactcctgaactcaggcaatccacctccctcagcctcccaaagtgctgggattacaggcgtgagccgcagctcccagccagttcctccttttaaagaaaaaaaggtgggaaataaccctctttcaggcactccattggttttatggtgcctccacttgtgagagtttgtgtaaaatggaaatattatggtctttttgtgaacaattacatcaaagaaaaagagctctaaggttgacctgcaaactatagagttcctaacttctctttttctctattttcttttctgcctgctttagatctgctgttgcttttctactgaaatgaaaaaacactgtttggctccaactgggttttttttctgtgtgtgtgttttttgtttgtttgttttgcaagccagtaaatttgtattaatagctagaattctgaagtaaaagctataggatctttgtgtgtgtgtatgtgtgtgtgtacatatatatatatatatttaaaaggactttatgttttttatttgttttctttcctatgaccttgttcttcttgagagagtttttcttaatttctaacaacctgggatcctttaaaggaactagagaaggcatcagactcctttttggggagaaacctctgtttttccttatgaaatcccaagagtataaacagacaagtttcccttcagatattaaacttcttgtttgtgttgtgttaccttttttcaactaaaatagttactaaaacagaggctactcttggatgcttaaaataagaaagagtgtagtttagacacttagagaaatgtctttgttaaaaaaaaaacaaaaacctgcacgttgtgcacatgtaccctaaaacttaaagtataataataataaaattaaaaaaaaaaggtgcactgtaaaagcatggactagcctcattataattctcttttaggaggcccaggatacagtgtggactctccccagagctcggaggtccaattaaaaggtggagaataaaattagaactacctatctaaataaaatgtctctccttacacaatcttatgataaatttctatacttttatgcttaacttgcaatgaaatttgctttatttccctctagcataccaggctttttctctctgtgctttgagatgtcaattttgctatctgatttttcacctaagagctgtttcttttaatatgcaaatttagggctattcagctgacaactgcttagggtaaggaaacaggttatcaagaatttaggtcaggcgtggtggctcatgcctgacctcccaacactttgggaggctgaggcaggcagatcacctgaagtcagaagtttgagaacagcctggccaacatgatgaaaccccatctctactaaaaatacaaaaattagccgggtgtgttggtccacacatgcctgtaatcctatctccttgggagactgaggcacgataattgcttaaacctgagtggtagacgttgcagtgagccgagctcgcacccctgcactctagcctgggccacagagcaagattctgtcgcaaaaaaaaataaaaagacttccgaagtctaataaaatgtacttctattggcatgcctaatatgtatttgtgttgtgtgtatatttcactactaaaaatatataaagtgctctaattaattggcttaaacattttttaatcagaaaattttttataagaaaaaatagagactttaagtcaaatgttttttcctttttttttttttttttttttttgagacgagtctcgctctgtcgcccaggctggagtgtagtggcacgatcttggctcactgcaacctccgcctcccgggttcaagcaattctctgcctcagcctcctgaatgactgggattacaggcgcccaccaccatgcctgggtaatttttttgtatttttagtagaaatggggtttcaccatcttggccaggctggtcttgaactcctgcccttgtgatccacccacctcggcctcccaaagtgctgggattagaggcgtgagccaccgcgcccagcccagtcaaatgcttttttaagctcacatgacttaacaaataaactggctttaaaattattggtaaaataatatttaaaatgtcttaagaattgttggcatttttgtttgcatgtattaatcaaaaggtttcatatttattcctgcagaatacctaaagtgtcaagatttgccataaggattataaaactataaacccagcccaaaacagaaggatcttacttgtgtaatttttgataaataagacatgtaatatagttggtttaatgaaaacagctaaatcctgagttattggtaaaaaaaaaaaatttatatttaaccataattttccttatttttagataaacacatgaaattcataggtaataaaaatggttaacaaagaattcactttaaatgatgactatcacagttttcataaataatctaggtaaactattaatcaggtaaatgtaatggaataaatgcttgtaaacaaacttgtcatataatttagaatctaaggttatattatagtagatattagttaaatgtctaggtaatttccaatttaaaaattatcagaaattttttaaaaaatgtattcttattaaaaggtgaatctttttacctaattcagagttacttaaagctgaagtataaaacaaggtaaaaggcatcagtaaattagaactgtgaattatagctataaagaggtattttgggtaagaaaggtaaaaaggaaaataattttacatgagaaataatcctgtaaggtgaaattttgtcctaaaataaaatgactgggtttttcaatgaagagggatatttaggacaaaacaaaaagttcaaatatgtcttgaatgatctaagtcataataaggtcattaaaaaaagagaatttataaaaatgttatgtgattaattggctttaatgaaggaaaattgtaataaagtttttctaaaattaaactttgatattaaaaatacactaatacaaaactaaataattggttaaaacaagattttatttaaaatgttgacttatgcttaaagcaaaatttttaatttttgaattctataatctgtctgaaatttttcagattgatatctaagaaggtcacctctttcttttaaaaaggacttggatgataactttcaccttttattggcacctataacttttaaaatctaaagtaaaggagagttttttttaataggtaaattaaatatattttggatctgcctttttaaattctgtatgcctgttatatctctatctttatatgtgtcatgtgaaagtgatacttcactaccaaactatatgaaagagctctaatcaagtaacttacaaaaaaagtgagtattcactagactggtagaaactagctcagatgccttttaattcacatcactttgataatctttggtaaaattaatttggtaaatttaatctcaaaactctctccagtgatttaaaatcttaaagttatgttgtgttaaattaagtaatctcagggtttttttttttttcaactgagagtttaggttactaaaagttaaaattgtagggtcataaaaatgtttttggtgaagtttataaaacacaaggatatggattttgctaaagaaagtgtaggtcggtggctcacacctgtaatcccagcactttgggaggccgagatgggcagatcacgaggtcgagagatcgacaccatcctggccaacatggtgaaactctgtctctactaagaatacaaaaattagctgggcgtggtggcccacgtctgtagtcccagctactcgggaggctgagacaggagaatcgcttgaacccgggaggtggaggttgcagtgagccgagaccacgccactgcactccagcctggcacagagtgagactccctctcaaaaaagtaaaaataaaaataaataaataaaatgtagggtttttttctagttaagaaactatttaagagttgctttaaaataaatgaaaaattatacagataaaagtaaatggataaaaggaaaaattaagccagagcaacaaaagttaattctgagacctttgattaccaaaatgatagtcaatgtaggggaagggcaaaaccaagtaactatactaaagggtataatgtaaaaccagagggtataatgtaaaggaattgttccattttgtagattggtatcatcagcttcttgagaaacctttactataatagatggtaaaaataaccatcttaaggacacaatccttaattttaaatgctacagaaaataaaagcttgtttgggctgacccagaacccacagctcactattgaaccatcactaatgagtatatgtgatttcaatgcacaggaggagagaacaaccagcctagtggactggataaatgacactgtaagctctgtttgccctgagaggggactacccagctctccctataaaataccaagtggagaaccccagatgaagcagttagtatgcttcatatgcaagccatgtgggaccagctttatgataactgggatatcctcctaccaaatgtgcctattaccctggtcatggtaaatttgggggttaagtggggagcccttttacatgggtgcccctcctgcagaatcatacaactgtctgagaagccttatcaagtttactgtacctcatgggttttacagatgcaactccctgctgggaacacaaatcctttttcactagaaaaagtaaaatgatctggggatagtaaaacaagttcctgggatcagaacacaaaaacatacaggttaatagaattatgaaatttaagatgtttacacaggctttatgtaaagtagttgtaacccctttacctaaatgtcttacgaaaataagtattgtatctaactgggggatttttcccctatctagtactataaaactgaagacatgtacatctgctctttgagaactgttgcttggactcactaaatgaaaagtagtatgattccctgagcccacaaaatatagcctaaagggtggagtgctagttgagacaaatcctccactttatagccctttatgaagtatttattggggcttaatgcaacaaggctgtactttccaatgacaaagactgaactagagaatttccacttgaggaacatttactgccttgctatgaaatgttaactgaagctacccctatgctgaatgaaaataatggtgccccaaagagtaaaataaaaaatggtttacatagaatcttgctacctggggatacaaggaggagaaacttataagcagagagcttcttttttccctaggactaattctcactatgtgaggatctgctagattctacagtgcctgatagacagctcccatgagttatttggtttgcgaatggcatttccaaggtgaacaaacatcttgtttgaaagctgctgctctggttaaagaaggataaaaaaaaaatcgttttcttttgagttatttgggtgaagtatgtttttgtaagcaaatttacctttctctgtacctgagttctccagaattcgggttgtgatttcatgacaatatagttacttgcataaatttagtaatagtcttttaaaacaaaacaattggagacactggttattttaccaagactttaactaaaatagcatattttaggtaaagttccagcaaagccaacttaaaaggagcttatatggccaatcaattcttgttacattttatgcaaataatcaggccaagtataataagcctaaaacctagttcgcacacaaattggtcttactataatttctctttaatagaaaaggagggctagagtaaaagaaattgtttccaaggaaaagcgtaacacttgatactagatttcagccctaacttttctttttttaagtgcagattgaatcatgaattatttcttggctacaataatcctctacagagtactagattataatttttcttcatatctttagttggtgccctaatggaataggttcctttttctgttcaaacacacaaaaattctttgattgtcaaaacattaatgttattatctctccttgttttacttccaaggaaacccaaatcatggttttctgaagaccagagatgcaaatctccctcatttggcatcccactgggtctgatctgtttttcactgcaaatgccctactgctaaaacgatgcaagcaccatccccccaggcccagggatcgtcacagaagacgtgggtgtgagagatagtaagggctggttttgaggaataaaattaggtcaagatcagaccctccaaagcaaggatagatacaaagatgcctaaagagctggtaaaacaagggactttgtcttctaagctattatgtgtcacttttgcatccaccccaaccataaagcattttttgctccctgtagaattaaaagaaaatatctgtgacacaagaaagataccttgtgataaagcttcctggatataatactcccagttatgagttgagaagataaatatattaaaactttttttttcagagcagtgcttatgatttgtatagctaattgctacaaatctgtaactaaatccaaacttatagtaggtcaacgcataaaagttacagtcagttttgtaaccttgcctttggtttttgtttgttggctttttacctaaaataataataattttaagagataataaatacctgtccacgttcatcctatctggcctataacaattaattggctgtaagtctttttactcttaaggtccttggccatagggacttccaccgagggacaggatggacccagggagggcagccctgccaccccagcaacgctatgagagaaaataaaaatttactggctaaataaataaataaacaaataaatttactggctattgatgttgcctctggcaaatcttgtcaagaaggaggagaatgtaaaccaaaaataaaattctaagcaccacccccaaaacatctgaacggacttcctcctaggccagggcacacttaaaatttaacctgagggactggttcaggccatgatgggaagtgcggttcagacgtgcctcattgtacctctctggcattcacatcaacacagaccttaagtctgataaacatttacaatcttttctctctgaagccttcctctgcacaataagaactttggtgtccacagttctttatcttaacccagacatttcctttctattgatcccaggtctttagattaaactcaaccaattgtcaaccagaaaatttttaaatctacctgtaacctggaagccccctcccgctagttcaaattgtcccacctttctggaccgaaccaatgtatttcttaaatgtatttgactgaagtgtcatgtctccctaaaatgtataaaaccaagctgcatcctgaccaccttgggctcatgttcttaggacttcctgagggctgtgtcatgggccatggtcactcatatttggctcagaataaatctctccaaatattttacagagtctgcctctcttcattgacactattaaattattaatgagactatgattggtattacttgatcagttaacaacttgtgaatgctacatatgaaatataaactatgaaataccttatgaaatagtgtaaagttgatatcatcaacacatggcaacatcacaagagacagaatcatggaacaccagattaaacagggctattctttctttagtaggagaggaattgtctcatccatccataaagtccaactaggccacccacctgcagatcatctcagtcagttcacaacaaagtacctgaccgttatgaatccaactgggaagaagttggtcccggtgaggcacctgtggttcctagaagcagggtcatggccctgagtccccaaggcaaccaatatatcagggagatctgtctcccttaggaaatgcagggtgaggttttccctaagggtcaggcttggaagttggttggaagagttggtgcctatcttctgggtattgtccagtttgcaccagaaacacaccctgtcttcaaactaagaacacctgttggtgtgccattttcatgcttccatgggacaggagtgttcataggtttagacttctttcctgtcctcagcccaggacaccagcctctttgcctctacctgctctgccttccttatgggtttgggtagctcttcttttcattcaccatagtgccatcatccctgtccatgctctgctcatccgagatactccagggtatgttcccttcctcgcattccatttatagggtggtggggtgggggggtggtagccagagggggtgtggaggttaacaggggagagatcataacatgtttgtggagtgatagggatgattcatatatagtgtaggccagtgattcagtgtcagttttctccatggtaatgagccagttctccaaatgttaatgttttaaagacacagtgttgggagaggaaatctgctgggagccctgagcattcctttatgcttttgcggagtacaccaataattcaaagtcccccactctttacctgggagatttctcagagttctcttttagtgagcaacaaacagggatgcttgagggatgaggtaacaccccccacagagagcatgattgctcccactcccaagaaagacataggatctcccaagctcagtgttcctctcttgtaacacaattctcagcaagtgtgagcatccacgcaagtccaccttcatcacccccgtggggcttggagggcatacagagccagtgcaaacaggaggctctggcaactacttttgttgaaaggaataaagtcctttgcctctgacccagagggtttctgtcttctgccagaatgtcaatctgtggcaaatgaacttgtaaacttgcaagtaggttaaaatcataggccctctaccattcttgacacatagatttaaacttatcagtactaaacctcatcagagtgcgcaagttctctgcttccctttgcaatttgcatcaaagtcaactccactaatatggtcttcatggtcttccaggccctgcatagcctggccctgcctacctctccaggatcttgtgccagttgtgtccaaatctctctgcttttgagtcatatggggaaaaatttgtccctgacatctgggcactggtatgacacttacaattaagcttccatgttgctagtagcatggcctcttgccgatggctagaccatgttgttctccagatagacataaataccagaatcacccaatcaaatcccaaatcccataacagattctttctatcatgatctttctgaaacaccattgttcttcctgacatgcattgtcctttattgccatgaatagtaaacccaacttatttaactacttgtgcattcctggcactctttggctggaggacattggcatatacacatgctgatcttcttccagtttatcaacattccattttctttcctgccacaggcactttgcacatactattccttctgcctagaacattgttctcttcacctccttgaccttgctagcccctccccatcttgaagttctcagcataaatatcactttctttaggatgttttcccaactccttcggcaaaatctgggtgtattctctgatagtgtgttaggtttttcccattatatacacttttctaatttgtaatatacatttgtttgtgttactgtttatttatttaatatctttaagggtagataccagtcttctttgcttattgctatagcccagcatctattaggaggcctagtacattgtgggcactcagtattcatcatttctttattctacaaataattattgcattgatctaggatccaaagttaaaactgtccaagtcctggtcctcatggagattccattttagtcagaaaagataacataagaaatgactaagtcccttaacaaatatttattgagcaactcctagaaactgcacattgttctggaaggtagggatgcggcagagaacaaacctgatacaatttgtattctctcagactttacattttgttttacatatgttcatgttagtgtatatttatatattaatagatctatatgaggtttagtactgataagatttcgtgtaaaataaacatggtatggtgatagagaattagagtgggtgccatttttggtatgatagtcaaggtctctctgaaaagttgatatatgacctgtggaaaaatagaaaatgccgtcatttgatcatgtgagcccttgatgttcattgtagtaagttttttatctgagcaaggtggagagccattggagattgttgagcaaagtaggaaattaacttacatttgaacaggatttctctggctgttgtgaggagtactgactcaagagtggaaggtgagggactacagtgatagggaaattaggtaaaaggctactcaattactcaaatgagaaatgatggtggcttagatcatgatgctgcggcacatatggagatgcacctctggaatcctttaaagtgggacttgccatccaactgagaaaagtgtggttagctgacaaattccacttgttagctacttcaggatcttcaaatacttcaaattttgaaattttgtatgtgcgcagtgtctcatgcctgtaattctaacactttgggaggcagagatgggaggatagcttggtttaggagctcaagaccagcctgggcaacatagcaggaactcgtctctacaaaaaaattttttttaattagccaggcatgatggcatgaacctgtggtcctagctactcaggaggctgagatggaaggatcacttggggccagaaagttgaggctgcagtgagccatgatcatgccactgcactccagctgggtgacagcgaaaccctgcctcaaaattgaattttttatcttttcctgggctagtgatatgcagtatgatactctcccatgttgctgggcagtggcaatgagccacagttcccagccagccaaataatcccaatggtaaacaaataatactatacagtgtactgtattcaacaaacttatatgaaatatccaccaccttattatagaatatgtattatgttagattattttggccaactttatgctaatgtaagtgttctgagtgcacttagggtagactgggctaagctgtgatgctcagtaggttaggtatattatatgcattttttacttataatatttttaaattacactgagcttatctagatgtaaacccatggtaagttgaggagcatctgtaataaatctctttatatatctcatattggttcagtttctctgaaaaactctgactaatacagtcccaaataaaattttgacactcctaactctgtctcattatctgcatcccaatgaacccagtctgtgacagaggttaatagaggataggagaagtgtacagattcaggatacatttgaagatagagctgacagaatgtgctgatgaatcagatatgccatgtaagacaaatatttattaaatgtttcttaaacaaatatgtgatagatattaccactcttcaccaattttgaatctgggaaattctgcacaaaggggaatgtcacattttcttgtcctcttgaagttagaggtagcaatgttcttttctctggtaaatgaaatatgaatgaaattttaaaaatggtcacttccttttgggagcaattaagaattgttgagtgtttctccatgctttcttctccctactcctataactggtaaagttcagagagtatagtctccatcattatgagtgcctgaatgagctcaatgtggatcacataccccttctgattcatgataaacaagtacagtgaacaagaaacaaacattggtgtgttaagctactgaacaagaaaatgttatgttttattacaagggcctaatctagcttaacctgactgaaatagctgttggtgctggaagtgaagtgctacagagacaaaacccataagaacctaaatgacattgactaagcagtcgggtggtgaggaaaaattcattgagaattcagagatattaagaacattgtttatgttcacacatctggtaaatgggagaggtgaatttgaatgcaactctacttgactctaaagtctacgtcatttgtcgctatagcctctcagttttggcttatgtggttggatagtggtaatctgtctttaactgatacatttattctttcaataaatattatttgtagtaatattgactatgttctaggcactgtgctagacaggcagaggaacatataaatcagtaagtgaatttttagtcatgttgagttttacctgacttcgggactgctggatggagagaatggtccagtaaaaattaattaattaattaatgtgacgaatgtgtcaagcatttatacagtttgtgttactgctggggctggagtggtgagaaaatccctcttaatcatggtttctaattctttttatacatctttgggttctatttttaatattttgttgggtttttaaaaaacatctaggttcattcaaaataatggtctggctgggcacggtggctcacacctgtaatctcagcactctgggagactgaagccggaggattacttgagcccaggagtttgagaccagcctggttaacatagcaaaaccctgtctctccaaaaatacaaaaaattagccaggcatggtggtgtgctcctgtggttccagctatttgagagcctaaggcaggaagatctgttaagcctgggagatggaaactgcagtgagccgtgattgtgccactgcagtccagcctgggtgacagagtgaaaccctgtctcaaataataataataataataataacctgtagttttccccttttgtactgcttttgtttggttttggaattaggataatacttaaatcataaaatgatcaggaagtgttgcctcctcttttattttctagaaaagattgtgtatattggttttaattattctttaaacgtttggtagacttctccagttaaaccatcttcgcatggagactcctttttctgaagctttcaatttaaaaattcaatatctttcatggttataggattgtcagattatgtattttatcttggttgggttttggtaagttgtgattttttgaggaatgtgtctttttcttctatgccatcaaacgaatgaacataaagttgtccatactattacttattatctttttaattatgtaagctctacagtggtatcccatttcattcccgatattggtgatttgtgcttttttattttgtttttctatcaagaggtttattaattgtactggcttttttgtcatagaacttccttttggtgatgtttgcagtgtatatctttttccatgctttcactttaatctacctatgtcatttaatttgaattgagtttcttgtaaatggtagcctatcttctcaaaagttcctgagaccgttttatttgtttttggccaatttccgtgttcagattagataaattctattgatatgtcctcacttcaccaagtctatcctctgtcttctccactagagcttatccaggaagtgttttcttaactcagatattatattatttctgactgagagtttctgttttttcatttgtttcaagagaatttcaaatttcttgttgaagtatttttatgatggcacctttaaaaatccttgtctagggtgtcccagccctggaaatgaataggcatctgggtggagctgcttgttgtggtgggaatatgctggatcctgctacactgttgcagcctatctctggtgataaaggatagcccaacagagaagaaaagacagcactttccctggccatttactgtcagcagatccccctggccattgctatctagctctgttggtattgatgatggcacttaagttcaattcagggaagaaatgagcctgcctgggctttctgttgtagctaggttggtgtctgggaaatgtcaagcctgggttgccttattctgttaagttgggggagtcatgagacaccctactcctacaggttgctcccacagccctgggatcccttactagtttgccttcttctttctacctttcagagatcttttttgattgcttcttgcattcgtcacatagtatatagttgtacttagcagtaaggagcagggaaaaaagtgagtccacggactggatgttcactcatagcatttttatcattttgtcattttgatttatctctattattttggggtgtatttctttgtatagattttttagttgttgctttagatattacattatgtattatacatattattgcattatacatacatttcttattatagtttacccatgtcctcatttcaccagttcaagtgaagtgtagaaaactttctaggctttaattccctttgcctcccctatttatgatacaatcatcttaaacattaatatttttctaaatactttatgaaccatacaagacaatgctataacttgtacttcaattgtcaaacataatatggaaaactaaagagaagaaaagtgggttgtattaacccctaattttgctcttttcattgttctttcttccttcctgatgttccaagatttcttcctttatcattcttttctgtttatgttctctaaccattcattcagggcagatctatttgtgacaaattctcttagtttctttaagtctcagactatcttggtttcctcttcttttctgaaagatgttttcactggatatagatttccagattaatagctcatttcttgtagcactggaaaaaggctttgtcacttccttctagacatcatgatttctgatgaaaaatccactgtcaacctaattgcttcctctttgtagataatgcatcacttctcccttgctgctttcaggaattttccccccaaatttgaaaatttttctactagtatttcttcaaacatgcttccagctcccactctctttcttgctttctgtgaggctatgatggcaggaatattaggtcttttgtaatagtccatcaagtacctgaggttctgttctttttttcccagtatacgttctctctttgttcatattaggtaatttttattattctatttcaagttcactgattcaatcttctgtcttctctagtctgcttttgagtccatccagtgattttttaaaattttggttttcatatttttagttctaaaatgtatctttgagttttctttatgtcttctatttctttgctgagactttctattttttatttgtttcaagcgtgtttgtaaatgcacattgaaacctttttatgatggctgctttaaaatacttgtccaataatgccaacatctgtgtcatctcagtgtttttttctttttgggacggagcctcgccctgttgcccaggctggaatgcaatggcgtgatctcagctcaccgcaacctccgattcctgggttcaagcaattctcctgcctcagccttgcgagcagctgggattacaggtggctgccactacgtccggctaatttttgtatctttagtagaggtggggtttcaccatgttggccaggctggtctcgagctcctgacctcatgatcagcctgcctcggcctcccaaagtgctgggattacaggcgtgagcctcggtgttttttatgttatgagactctggatattatttaaatcttttgtttcagcagatcttctctgataccatatcagtggggaaaggaggagtgttgccctataactgctaggtgagtatggaagtccagattccccacttagcctcccttggtacccagagaaggaggggttcctcattactactgggaaaagggtaggaatccccaccaggccaacactgaattactctgtctctgtgttgtagggggtacctcattactgtttccaatatggcctctactgaaaccatgggggaatgcctccttattaccaggtggggatgaatgtcacagcctcccattcatcctcctctgaaaccaccccaatgagggagaagtagtgctttgttataaccaggtgagaatgcaagtctaagctcccaacttggtctttgttagtccagaggtggagtaaggccacattctttgccatgaaatttggctggagtagggtggttattttctaaagttttctatattgttatgctgatcctttcctggtcctttggctagaaagacaaggctcttcttgggcttttttttttctgtgcccttagcatttctgggtttctagattctgcagtacccagacttggatatgtaaggcaaaaggaaaatgaacagtctcacttctgtgttgcacctcatgttctgaagttcctagctggtcaggtttcttctctctatgtttcaaaaccttcttatataggttttatatactatgtaagggtttttagctatatttagtgggaagaatagggagaagtgcatcttctccattttgttctagaaccaaaacctgactggcaattctaaatgagaattttagtttgcaaatgggctaacgatttgcatctttgcattcacatgttctcttcctgtctgcctaggaaaacaaattttattaagaagcttccttggtgagcaaataagagtcagagacaagtgattcttactagttatgtcaaggagcctaacatgtttatcactgctaccaaaaggaatttaatgttcaatttttattttcatgcaccatttttctggggtctataataacagcccattcctcctttctttactagtttttcttcagtctgtgcccaatgtagttcattaggtttcaaatttcttggattctatcctacccctttgatgtttcattcttgtcattcatatagacctcgatattgttaaattgcctcagatacaaatttgcatatatagtgtacatggtagccaatggtatatcacacaagagcatttggtatctgaataatccttgataaaattgttaaagtgaagtgaacatacgttatgggtgttataaagtgacttgatacgtttaacaagagataggattcagttatctaacattcttgtgatcagtaatattaaaaatattgtagcacactaaagacataaaaaggtataaagaatggtgcaatgcagtcccatgtactcaccatccagcttaagaaattaaactacattaaactatattaatgcttgtttttgtattctttgaaacattattacggctctgcaaattttgaggacaaagtaaagactgtaggcgttgatgtcagatcgaggttctagtccaaagtttactatttattagttaattgaccttaagcaagtcatttaacctcttagaaactatgtttcctcatctgtaaaagagtagggatagtgcctgtttcacaaggtagttgtgatagttaaatgagataattttgttattaaggtgcctcatcacagtgcctgacacccaataaatgcagtttctattgtcattttgtgtcatcctaagtatgcaggggaaacaaaagtaagcctttattcttgtcttcaaggagtttgtcaaaaagtaagaaggataaagtaggcatacaaatagctactataagatgtataataacataaattccattatcaaaatgctgtgagagttcaaaggtttggaacatgctgagatctggagatgtagctttttttttttttttttttttgagatggagttttttgctcttgttgcccaggctggagtgcaatggtgtgatctcggctcatcgcaacttccgcctcccgggtttaagcaattctcctgcctcagcctcctgagtagctgggactacaggcatgcacaaccacacccggctaattttgtatttttagtagagacggggtttccccatgctagtcatggctggtcttgaactcccaacctcgggtcatccacctgacttggcctcccaaagtgctgggattacaggcgtgagccactgcgcctggtcgagatgtagcattaaaactaggaaagcaagtatattgccatacccctcctatatccatgggcggacactactttttgatctcagatatgacctcaattttttttctcaacatattgattcagggaatcataactaatcaattggagttgtccttgaaatagagtatgtacctaaagtatgacactcctgggaggacatgaagaagaaggggacataggctgagagtgccaaatagcagaaataaaagcgatagaacggtatcaaattttaaagacagtcattgctggtgaattttgagaaacaagttatattaaattgaacctatagtaaagggcataggaattgttggggttgtgggcatcaaagaacgttgagactaaatttggatggataatccaaataaatcttgaggttatttatgataatggcagaaattgcagggggaaataagaaccagctacatggtgaggagcgatgaccaagaacatagcatagtataacaaggaagaggatttgtgtacatgttgactcccacttactagattgcggtacctgaaagtcagggaatcatacttcatcatcctggaatcctagcatctaatacagagtacaaagcattgaatatatggatgaatgaattagggaatgtgtggtgatcatcaaacgagtgtaaacaatatatttgagaacaagttgaaaataccaccctaaaagagtttatattggggttaaaaagaagtatttaaaattgagtttcctttgagtaaatcatgccctccttttcctgagattaaattggtaatttaccttattgatcactcattattatctcagtctatgtcaaagcttcttatccgtggctgcaagttagaaacacctgagtagtttaaaacatatcccaataacctggctgcaccccaggccaaatcagaatctctggggatgtgacctagtcctcagtatttttaaaagctccccagatgacttgtgctgccaagattgagaaccactgagtgacgacaagataagacagggtacaggtgtgttaacttgtataactacataaaattcagtattacagctagaattaattgtagcagtcttttttaagaaatgaaatatctcaaactcaacttctgtttacaatgtttatttaacaactacctagtactcaatatagagtttgttaactggaggactatagacaggttgagtttggttatcacagtgctgaaagttttacatcaattgccaacattttatggataaaattcagtagatttcatgtaaaattaggaacttcaaacttctcttgaaaatcagaagatttggtaacttgatatttgcattccctagaggtaccaatcaatcgaaactgagtagtagctgctagctgctgccccatttagatggaaatagtcaattttgtggggttttttatttttatttttttgagatggagtcttgctttgttgccgagactggagtgcagtggcacgatctcggctcactgcaacctccacttcccaggttcaagtgattctcttgccttaacctcctgagtaggtgggactacaggcgcgtgccaccatgcccggctaattttttgtattttttagtagagacgaggtttcatcacgttagccaggatggtctcgatctcctgacctggtgatccacccacctcggcctcccaaagtcctgggattacaggtatgagccaccgtgcgtgcctggcctgttttttttttttctttctttctttcttttttttttttttcgctctcattagaggttaatcaagtttactgatcttgcagaaccagcttttggtttcattgattttctctgttgttttttatcatttctcttacattagtttccactttgattcttattattccctttttttcctgcttactttgggattttcactttttcttaagtttctaaggatgaacatgaggtcattgatttgaaatctttcttcttttctaatgtagatattcattgctattaatttcctcctaagtacttctttaacagcatcccacaaattctaatatagtgcattttcatcttccattaggctaaaaatactttttttttttttttcagaccagagtcttgctctgttgccaggctggagtgcagtggcacgattttgcctcactgcaacctacgcctccctggttcaagcgattcccctgcctcagcctcccgagtagctgccaccatgcccagctaattttttctattttagtagagacgaggtttcaccattttggccaggatggtcttgatctcctgacctcgtgatccgcctgccttggcctcccaaagtgctgggattacaggcatgaaccaccgtgcccagcttaaaaatactttttaatttcccttttcatttaatcctatgatacatgagttatttataagtttgttatttagtttccaaatgtttagggattttccagagtttatgcactattgatttcttagttaattccattgttatctaaaaatatactttgtatggcttgaatcctttaaaatttacagggagatgttttattccacagaatatggtctattttggtaaatgttccatatgtatttgagaagaatgtacattctattgttgattagagtgttctataaatgtcagtaaggtctagttggttgattgtgttgttcaaatctgctttatatcattttgacttttctgcttacattgagagaagaatattaaaatcccttactgtatttgtggatttgaatatttctctttgcagttctatcagggtttgctccatgtatttcttttattaagtacataagcatgtatgattattatgtctgcttatgtaattgactaagttataactttttttttttttttgagacgaagtcttgctcttgtcccccaggctggagtgcaatgacgcgatctcagctcactgcaacttctacctcccgggttcaagcgattctcctgcctcagcctcctgagtagctgggattacaggtgcctgccaccatgcccagttaatttttgtatttttagtagagatggggtttcaccatgttggcccggttggtctcgaactcctgacctcaggtgatccgcacgcctcggcctcccaaagtgctgggattacaggtgtgagccactgtgcccggccagttataactattaaatatccttctttatccatgtaatattcttggctctaaaatgtactctgtctcctccaaatttagcctctctggctttctttgcactaaagttaacgtggcatatctttgtcacatcttttagttttattatatttgtggctttaaaactaacgtgcaatagatagcatatagttgtgtcttacatttttattcagtctgccaatctctgactttaaattggggtgttcagacctgttacatttaatgtcatttattactatgatttggtttgagtctagtatttttttatttgtcccacctgctctttgttcccttttccctgttttctgtcttcttttgattagtcaagcattttttctttctttctttcttttttctgagacggagtttagctcttgttgcccagcctggagtgcaacggcaccatctcagctcaccgcaacctctgctccaaggttcaagcgattctcctgcctcagcctcccgagtagcttggatcacagacatgtgccaccacacatggctaatttttgtatttttagtaaagacgggggtttccccatgttggtcaggctggtctcgaactcctgacctcgtgatccgcctgcctcggcctccgcaagtgctgagattacaagcatgagccaccgcgcctggcctagtcaagcatttttctgattctattttatctcctttgtcagttcattacttgtaactttttgttttgttattgtagtgattagtcaaatttcattttaaaggctttaaataatgaggattttaaaaaatatatttatccttttcactaccatttctggccctcttaattcctttctgtagatacatatttccacctagtatcattttccttctgcatgaaagactttaacatttcttgtagtacagttctgctagtaatggattatttcaacttttctatgtctgggaaatgtctttattttaccttcgttttgaaagatcctctacagaattttactttgacattttattctttcagtatattaaaggtgtttctccattgtcttctcgtttgcattatttccaattagaaatccaatgtcggctgggcgcggtggctcatgtctgtaatcccagcactttgggaggccgaggagggtggatcccctgaggtcaggagttcgggaccagcctggtcaacatgatgaaatcccgtctctactaaaaatacaaaaattagccgggtgtggtggtgggcgcctgtaatcctgtacttgggaagctgaggcaggagaatcgcttgaacctgggagatggaggttgcagtgagcagagatcatgccactgcactccagcctgggtgacagagtgagactgtctcaaaaaaaaaaaaaaaaaaagaagagagaaattcaatgtgattgttatctatattcctcggtatataacatgcttcttatctctagctgcctctaagattttctctttttcactgattttaagcaatgtgattataatgtgcattggtgtagctttcttcatttttcttgttcttgggattcatttatcttattagttctgcagatttatagttttcatcaaatttggaaattttcagttattattgctttaatttttttctatctcctcccactctatcttttagagactccaatgacccatctattagtcagttgaagttgtcccacttttcactgatggtcttttaatttcttagaattcattttgtccctgtgttttattttggatagtttacattgctatgccgtcacgtacactacaatgttcttctgcatatctaatctgccgttaatttccatcatcatgtttttcatcttaaaaattttagttttcacttccagaatatctattttggtatttttcatatcttccatgtctctacgtaactttttgaacatatggaacatagttataatgtctacttaaatgtccttgtctgccaattctaatgtctctattagccgtggctcaatttcaattgtttgttttttctctcaatatagctcgtatttctatgctttttttcattgttcataatttttaattggatattagatagacattgtagagtgtaccttgtttggtgctgactgtttctgtagttacataaatattcttaacatagttctgaaacatagttaaggtatttagtttgacccttttggttcatacttttaaattttgttacaggactgaaatggtgttcattttaggcctaattattttccactactgaagctatccttctgtgcactctacccaatgctccatgaattttgaggttatctagtgtagctggtgagaacaccattatttttgccccttcattcaccgcagacactgttaggtctaatctttttgggtgattctctatctggtcttgggtactttcctcacatgcatgctctcatcagtcctcagttgaatgttggaggaaaatctctgtagatatctagctatctacagctctctcctctctgatcctttctcctgcaaagtctgttcacctcagtcttcctggatgctcagctccatcttcttgatgtaccataccccagaaaatatttcaaggcaaaaattgggacagtctttgggctcacctcatttcccccacccccatcattcagggctcactatccttcatttctggatttctggatctccaatgtcttggaaactgtttcctatagctgaaacatattttggttatttcagttataagggtaaatctgttacttcttattccatgttgtccataacagaacaataaataattttttaattgaggtattttatatgcaataatatgtactactcatgtgtgtatagctcaattatttctgtatctgtgcaatcaccatctggatcaagatattaacattttcaagcacccctagcaggctacctcactactctgtcttattgaaagctatcttattcttttgttttgaccttgaggaaacttatgctagaatcaggataaatctgagtaattttactgctgccacccctactatcaatctccatcttccagaagtagtcccatttcagagattcatttttttttcccaacagatggtcattacagagtgagtatttttgtccaagaatattgggcctaagtatttagatgttcccagtttaacattgaaacccaccctgatctcactgttaccagtttattattcacatagaataccaatagatgctacagaaagtaagtgatgctaatggattatgattatgactcagatcacgaaaagcagcatggtgctgtggaaaaagtaatggcttacttcctcttttccctctttcctgcctagacaagaaatcaaaaactttattttaaaatcagcgccattttttcctgaatttctgatagaattgttactcctatatagctctgttcccccttcctgatttttgtagtattatttgtatacatatcatatccatatgtattacaaacccaataatactttattatgattattactgtacatactctcgggccttgtaaagaagctgagagatgaaaggtgagcaactatatatttatggtgtttgtcacattaaccttttaatttatcatttctgactcctatttgttaatgtgaatttgaattgccacctgtgtctttactccaataagctttgctcccatcccctcccatgtgatgttattggaaattatattgtatttatgaatgttatagtcccaacaataaaattgtacgcatttttatataattgttgttaaatgagttaagagaacagagaaaaaatatagatttacatagccatttttattattatatagtttcctttaccagtatttactttgtgtgtgtggattctgtgcgctctgtgcttttaggctgaagaagtttctttattacatttattgttagatttatctaccagcaataagtgtttacagtttttaaatctgtgaatgtatttattttgccttcatgtaagttttttattttttaatcattatttttttgagacagggtctcactctgtcacccaggctgtagtgcagtggtgcaatcacagctcactgcagccttcacctcccaggctcaaacaatcctccggcctcagcatcctgagtaagtgggaccacaggcatgtgccactaaattagccactggctaatttttaagtttttcatagacatggggtctccctatgttgcccaggctggtctcaaactcctgggcttaagcggtcctcctgcattggcctcccaaaatgttaggattacagtcatgaaccaccgtggacagctgtcttcattttaaaagatagtttttctgaatgtaagattctatgttgacattttttttctttcagcactttgaatacgtcatcccactatcttgtggtctccattatttctaaagagaagtcagttggtaatattagtggggctccattgtagttgatgagttgtttttctcttcttcctttcaatattatctctgtctttggctttcagcatttttctgtgtatggttcttgcgtttatcatacttgaagtttactgaacttattggatatataatttttaaaatcacattttgtaattttatcagtcattatttctttgaatacttttttcctgctcccttttctctcctctctccttattgtacatctgttatgtgtatatttgtgggcataatggtgtgctgcctttttctggggctctgttcatttttcttcatttcttcttctctctgtgcctcagactggtgaatcttaattgatttatcttcaagtttgttgattcttccttctgcctgcccaggtctgttattgagctcctcccaggaatttttcacttacacttttcaactccaaaattttaatttttctgttttataatttctatatctttactaatattctctatttgtcaacatacctcctttccttctttaagcgtggtttcccatggttctttgtatgtatgcataaaggctgattaaacattttttctgttatatctgacatctaggccatcccaccggcaatttctgttgcctccttctaattcctgtgcatgggtcagacacttctgtttgtttgcatgtctcatcatttttttgtaaaacatattgtcttttttcatgatctgttacgctgtctgcctctgttagtatcattccctgctattaggctccactaattgccggctgatttgctctattgttttggataacacccttgggcataaattactcaacagtctgatccattaaatttgacccctttgcaggaatagtttttgaagtcaaactgaagttccttctgactctaggaggactcttgttagctgtctctttctctgatcctccctggaaaactacctggcttgtggtttattttgcttctctcatggatctaccagactgttctcaatgctcaccactaaaaacttcattgtttttgagattgtgcttgtgcttgaacttaccacactctgttccaaataaattcagttttattgcagagagctttgaagctctcttcttatggccagtctccctcctgggcaaaatcactgcaccactgctctggggcttggagtagaaacagtggactgcttctctcagagtgaaagccctactttatgagttgagcactgggtagaggcagcaccctctggtcttcttggcttgtctctgccactgtggaacctgcactctatgagcaaacttgaacgagggatattaaaactccagtatttttggcctgccattcctgacatagagtttccaccctataaatggtggctaggtagaggaagggcaccctgggcctctcagctgcactcactttgaatttagactctgcaacataaagctggaggtgatgaaaaatactaatactggtggcctgctcaccccaagggagaaataatagcccttaaccaggagactggggaagaggaggctatattttcttggccatacccacccaaatgatagctttaatcacgctgattttgatgggggagggattgagtaggtcatggctcaagtgccgcagactttcactgttcttactgacatttatattttttgaataaatgtttcttcatttgttctatgcctttagagaaattttctgagactttatatggttgttttaaaaataatttttagcagttatggttgtttccctgtgcggatggtctgtagaacacctgatacttcctttctggaagtctgtgtttttattcatacaaaagctgagattaatggatatcttcaaattaagtagagtgaaactcagtaagaaatcagtaaaagggaaggcaaaacaaaaagctgcaggataaataaatttaggttatttgcattagctgctcatatcagtagggaaaaaatagattcagtcaaaatatgtttttggaaaaagaaagtaaaccacctggaagaaaaaaatataaaatgggattttccctcatatgtcatctagaataaattcctaatggatcaaatatttaaattcaaacattgatacattagacgtaacaggagagctgttcataatcttggaggagaaaaaggttttctaagtatgcttacaagaaattcacatcagtagcctaaaagtaaaaagatggaaaggtatatcatgaaagcagtaatcaaaagaaagatagagggccaggtgcagtggctcatgtctgcaatcccagcactttaggaggctgaggagggccaatagcttgagcccaggagtttgagaccagcctggcaacatgccaaacccctgtctctaccaaaaaaaaataaaacaaattagctgggcatcatggtgcacacctgtggtcccagctactcaggaagctgaggccagaggatcacttgagcctgggagtttgaggctgcagtgagctgtgattgcaacactgcactccagtctgggcaacaaggtaagaccctgtcttcagaaaaaaaaagaaaagaaaagaaaagaaagctggagtggttatattaatatcagacaaattatactccagagcaaagataattcccaggaataaagaagggcattatataataataaaaaggttccattcaccaagaagacataaccttcctacatgtgcgtacactaacaaaagagtttcaaaatacgaggggacttcaaaaagtttgtgggaaaatataattaaaagataaaaataaaaactataaactttatttctcaacattagctccatcaagttcaaaacacttttgtaagcaaagattccagccatttagtccatatctaaagaactgaagggcctggaaatttaaccatgttaatgtaggtttttgtttgtttgtttgtttgttttttacattattaatcgaagagaaacaagcaccttttaaagatttttttaagattaggaaacaaaaagaagactgaaagagccaaatcaggactgcatggttgatgcctaatgatttcccatcaaaactctctcaaaattgcttttgtttgattagaggactgaacaggagcactgtttatgtgaagcttttctgggtgtttttctgcttaagctttggctaacttcctcaaaacactctcataataaacagatgttacttttctttagccctccagaaagtcaacaagcaaaatgcctcaagtataccaaaaaactgtttcctttacctttgctcttgaccagtctacttttcctttgactagaccactgccacctctttgtacccattactgtgattgtgctttgttttcaggatcttactggtaaagccacgtttcattttctgttataattcttcgaagaaaggcttcaggatcttgatcccacttgtgtaaaatttccattgaaagctctcctctttatctgctgccgatctgggcacaatggttttggcacccattgagtggacagttagctcaactttattttttcagtcagaattgagtaaactgaaccagttgagatgtgtatggtgttggctattgtttctgctgttactcatcagttcccttcaattagggcacaaacaagttgaatctcttcctcacaaatttatgtggatagtctgctgctgtgagcttcctcttcaacattgtctcattccttctttttttttttttttttgagacagggtctcactctgtcacctgacaccctggcactgcacagggtggagtgcagtttttgtgattatgtctcactgcagcctcgacctccctggctcaagtgatcctcccacctcagcctcctgggtagctgggattagaggtgcacaccaacacacctggctagttttaaaattttttgtagagatggcgtctcactatgttgcctaggctagtctcaaacttctaggttcaagcaatcttccctccttggcctatcaaagtgctgggattatagatgtgagccaccacacctggccttcatcccttcttaaaacaggttatccatttgtaaactgctgatttcattttttaaattttcttttcttttttctttctttctttctttctttctttctttctttctttctttctttcttttttttgttgagagtctttctctgttgctcaggctggagtgcagtggcacaatcttggctcactgcaccctctgcctcctgggttcaagtgattcttgtgcctcaccctcctgagtagctgggattacatgtgtgcacccgtaatcccagcactttgggaggctaagtcaggaagatcacttgaagcttggagtttgagaacagcctggccaatgtggtgaaaccccatctctactaaaactacaaaaaaatatataaactgctgatttctttgggcattgtctctgtaaacttttcataaaacatcaatgatttcaccatgcatccacccagcttcaccataaatatgaggtttttcttgtttcaattgtagcagaattcatgttactctcacaggcgctctgttcaaactgatgtcctatccttcatagcgcttcaagctagatcctgttcggacatgttagtgtttattttggtgcaaaaaatttttgaaatccaggcatagttttttttataatatgtatttccatgaacagtttgaagacccctcatatataaagcaaaatctcagaggctgaaagaacaaatagacaaattcacaaatataatcagggacataaacactcctctctcaataattaatataatattttacatagtaaataaccaaggatacagaataactgaatattatcaattatctctagctgatatttatagagcatttcactcaacaacaggagaatgcatattcacattcttttcaagtgtacatggaacattcaccaaattgaccatatcttcagtcataagacaaaatttaacaaatgtaaaagaactgaaatcatatattgtaagtttgctgatcataatggaattaaaaaaacaatagtggaaaataacaggaaaatctccaaatacttggaaattaaacatgcatttctaaagaacccatgggtcaaagaggaagtacacactggagacagtggctcatgcctgtaatcccggcactttgggaggctgaggcaggagaattgcttgagcccaagagttcaagaccagcctaggtaacaaagcaagaccccatctctacaaaaaataaaaaaagattagctggacatggtggtgtgcttctgtagtctagctactcgggagactgaagcaggaggatcacttgagcttaggagtttgaggttatagtgaactattatcatgccactgcactccagcctggacaacagagtgaaaccctgtctcaaaaaaaaaaaaaaaaggaggaactacaaaggtaaaattagagatcattttgcactaaattagaatcaatatacaaaaatatcaaaatacaaaatataaagattggtgggatgcagctaaagcagtgcttagtggggaacgtgagtcaaattgttgaaataaattgtaaaagtaccagcaaaactaaggaccgaccttattgctagtttccttctttgctctgaccacattttggtcatttattcatttaacaaacattgataaacacgtattttatgctaggctcttaagtgtttaaatgtcatctttagctctaggctctgggatcctagtgtagtgtctctgggtgtagcatagtatttgggacatggtaggtgctcagtatatacttgtggactgactaaaaataaccacaagagatcctcccctgtggtgagaattgtggcgcagatttgggggccaggagaactttctggaggtagtggcaataaataattcagttctaaacttgttctgaaagtatttaaccagagtacggatttttattattgaaacattttttttcagttttcattttcttccttttcttggggagtatgtaaaataatgcaagaatgctttctaaatgagtccacgtttattctttggatatttgaatatggtatgtaactctggatacgatctcaaagcaaaaatgatttagattgaagatttttgtaaaaagcttgaaattgaagtataccgctaatacaaatgaactttttaaaagtggtgtgccagaaaacagtaaatcagtttggtaaatatgtaactgtagacatccaagacagagaaaatgaggcctgagttaagggactaagatgaagggagatatttctaaggcgaatcaacaaggagaggtggcgaattgtacatgagggatttggcagagatactgcagctcctggcacgacaagaattaggatttgtaaaaagttagtgattctctctccctgccggtttacatcacaacgtaggtgttgatctagggagggagtcaatgagatagagcattgcagagcttgctagagaggcacaggaagttgcctgaagtgaaggagggggtagcggctgcagaagctaaagcttccgccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtctttcctgttcccctcccgcggagaccagtaaattacgtactttgcaacagtaggtgtgacttcaaggtcaaggcttttttttttttttttttttggttcttttaaagtataagcaaagaagcagaaaccttagagccctaagaggcataggcacttgtccaaatgatgttcttttttttttttttttttaactctaaacaaaattacacatcatttagatactattgcacaggtttcagtcttctacacattgcatttatttttttatgttgccatagaattgaatcctcagattttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaataaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtgttctcagcactggagatacaacagtggataacaaaaacaaagtcttttaaactatagctgggagacagacaataacttaatatataaacaatatatattggcaagtggcactggtgttaaatgaacgaaacaaaaaaatacatgaagaaataaaaaagaaaaaaacaaaaaaagaaataaatatgtaataggttgtaatgtggacgggttctactattttagataggatgggcaggaaggcttcactggtaaggtgatatttgagcaggaacctgaaggaactgagggcacacactatgcagatattaatgggaaaacaggatttatgtcatagtctttgcatttgttcactctgtttcctaacccgcggccaccttcccattcccctagtggtcacttttctgcatagcattaattcaacgctctgcatactcaaataacctgatccattcacattaatttctcatattctcttcctcctggctagcttcttgctaccatttaggcgacttgtcagcctctttaggaagacatatcactatctccatattcacctcatcctcagtttgttgattgctggtgcattgtgtgctatcctacaggatatttgattatctctctcgctgctcttaccactttgtgttcataatatgttgtccataaatatttggtacggtaaagtgaaatgaattcagtgcttgtttataaaagataaaacttttaaatatggctttccccctaatgttcaacactattctctaaggtcagtattatcattgtcattttactaatgctaaaaccaagactaggaggtatgtagtaacttgctaaactgtggtacagtttatggagttaaggtttttcaggcactcagtcctggtctggttctctctatctgtttcttaatgagaaataaaaaatatacagaatattttattattttataagacaatccgggtatagaaattttattttttgtgcttctttcacaacttagatcatatcaggtgcttgaattactccctaattataaatattaagctctgagaggcatgaataatgcctctttttaccagaatatttttaaataaaaaattaaacaagcagaagttgaaagaagagtacaatgaaaacttttatattctggacctagattcaacaactgttaacctttgccatattagctcactctctctattactcactctctttctccatgcatccatccatccatccatccgtccatccgtccatccatccatttatccatccatctatctatttttttatctattttggctgaaccatttgacacttgcaggcattattttaagtaaatgtaaatacatgcagaaaagtgcacattgtcctaagtgtacagctcaaagcattttcttttcttttcttttttttttttttttttttttttttttgatggagtcttgctctgtcccccaggctggagtgcagtggtgaaatcttggctcactgcaacctccacctcctgggttccaacgactctcctgcctcaggctcccgagtagctgggattacaggcacatgccaccatgcctggctaacttttttacttttagtagagacggggtttcaccatgttggccaagctggtctcgaactcctgacctcgtgatccacccgcctgggcctcccaaagtgctgggattacaggcgtgagccaccgcgcccggccagctcaaagcattctcacaaagtgaactcggctgtgtaaccagcatcaagatcgggaaattttgaaagcccctaaatgtatcccttatttgttactattccaaattaatcacaatcctgtcctctgtcattgtataataataattttgtctgtttttaaactttaaaaagtaacacagtttgtgttaattttttggcttgaggatttgtttttgagattcatccatattattgagtgtagtagtaattcctctattttcattgctattccattgtatgaatgtaccacaatgtagttatccttttattgtagatgacatttttgttgttttcattttcagcttgcaaatagtattgtgagcattctagtacatgtcttttggtgatatattcacacatttctgttggacatatacctaagagtagaattgctgaatcacaggttatgtataagattaattttagtaaatactgccagccagctttccaaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaataccactgtcttaattaatgtaacttcacaacatgccttatgtatggttatgtgagtcttacacttttgttctttttcttcaataatgccttggttattcctggtctttttccttatacgttttagagctagtcaatttctacaaacattcttcttggcattctgattgagataccatctaacagatcagtttagggagcagatatcatggcacgtcacccttaaatatctcagcattcatctcctaatattagcattactttgtagtaattaattaccattatctcactaaggaaaattaatgattccctaatatcaacaaatacctaatcttttcaaatttattttcctcaataagcctttgtaagctggtatttaaaactatcatccaacctagattaatgtattgttaagtttttggggattttattggtgttattttctctcctttgttgaacttgtgaatatttatatatttagtacttttcaatccattgcagtcattatttcttctgttgttccaactgtccaatcatgtcaagtgggagcccattcacattcacattggcttctgtgtcttttctcttttgttacatacattttcaaatatattcaaagtagaaaatagtaaaataggctgtgcatggtgactcacccctgtaatcccagcactttgggaggccgaggtgggaggacaacttgagcccaggagttttagaccagcctgggcaacaaagtgagaccccatctccacaaaaaatttaaaaattagctggacatggtggcatgtgcttgtagtcccagctacttgggaggctgaggggggaggatcgcttgagctggggagtttgaggctgaagacagctgtgattgcaccagtgcactccagcctgggcgacagagtgagaccctgccttagaaaaaaaaatagtaaaataaacatgaatgtatccattccccagcttcaataattaacaacattttgccaaaactggcaagttttgttttatctattctcacccatttttttccacatcccagatatgtcattacacaggtgaataactcagtatgtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttataaagcccttgcatagtcccctttttattttattttattttattttttttttgagacggagtctcgctctgtcgcccaggctagagtgcagtggcgcgatctctgctcactgcaatctccgcctgccgggttcacgccattcttctgcctcaggctcccgagtagctgggactacaggcccctgccaccatgcctggctaattttttgtatttttagtagagacggggtttcactgtgttagccaggatggtctcgacctcctgactttgtgatccacccgcctctgcctcccagagtgctgggattaattacaggcgtgagccaccgcgcccggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccattgatgataattgcctagattcattatttctgtagaggttgaaaaatggtgatatttaattctttcaatctttctgcattattaactggaattactttataaagaagactttttccttatcagctattttttgtcctgaagtatatttcataataatcaagataaatgatgctgccgctgctgctttttttcatttatcagtgttcatagtaatgagttggtttcttagcaaccgccactgttttctttaatatcattaagaattcatggatttttatgtattttaagtgtatcaacccattgtggtcattttttaatgcttaaacagtgtcatcttataaattaggagccccttctgttttcacttctatgttttttttcacattatctcgttagtctttgttggcgtccttgctttttggcataagctattttaggctcatcatgtacactccctgccccacccctggaattagccattttacaaggaactatgtaatttttcagtgaaccttggtatttagaaactaagatgggaatactcaggggattattattttaaaagtcatgctacctgatctttagttgtgctcttttccctgctattgtgaatacattggaatgactcttgcagcattttattgaaaattcgctaaacatggctttcatttgtttatgtagtcattcattcagccaaaatttatagaatgcttactatcatgtatctggtcttatgctgggcacagggaatgtgagggtaaacctgactggtctcctgtccttggagaagactcattctagtgtggatatgagcaaatacgcagtgtctaaagagcagtgaacagtactgtgttcatactctttagacactgagcatactctgggcataggcaaatgggctataggagcacagagaggacatcccaaaatgctttggaaagggaagataatgcttgatactggtgagtaaatgaggtatgaaggtagaagagtaatgaagagtgttccattcagcaaactggaagaagtaggggggaatcttgatatagtcaaggaaaggcatatatgtagttggttatgatgggaacataattgtgtaagtttttcagttttcagaagattgacaaaatagtctatttaccacagacatgaagatgtaaaatgttgtatgtatgtgttgttgatttttattttaaatctgataatgaaataatccaaattctaattaaaattagtatttaatgtacttcttggacctgatcatattttttagttatttcattaatgttaaagcatagttacagttaggagatgtctatttcgtgttttagttcactgcttctttattttttactattattttgctttatacgtgttaagaatctgaattttcaagatatgacattaaaaatagtggcatatttattgtggctcttcatctcccttcattctttggctgctatttgtgtcaacccgtttaataccataattacagccccttacatactcacaaggcaaagttgttccagaaaacatgtcatctctctttattaccaattggacattatactatacctgttacattttacagcatgttgcacctgaggctatccatctgacagatactgcatgaatagtatgttaaacacaggtttgtggtttaccggagtgctatggtttaccagttgggaattttgggaccgtgagtgtgggagaatcactaggcttaggaaggaaccacatctcatatgtggccaggaggtgaaggggtgttctagaaatcattgaagaatgtggggaagcttattttttaagggggattctagaggtcacaaagaaaagattccaggtgggaaggagagcagtgaaacagtagattaaaggggaagtgggagtagattactacttttcattctctctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaataaataaataaataaaaaactgaattttgacaaaaaaaagctgtgagtgggaccagagagcaagtggtcattggtcatttagacgatgtaaagtagctgactggatatgccatttagccttgagcttgaaagtacctaaaataatgggcaatttagaggttactctgtggtctagtaaagctaaggaaaaggggcaaatggaaaggaatagttttataaatggtgtccccattctcccagcccatggcaaccactaatatactctctgtctctctgaatttccctattctgaacatttcatataactagagtcttgaaatatgtggccttctgtgtctcacttcttccagttagcatagtgttttcaaagtttatccatattatagcatgtcttagtatttccattccttttcatggctgaaagatattccattgtatgagtataccaccttttatgtattcattcatcagattgtagatggacagatgagttgtttctactttttggctattatgaataatgctgctgtgaacttctggtatacgtttttgtgcaaacatatgttcttctcatttctctggggtatatgcctaggagtgaaattgatagtaactctatacttaactctttgaagaactgccaaactcttttccaaaatggctctaccacttaaattcccaccaggaatgtataaggttccaatttctccacatccttgctaacacttgttgttttcctttttttttttttttaaattacaaccatcttagtgagtatatataataaagaatctcacttaatttttaaaatataatatttaaccgctgacatctttttttttttttttttttgaggcagactttcactcttgttgcccaggctggagtgcaatggtgccatctcagctcaccacagcctccacctcccgggtttaaccgattctcctgccttagcctcctgagtagctgggattacaggcatgtgccaccatgcctggctaattttgtatttttaatagagacggggtttctccatgttggtcaggctggtctcgaacttccgacctcaggtgacccacccgcctctgcctcccaaagtgctgggattacaggtgtgagccaccatgttctgctaactgctgacatcttttaagcctcacctctccctcttcattttctgctccacaactgggcaagttaattagaaagcatgagtgcttcatcctttggagctagcaagagattcaaaccatgcaagtgtcttcctgaatgtaagaaccctcactcctgcctcatcctttaaccacagtaaaaactcaatttagtttcctttccttgctttttctaacctgcttaggagacttgccttgctgtccccagaaatgcattgtttatgtaagtaagtagtaaacattttcataccctctttgtgtgtgaggtgttatcaatctgaacactggaatcaaaatttgggtggggtccctccttcttctgcaggatggcaagaacaattggcacagtgagcttggtgctcagataatgacagccatcatggggggaagggagtatctttccttaattgctttggctcactaattggttctgatggcaagcataaacattgagcctgcaagggtagctagttttttagttgtactgtgctgtgttgtattgttgactcctgtagaacctctcttacagatttagctaacttggaagtttaggtaatttaatggacattgaggaacagtagtatgggatccttaaagtagccctggatcatgtgtctcagcccagacctatttgtgtgtcttaacgtaaagctgtgactgatgctaggctcaggaggaaaaccatgtctatgactagctggttttgtgtctcaattaggctctgaccctgacagctgactgcccattgggtggtcgctcttgagagcagtcatcagggagtgaaaaaaagagagagaaaagagaaaagaaacagctattatgtggcttgctggggtctggacttcgaagcacaaatgactcactagaacccttaaatacctccgttgttatggctgttgctgctgctgctgccgctgccgctgctgctaccgccgccgccgctgccgctgccactgccgccaccaccacctgtgcttctgttgcaacaaagatcctgatcttcaggattatagggaaaaacattagtggcacccctgtagcatggagaaaggggtaattcaaacccataaagctcctagtcctttaatcttatatgaccaccattgcctttggggaggccccttacagtgacagtgctgatttgagactttctgcaggaagacatttataaatatgagcaggttagggaccccgcagaaatatatccagtaacaacagcaacaaaaaaacaagtacagtcatgtacagcattatgatgttttggtcaatgacagatcacatatgaggacggtggtctcataagactataatggagccgaaaaattcctgtcatctagtgatgtcatagctgttgtaacattgtagtgcaatgcgttactcacgtatttatggtgatgttggtgtaaagaagcctgtagtaccagtcatataaaactagaacaagtaccattatatatggtacataatacttgataatgataaaaaaacagctaggtgtggtggctcacgcctgtaatcccagcactttgggaggccgaggcaggcagatcacttgaagtcaggagtttgagaccagtctggccaacagggtgaaaacctctctcttaaaaaaaaaaaaaaaaaaaaaaagaaattagctgggcgtggtgacgcacgcctgtggtcccaggtactctggaggctgaggcatgagaatcgcttgaacctggggggcagagcttgcagtgacccaagattgtgccactgcactccagcctgggtgacagagtgagaccctgtctcaaaaaaaaaagatgaaaaacaaccatgtttatgtatttactataccataatttttatcagtattttaaaatgtagtctttctacctattaaaaaaaaagttaactataaaagagccacagacaggtccttcaggaggtattccaggagaaggcattgttataggagatgacagctccatgtgtgttattgcccctgaagaacttccggtgggacaagatgtggaggtggaagacagtgatattggtgatcctgactgtgtagggttaggctaatttgtgtgtatcttagtttttaagaaaaaagtttaagaaataaaaaattttaaacaaataagcttatagaataataatataaagaaagtatttctgtatagctgtataatttttttttttttttaagatggagttttgcttttgttgcccaggttggagtgcaacggtgcaatctcggctcactgtaacctccgcctcccgggttcaagcgattctcctgcctcagcctccggagttctgggattttaggcgtgtgccaccatgcccggctaattttgtatttttagtagagacggggtttctccatgttggtcaggctggtgtcgaattcctgacctcaggtgatccgcgcatctcggcttcccaaagtgctgggattacagatgtgagccactgtgcccggccatgtgtttgtgttttaaaagctaaacatcattacaaaagagtcaaaaagctttacaaaattttaaaaagtttataagtaaaaagttatagaaagctaagcttaatttattattgaaagaaatgtttaaaaaatgattttagtgtagcctaagtgtactaaagtgcacattagtgtacagtaatgtcctaggccttcacattcactcaccactcattcactgacccacccagaacaacttccagtcctgcaagctttattcatggtaagtgcccagtacaagtgtaccatattttgtctttttttttttttgagatggagtttgactcttgtagcccaggctggaatgcaatggtgcgatctctgctcactgtaacctcctcctcccaggttcaagtgatttctcctgcctcgccctcccgagtagctgggattacagatgcctgctaccatgcccggctaatttttgtatttttaatagagatggggtttcaccatgttggccaggctggtctcgaactcttggcctcaagtgatctgcctgcctgtgcctcccaaagtgctgggattacaagcgtgagccaccgcgcctggccatatttttgtcttttataccatatttttactgtaccttttctatgtttaggtaggtttagatacacagatacaaaaatacacagatacacaaattgtgttaaaattgcctacagtattcagtacagtaacctgctgtactggtgtgtagtctaggagcaatagtccataccatataacacaggtgtgtagtagtgtataccatctaggtttgtgtaagtacactctgtgatattcgcacaacagtgatgaaatcacctaatgacacatggcatttctcagaatgtatctccattgctaagtgacacgattgtaaaagaaagaaaaaaaaaaaacagatatgagaggcagaggaaacaaacagaaacggagatccacaatttgacccaattagaatccagaatttatggaaaaattttactaaaagagcaaaaagataaaagggtgctgattggtgttgaaatgcagtgggtggcaaaacttcatgaccttaattactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagttcatcttgaatgggggtcccctccaacaagaggttctagaatctgtcaaaattgcaatatgacactaatgacaattagtcactaacgacaatatcgttagtgaccccagatgcgcttcaccatagaggttttagcaacttcctcatttctccctctggaacatccatcattgccataagttgccaagggtttctgaggcaagagactgtcatccttggacctgttttatacaccattagagtgacaattgctagctgcatagtggactgtcttagaaatagaggctatcacaatccctcagcctgtgaccctccatatccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacctcacagatacccaaaatgtaaatcaagttaacacatttatcttcacatagtgaaggtcaaacataaggtctcaccaagagactccttattttccttcagaatttgaggcatcattgatagtgatgaaggcactcatttcatttcttagaatatacagtcctgggcttaatgaaggaatacaacaaaacatttactttctttacagacttcattctgaaggacttacagagcaccatactggcttcattaaacaaatgtatatttgattaaatgaacatggcacatttcagtcattagacaaacatcaggggtgaattgtaagattctgactctattttttcaagtttgctgactttttttttaagcttcaccttcttcccctctgccccacatcgggacaaattgataagaagctctggttgctccctccttgggggtcaggaaaagattcaaaccatggaagctccttcatgtgtataggaagccttacactgggccctaaccacaacgaaaacccaagcttgtctcctttccttgttctgtcaagccgtttcttacctgcttgggaagcctgaccttctccaccaagaaaatcttcatttaggtaagtattaaactttcttgtaccatcttggtgtgtgtaaccagtctcaacgtctaacctaagtttgggatgggggtcccttcttcctcttcacagtgtcaagtagtacctgattgaggttcttatttgcatttccctaatgactaatgatgttgaacgtatttccatgtccttatcggctatttgtatatcttctttagagaaatatctattcaagtcccttctttttaaattacattatttatatttttaattgtttagtcatatgactttttatgtattgtgggtattaggtccctaacagatacatgattttcaattgttgtcttccattttatgggttgtcttttcactttcttgatagtgtcttttgagtacaaaagtttttcattttagtgaagtccaagctgtctaatttttcttttatagcttgtgtttttgtgtcttatataaaaattgttacctaatcaagttcacagtgatttacacctatgctttcttctgtgagttttataattttagcttctacatgtaaatctttgatctcttttgagtttatttttgtatgtggtgtgagataggggtccagtttcatttgcatatagatatccagttgtcctggcaccattgtttgagagactatacttggcactcttgtcaaaagtcaattcaccataaatataagggtttatatctacactctcaattctgttcatcagtctatatgtctacaattattctagtaccttagaatcttagtaactgaagccttgtagtaagttttgatattgggaagtatgactcctccaactttgttccacgttttcaaaaggtgttttgaccattttgagttacttccattttagtattaattttagggtcagcttgtctgtttctgcacagaaggtatttagaatttcaataggaatttcagtgaatctatagatcagtttggagagtattgccatcttaacaatattaaatcttacaattaatgaaaccaagtgttttcccatttttaaaggtcttaaatttctttcagcaatattttgtagttttcagtgtacaagttgtggtcccacacattaaggtccccatacccagtattgttgacaagtctttcacctccttggctaaatttattcctaagtgttgaatttttcttttatgctactgtaaatggacttgttttcttttttaagttttattttatgtttaattgatacacaataattctatttatttatggggtacagtgtgatgtttcaatagatgtatacattgtgcagtgatcaaatcagggtatttagcatattatcacctcaaacatttatcatttccttgtggtaagaacactcaaaatccttcaactagttattttgaaatgtataacgcaatattgttaattatagtcattctactgttcaatagaacaacagaacttgttgctcctatttaactgtaattttgtaccctttaactagtctttctgcctctcttccaccccactttttccctctactctcctcagcctctggtaaccactattctaatctgtacttctatgagatcagcttttttaagattccacaaatgagtgagatcatgtgctgtttgtctttttgtgcctggcttatttcgcttagacttgttttcttaattttatttttggatttttcattgcaaggtagaactacaattgatttttgtttatgatcttgtaacctgcagctgtgctgaactcatttataagttctagtagtttttagtggattccttagaatttttacattcgagatcatgacatccacaaatagagatagttgtacttcttcctttataacttaagtgcctttcattgtgttttcttttaaaattgcccttgttagaatcttcagtacattgttgaagtggagagagtagacatccttgtctttttcgtgattttagagggaaagcttttgatcattaattatttattgatattattattattattagagacagggtctccctctgtcacccaggctggagtacagtggtgcaatctctgctcactgcagcctcgacctcccgggttcaagtgatcctcctgcctcagccccccaagtagctgagactacaggcacatgccaccttgccggatagtttttgtattttttgtagagactgggtttcgccatgttgcccaggctggtctcaaacacctggactcaagcaacctgcccgccttggcctcccaaagtgctaggattacaggcgtgagccactgtgcctgggcctgatctttaattattaagtatggtgtttctgtgactttttcctagatgccattatcaggttgaagaaatttccttctgttcctagtttaagggttttttttatgaaaagttatcgggcttaatcaaaggctttttctatatccattgagatggtcatgtggttttcattttttatgctgttagtatagtgtattacactgcttttcatatatttatccagctttttatttctggaatagatctcagtcatggtgtggagttctttttaatacgtgtcagaatttggtttgcttgtattttgttgaggattattgtgcttatattcataagggatattggtctgtaggtttcttttcttgtaatgcctctgtctggttttgctatcagaacaatactggcctcacagaataagttaggaagtgttccctcgtcttccctccttttaaggagtttgtgtagaatttagcagtgaagccgtcttggccttggcttttatttgtgggtagtgttttgattactaattcaatgtcttcacttgttataggtttctttatcttatctatttcttcctaagtcagattcagtagtttttgtttttctaggagtttgttttatttaagttaatctgattttttgccatacacttatttatagcatttttttataagattggaagtaatattccctctttcatttcttattctagtaatttgagtcttctatcctttttcttgtcattctggttaagggtttgtcaattttgttgatcttttggaagtaccaacttttattttcattgatggctctctattatttttcgattctctatgtcatttatttactccttggtctttgtattatttccttccttctgtttgctttgagtttagttttctttttatagttaattaagatgaaaagctagggtcattgttttagatctttcttgtttttcatatatttatccagctttttatttctagaatagatctcagtcatggtgtggagttctttttatacgtgtctgaatttggtttgctagtattttgttgaggattattgtgtttatattcataagggatattgtaatatagttattacaactataaattttcatcaataaaaaatactgctttcactgcatctcatatgttttggtaggttgtgtttaagttttcattaatttcaaagaactctctcatttcctgtgtagattcttatttgacctttggcttatttagaggtgtgttgtttaatttctacttttgaattactttacaaaatatctttctgttactgatttctaatttaattccattgtggttggtgaagatactttttattatttcagtccgttttatggagacttgttttatgatctaacatatggtctatcttcgatgagaatatttaatatgcatttgagaagaatgtgtattcatctgttactgggttaagtgttctatagtgtctattaggtgcagtcttctttttccttgttgatctcctgtctgattgtttttatctgttattgaaagtgggatattgaggcagccagaatatgttattgaattgttcatttctctcttcagttctgtcagtttttggaatctgttggtagatgaatgtaagtttatcatagttatatttttgtgatggattggcagcttaaagattgcaaaatgttattctttgtctgttttaccaatatttgttttaaagtctattttgtctgctattagtataaccactcctactcttttttgggtaatgtttatatggtatctctttttccattcttttacgttaaacttatttgtgcctttgaatctaaaatcattctcttgaagataatgtatagttgggccataactttttttgtcgatttaactagtctctctctttattggagagttcaatccattcacatttagtgcagttactcttcaggtagaatttacatgtgtgttttgttatctgtcctccttatgtcttatgtcacttttgtttttctattcttacattactgctttcatttgtcttaaatattttccactgtgccatttcaattcccttgttgtttctttgctatatattttggtattttttttttagttcattctttggagattaccattaacatctcaattgatgagaatctagttcagatttatatgaacttactgtcctagaatacaaaagctttgcttctttaatagcactgtaaccttctttatgttgttagtgtcacaaattacgtctttttgcactgtgtgtccatcaacgtagatttataattattgtggtagtcatgttttaagtcagactggaaaacataggaattgcaaattttaaaaaagcaacaactatatttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctgagcatgcacacagccctatacatgcagatggtcttctatattccctagaaaatatcagaactcttcaaatcccctattgatagcttattcctcagcttttcctttcattctttttatttagtttattgtttgctccaagtgttatcatttgtggaggggcttttagtatgggttttgcactgaatcaaacataaaccttttaagtagcgtcttctggggaaccaacagacaggacaaataatgacagttctttagaactgaagctttgggagttgatgccactgctaaacagctgagccagctaatgtagttctttgacagcacagaaatgtagggagaaatgagcagcccctggctgaaatgccgcagactctccttgttcttacttagttctgtagattttgttgccgttgatcaatccccagagactttaggtgattggctttgcttgttttgaccagttttattagatgtctctttggggaggagatttcactgagctcctcacatagccattccagaattcccataagtttggtgttgtatctaaaacctcattgctaaagcctaaggtcatgcaagttttctgttttcttctagaagttttataattttctgttttatatttagattcgtgatccattttgaattaattttcatgtgaagtgtgaggtttgtgtcataattttattttgcacatggattccagttgtttcagcaccattttttttggcaaagattgtccttctccattgaattacctttatgcttatgtaaaaaaaaatcagttgactaaatgaaataaactgattaaaaaataggcaaaagacctgaacaaagacacctcaccaaagaaaatatacagataatatataagcatgtgcaaagatgctcaacagcatatgttattaggaaattgtaagttaaaaaagataccactacacatttattagaatgttccaaatccaaaacactaagaacatcacatactggtggaaagatgaagcgacaggagctctcattctttcctggtgggaatacaaaatggtatagccactttggaaaacagtttgacagtttcttacaaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctcaaaaaaacaaagaaaaaaaaaagaaagaaaaggctacatactgtatgattccaagtatttgacattctggaaaaggcaaaactatggagacagtaaaaagatcagtggcttccagggtttgggggttgggaatggatgaatagacggagcacatgggatttttagggcagtgaatctactctgtatggtactataatagtggatacatgtgtttatacatttgtgaaaacctatagaatgtacaacactgagagtaaaccccaatgtaaactatgaactttaggtgagaacgatatgtcaatataggtccatcaattataacaaatatacatacccttctggtgggagattttcatagtgagggtggttgtgcatatacgggagcagagagtatgtgaggaatctctaccttggactcagtttttatgtgaacctaaagcttatctaaaaactaaagtcaattttttaaaagtcaactgaaaaaaagaaatgcttctctctcccacaccttgccccaatcctcaggcaataataaatggttttgcggtatcaaaaaaaatctgtgattgtatttgtgtggatctatttatggcctccctattctgttctgttgatctatgtgtcatttcttttgctaatactatggcaccttgattactatagacttacactgcgacttgaaatcggataacatgagtcctctaacttggttttcctttttcagagttgtgatagctgttaggtcatttgccttttcatgtatattttttagattcagtttagctatgtctacaaaatgcttgctaaaattttgattggaattgtgtttatatggctttaattgagcattttatctctctctttgcatatcatttatacttgtttttcttaactttttagtggttaccctagttttcacagtacacatttttaatctaagtctttcaaatactattgtattgcttcctgtgtagtgtaggtaccttataagagttatcccccgtttctcccttgctttctttttgacattgctgtcatccctttcacttacttatatgctacagtcatttcatacattgtagtgtttttactttatacacagttacctcctagattgattaagaaaaataaaaagttttatattacttatatttatttttctctgactttctttatgaagattcaagtttctgacatgttgttttttttttgtgcctggagaacttcttttgacatttcttgcaggacatgtcagcttatggtatccagcagtttctctaccatgtaaacaaatcataagtgctagatcttcctgtctctccaaatgttcaagtggtgatttcccatgtggcctcagttctctgatgatttttaaaaagttattgattttcattttgtctagcttttcggtcttgtaagggcaggagtgacatcttcccagttctttacaatttggagctacaattagaggtgctcacatatgtatttttaaatttttcttgtggatatgttgccaaaaacagtaaaaagaaaacaggtgaaattaattttaataaagtattttattaaacccaaacaacaaaaataacattttaacatgtagtctgtataaaaatacttaagagctattccacattaaaaaaaaaactcttctaaatatcatatggattttttctacttgtatcacatctcactttgaactattgcatttcacgttatcagtaacccaatgcggtttgtggctattgcattgggcagcacatgtccaaagagaatatgtagaaagagaaggaaggagagttgaggatgaacttttggggatacagttaggtattaagcagaggaagagaggcctaaagacagagaaagaaaagtcagagaaaaattgaagacagcaaaagtataactgaaacaaagggaagaatatgtttcaaggaaaaataagtattcaaatagtgtcaaatgtggcgaggagctcagggtagatatggagtagatatgggaattgacaaatggaaaagaatagagaatacagaaatagaccagtgtgtttgtgtatgtgtgtgtgtgtgtgtgtatatgtatatatatgtgaaattagtaaatgaaagaggtgtcaacataaattaatagagcagagtatatcattcaatacatggtgatgggacaattgattatccatatagaataaaataaaataccaacaccaaaaacaaaccattaattttttatagattataaacccaattatgaaaagcaaaactttaatttttaaaaaaaaaaattaggggactgtttattatctcagggaagggaagggttgttgaaacagaatgtataaagaatgcctataaatcaatgataaaccatccaatccgaaaaatgggcaaagttatgaacaggtaatttataaaaaaggaaatacagaagtccaataaatacattgaaatgtggtcaattgcactaataacaaggacaagggactgaaaatcaaaataatgaaatgtcacttttaacatatcaggtaaaaattttattgtttgacaatacctggtattggcgtggttgtagggaaacagtagtcttcatatatggctgatgtgggtggaaagaaatacaatcacattcaaatgaaattaattgtcaaggatctagtaaaattgtagatgggcatttccttctgttgcaacatttccaattctaggagacatggaagaaaacattgcggtattacgtgatattgtgaaaaactggaaataaactaaattccccaactgttccaaattaataggggaatgatcaataactcatcagtcatcatctattcatacagtgcaatttaatatggcagtgaaaatgaagaaatcacatcaatatatatcagtgtcatcttaaaaacataatgctgattgagaaaagtgagttacagaacaatcacataatataccatttatataaacttaaaacatacaaaaatactatatattgctcatagatacagatgtgtttgaaaatgtatgtataaagaaggaatagaaatgatgcacaccatatcaaatttggttgcctctggggagaggaaaggataatggctaggggtgggtttaaagagtacttcatctttatctagaatgtttagtttatttcataaaatagatgaagcaagtgtgactacatttttaaaaatgttagcaattgttaattctgggtggatattctatattattctatatttttgagatatttccaaaataacaccaataccaattaaagtttataggagatgaggaaagaggaaaaaaaaaaaaggtagtacctggagaaagatgcagaaatctggaggagaaattactttcaaggtggtaaaaactcaaatagatttaactactggtgggaaggagcctagggagagggagtggttcaaagtacaggtgtaaggagagatgattaaagtaccaggacccagcttgtgaggagtgaagcacagccattttccccaactgatctatcatgtatttgtcacctaaggcaaaaatgtatttcttaactgatacagctatttgtaataaggtttcatatgctgtctcctttgtgttttatatatttatttatttatttactgagacagagtctcactctgtcaccaggctggagtgcagtggcacgatctcagctcactacaacctctgcttccctggttcaagagattctcctgcctcagcttcccaagtagccgggactacaggcgcgtgccaccacgcccagctaatttttgtatttttagtagagacagggtttcaccatgttggccagggtcttgatctcttgacctcatgatccaccttcctcggccttccaaagtgctgggattacaggcgtgagccactgcacccggccttcttggtgttttatatatgataactacatatcaagcaactgttattcccaatcttgacttgaaaaagtaacaaaatgttcctaacaaagttacactgagatgcaagtacagtgttttctgacatagctcttgcaaaaaatattggcaataaatgtatttaaaaataattttaggctggaggcagtggcttaagcctataatcccagcacttggggaggccaaggcaggtggattacctgagcccaggagttcaagaccagcctgggcaacacagggagaccccatctctacaaaaaaataaaagaattagtcaggcatggtggtgtgcacctgtggtcctagctactcaggaggctgaggtgggaggatcacttgagcccaggaagtgaaggctgcagtgagctgtgatctcaccactggactccagcctgggcgacagagtcagttgctgcctcagaaattaaattaaattataaataaataaatacataataattttaatgattaagaaaatttcaggaattagtaagttcccaatattgttgtttgggcattggaagcaatgtactatgaatctttaaattttccaaatacagagtttccaaaagataaatggacatcctcactgggctctatgggtaacttccttttcatcttctcccactttgcaggctaaacaggcactctgcacttttttcctttttaaagaaattatttttatttctaattattatggctatataatagttgtatatatttatggcatacatgggatgttttgatacaagcatataatgtgtcatgatgaagttagtgtttatcatttgtgttaggaacattccaattccactctgttagttattttatttttattttattattcttacttttttgaaagaagatctcactctgtcacccaggctggagtgcagtggtgcgcaggcggttcactgcagctccgccttccgggctcaggttcctcccacctcagcctcctgagtagctgggactataggcgcgcaccaccacacctggctaatttttgtatttttagtagggatggggtttcaccatgttgcccaggctggtctcgaactcctacgctcaagggatctgcccaccttggcctcccaaagtcctgggattacaggcatgagccactgcactcgatctcctttagttatttttaaatatgcgataaattattgttaactatagtcaccctattgtgctactgaatactagatcttattcattctatctaactgtatttttgtacccattaaccactcccactttatctctccctctctgctactcttagcctctggtaaccatcattctactctctccatgagttcagttttttttttagcttccacatatgaatgcaaacatgtgatatttatctttttgactccacttcttttttcccatccaggctccatggaggggaaagagaagggaaaaggtagacaagaaagattggaaacttggtcttgaccctgctactcacgagccttaatgtgtcttcttacctcttcttttcctcacctgccaaaacctctgcagccctacttctgcatgcctccccaccttcactcttcaggaattactaggaagttctactcatactgggagtcaaatgggatatcaaggagataggtaggagaatcagcagtactaccagggatatagcactggaagataggttcttagcatctcagtgttagcccccttttattaatttctcataaaagcacattgttttattagtggtctttatctacaatagtattggaaaatttcagcaccaacataggtcaagcaatcttatgtagtccaacgtaagtacctaactaccatttatggcattttctttttttaaatggaaaactgttttgtaatgcaattttcttataaatggtagtttggggctacatttaattcatgaaagttagtaagaaagtagaagaagaataaaagtttgagttgacaaatcccatatgtgaatcctttgaaatgtttattaaactaaagcattatattgtggttagatttcaggaggtaaaaagtggtagaaattactttatttagttttttttttttctacaggaataaggtagtggaattgctctctgataccctaagtcagtcaaccagtctctcccaccccacacacatacatttagttttttctatatttctcaaatgtgaggtacctttaatttcttaaaaaatcttagtaagtgtgctgttgctgaatcaattttttttacattaagtactacagggtttcatctgtcattactttttgtgctaatcattttgtaacttttatctgaataattcaatacttgtaactaaattatgtttgaagattcttaatctatataggataaaacttgttttattacatttcatttattagtgttactcatattagtaaagtgtctactttttctctatggttgtcagaagctggagaacaccaagtaatttaagatttatttgatttgagactttaccatcgtcaggatatttaaagatatttaactagggacagtatatgtgttaaaagctgacttctactttataaaatcacgaaatattaaaatatgcagaaaagtgtaaataataaaacaatgaacacttttgcatttattgcctaactcaatacatttagaaaatcgcaatgcaattgaagccccctgtatgaacccccaatcacatcctactcctttccctctacatgttgccattatcttcaattcagtatttatcattcctctgcatgtcttttgattttcctacttatataaatatcacttgaaatatatgaaattattttgcttttttgaacattatatggtagaaatatatgcattcttctacaaacttgcttttttattgttcatcatggtatttgtaagactcattgatgaatgtaaaactcatgcatctatttataatcccgtataaaatcataattaaaagtctcactccattttttaatgtttgactgctgacagctttgaagtcttatctctccctcttctccctctgtcccacatctgggcaagataagaaagccaagatgctgcattccttaccaccagtgtaaagttcaaaccacaggtgagaatcctcattccagccccacccctaaccaccataaaaacccaagccaatcttctgtccttgctctatcaagccatttttggatgtgtctgagagccacccctgctctctgcagaaagcctcattatgtgagtaatcagcttttttatgaatattggtgtgtgtttgtttggtatcattggtgttgacatttaaaccaaattttgaactggagtccatcctgtccttgtggagtattcaaaaaattatttcagtgttcttttgttaatggatattaggttgtttccttttttttatagttgaaaacactgtttctatggatactttttattttttcttattgatttgtagaagttacatttatattctggatatggattccttgttagtgttgcaaatatctgctctcagtccgtagttagtctttttaccttaatggtttcttttgtagtacagaggtgatgaattttgatataaattttgatcaaatctaccagtctatttatgattgatctttgtatctttaagaaatatttctctgatttggagactataaaaatgctcttctaaatgttctaaaacctttaaagttgatttttcccatttaggactttgatctatttattttttgttgtataaattatttcctttcttgtaatgtctgtctggttttcgtatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttttaagctcagatattattatttacatctctaaaattttaatttgggcgtctttgttacagttttccatgcctctacttaactttgtaaatgaatagattatgtcataactttttaaatgtccttgtctggtaactctaacatctgcatcaattcttggttggtttcaatttattgatttttttttttttttattttgtaatttcaagcttctttgcattgctggtgatgtttgtttacattcaagccttgtggattttaccttgttggatgctagatatttttatataactaaaaatttcttgagctttattctggaatgtgataaaactacatggaaacagtttgatccttttatgtcttgcttttaagattgattaggtggaaccagggtggtgctcagtctacggaaaattattccttgctggctgttggtaacaggtgctgttcctgtctcagtgtaagtgatgaaaactgttctttctagtgatttcaaatggttctttcccctgccttgggtagttgcctctgtatacactaatgtgtactctgttttttttttttttgagatggagtctcgctctgtctcccaggctggagtgcagtggcacgatctcagctcactgcaacctctgcctcccgggttttacgccattctcctgcctcagcctcccgagtagctgggactacaggcatgcaccacctacgcccggctagttttttttgtatttttagtagagatgggggtttcaccatgttagccaggatggtctcgaactcctgatcttgtgatccgcccgcctcggcctcccaaagtgctgggattacaagtatgagccaccgcgcctggcaatgtatacgctgttgaatactcaatggagcctttgcagatctcaggagttctttttctgcactgtttccccattctgctaactattacctgcagattttagctgccttcttctcactggactctgagctttgtctccttacctcaggggatctgccaggttctgactcagttattacccttgcctgtggcatgatctgaaaattctctcagggaagtacgctggggcatttatagggtcaccttgtttctttaccatttctcaaggattattggccctcactacctgatatctattgttgtgagaataatttgctttttaatttttcaacaagttgggtaaatggtccctgttattccatcttgcccagaagtgcaagttcagctgagagtttaaaaagtgttaagattctcataagttttttatgtagggaatcttatcaactctaaatattaacaattccctttattcatttctaatccttactctcttctgctttctccttttccttcttcctcttacttcctcccacacctctggatagggccttcagtataatgaatgaaagggatgatagcagtgattcctgactcccattattaaagggggaacacatttctaatgtcattatttgttttttacaatgaagcctttgtgctcttctttcacatcagtttacaagtgctgtttgacaagaatttcctgtaagcccttaagttattgagtaacagtttagtgcttaagttaactgtcaaacaacatttattatatgccatctttcaaagtacttacctatattaacgcatgagaggcccaaaacaaacataagaggtaggtactgttattatccccacttcacatatgagagacggtgaggttaaatacatttcctaaggttgcacataataaatggtgaagctgagattcgagtctaagaaacctggcactagagcccaggctgcttctgcactgtatttctctgctcttaactaatatgagagtattaaatgcaattgtcagttggttcatttaaatgaccacaaagacatttctagcacttagtgttcacatttcaattatttatgccagccaagtaaccactatcaacaaaagttacaaacagtagatatttcactataggaaaagatgggagtaaaattgtagccctcttagcaggttggttttgaggaatttaacttactagattcaagttacgtgattcctgctatcccatgagttttgttggctgcaggccagggattggctgtttactactttccgctgtctcagtgctgtaataccctggcctaatggctctaattaactccatatatttgttccagaaagatgaagaggttctgtatagttaagaatcaataaaatacaaattgttgcttaggaaaccccgtgtactcttagtgtcagtaattaactttttttctggagaagtttaagaaacaggcccaagccattcaatagccatttgtgaagctgatatttaaagaaatgtagatgctgcattagaatctttaggcatctacaccaagaatgcagtgattccatcacaaaaatttcttttctttcctattggcagattataggaataaagtatttctgatttaactaactcaggtaccagggaatatttgggcaaattagtacatctcttgttttgttttttaaaattttttcataaaatccagatcctgcacaataataaatctcttaatttattagtagctgctttcttaaaaggatttatgaacataactttctgctttactaatacagagctgaagcagacttaggaccgatgagaagaatgtaaactaaaaatcatgtctttatgaaaataggaatttcttcctaagatctgggtgaggtttctcagtggcatacattgacctcagtggtcaggatacaaaactcacacagacgataaagctgacgaagtggaggaaattggcttgcaaacacttggagaaatcacttcaaagtaaaaccactttcaaattgctttttttttctgactatggaatagtgtttagcatgtttcagcaaaagtctgcacaacaatacactagatataaattttaaaagacaaatagcatcacagagcgacactcagggagagatctatttctgtagagtataagtggcttaagaacctaaatgtggatattttaaaattaaaaaaatcaaacctcttccactttggagattatttatgtgaaggtttcttatggccattcctctgccagagctctctagaagagcagagtgtttcttaattttattccagtcagattcactactattcgaacatttatcccaaatacttatactctcaatacttaaatttatctcaatctatcaagtctcactgcttctccttttctttttattctccacatatttaaagttactagtgtgtccacattagcagaattccttgtgtccaggaagatgtgtcttctgtgtactaaaaagcaatatcctcctgtcctatgtgtacagaaatggatccaggcagaaacctttgagtagtcaactgcatgagcagcttcagatccatgacaagtccttcccttcctgttccatacctgctcttttgttctaagagaaaactgttttataagaaaatatgtatgcttctgtctctattattatataaaattcagccttcctccatttctgccagaaaaaaatatgttctttaagcttgcatttttttctataatcttaataaaattttagaacttagccttaaaaattcaaggctcataattgacaaaatgagtcttcatgcctatagctgcaaagggatacatgccatcttgtattataaaaccaattccatgaatcttatttgatatagaaatcaatatgtctgcaaatatttttatctggttttcttttgctgcatggagatttgtgtgaatatacagaactgttaccaacctgtggtcttcttggttaatagaaatctgtccttcaaatttttcatgtcaacaaatggagtcctgtaagacaatggttctcaaaatgtggtccagggagccctgggtgtccatgtgaccctttcaaggccttttcaagattgaaactattttcaataacgctaatacattcgctttcaaaatttcattatcttgcagtgttacagtggattttaaaaagagactttctgttgtgagatatcataacagattgggtgaggaatcagatatgagaatttagttgtcagctattaagtcaaacattaaagagatttgcagaattgtaaatcagtgccactcttcccactatttgttttattttggaaaatacagttattcttcataagataggttatttatattaacatgtaatgagttttgttattatttaaaagtaagtgaataaatatttaaatttctaatacactaaatatggatagatagaacccacatgaaccaaggccttttggggtcctcaaaaaaattttttcggagtataaaaggctctgcaaaacaaaaagtttgagaaccgctgctcaagattccaaagacttttttttttaaattttattattattatattttaagttttagggtacatgtgcacaacgtgtagattagttacatatgtatacatgtgccatgttggtgtgctgcacccattaactcgtcatttagcattaggtatatctcctaatgctatccctccccccttcccccaccccacaacggtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttatagtcctttgagtatatacccagtaatgggatggctgggtcaaatggtatttctagttctagatccctgaggaattgccacactgacttccacaatggttgaactagtttacagtgccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtgttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtagggtgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaagttttcttctagggtttttatggttttaggtctaacatgtaagtctttaatccatcttgaattagtttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccgtgctgttttggttactgtagccttgtagtatagtttaaagtcaggtagcgtgatgcctccagctttattcttttggcttaggattgaattggcaatgcgggctcttttttggttccatatgaacttgaaagtagttttttccaattctgtgaagaaagtcaagattccaaagactttagaaactgttgccatgtcctctgagaaaagcttcagaagaaaaacctatagttctcattggttgtcttaattgatgatttgttaccctagtaataatgttgtaatgaacttacatgtattctcaaacagtgcagatacttttggtgttttcttctctacctcattcatggaggagcaaataaaaacttacaagcctgttagttttgtaatatatttgaagagcctttgtttatttagtttaacactgtactatgtgacacattaatagaagagtttccggtttgttggtgaggtagtcagtttttagtagtaggaaaagctttattttcaacattgtgatttggggactttgttgtttgaatgctttggtttgctccactttctcatgtcttttttctcaccttctacatgtagtatacttgctatagctttaagttccaattgcatatcttctttatgtaaaatgatataatcttgagtcctgctaagttaggtgggccaagggagaaaaggcaatgagcagaggccccaaaatgttaatggtgttcctatgagatgaggtcaggctatcagaagctcatacagctgtagacactttaaagacatcacttctctttattcttagtggattttatattttgagtatgatttgacgttcttttaatgtgccaacaatattagataccactttattaattaattatttataagatggggtatcactctgacacccaggctggggtgcagtggagtggtcttggctcactgcatcctccacctccgaggctcaagcgatcctcccacctcaactccctgagtagctgggaccacaggtgcgcaccaccatggctggctaattttttttttttttttatgtttggtaaaaatggggtttcaccatgttgcccaggctggtctctaactcctgagttcaagtgatccacccgcctcagcctcccagagttctgggattataggcatgtgccactacacccagctaggtgtcacattattaaacatgcttgaagtaataacttctggccttataaagagtttttataagtctccttttgagggctttattttcttggagaaggctttgttgccaatgtttgttgtcaattgaacacattaactgttgcttctcctttcttagacatgagccagggtgtgacttctcattctgcccctttccaggttcccagattgtttttgtggtaagctcaataatgtcccctaaaggtgttcacattctgaaccccagaacttgtcagtatgttaatttacatgttacaagggacttgcagatatgattaagactttgaaatgaggggattatcctggattattaggatgggcccaatgtgatacaagggtccttataagatggagacaggggaattagagttatagagtgaagatgtaagactgacaagtggtcagagaggagagaagatgctatcttgatggctttgaagatggaggaagggactgtgatcccaggaatggaaacagcctctagaaaatggaaaggaccagtaaatagcatctcacctagagcctccagaagaaacgaacctcactaacagcttaattttaaaccagggaagtaaatttttagactttttacctccagaattataagatgataaattcatattgttttagctactaagtttttggtaatttttttatattagcagtaagaaaccaacacagattttggtacctggaagtagagtgctgctgtaccaagcacctaaaaatgtggaagtggctttggaattgggtaatggttgagaatggaaaaattttgagaatacgtggaagaattttgagaatgattgaggatggagaattttgagaagtgtgatagaaaaagcctatatttctttgaattctttgaattgttagtagaaacatagatgttaaacattctaatagtgagggcccagaaggaagtgaggcacatatcagagaaaacctatattatcctaaagaaaatctgtatcagcttgttaaaaatacagacattaaaaaagcttcatgtgaaggcagatatgtagactttaaaggtattgctggtgacagcacagaaggaaataaggaacattttattgctcctctcttagatatgagccagcatgtgacttctccctctgcccctttccaggttcccaaattgtttctatggtaagttgaataatggccccctaaagatgttcacattctaatccccagaactgaagaaaagaagatccttactatatagtggcagaaagcttagctgaatgtggcttacagttttgtagtaagcagacattgtaagcaataagcttggatatttagctgagatttccaagcaaagtgttaaaagtatggctagcttcttctcgatgctcattaaaatgtgacaagaatgagagaaattgaaggaagaactgttaagcaaaaatgaactaggacttgatagtttgggaaattctcagcctatccagactgcaaatgatgttaaaatttggagattcacagtcaggaaagcttactatggagagaaagccaaagcaggcagtgtggcatcttctcttctctctgatctctgcagcatcttctcttctctctgatctcagtcacacacaaaggtgtgactggacagccttttgctactgccttggaagagggctttgtgaagagattaggcatgcatctcataaatcctctaagccaggaatagagatggaattatccaggatagatatctggaggaagtccttgtctaatggagtgaatactgagacatacacaagagacccacaaggcattttagaaggttgtagcagcagaaacactaccagcttggactgaaagggacagagagagaatggaatgaaagaaggctgttggacttctaaaattctacaggcagaagacaggctgataaaaatatttagcagtaggctgggcgtggtggcacatgcctgtaatcccagcgctttgggaggttgaggcaggaggaacacgaggtcaagagatcgagaccatcctggccaacacagtgaaaccccgtctctaccaaaaatacaaaaattagttgggcatggtggtgcgtgcctgtagtcccagctactcaggaggctgaggcaggagaatcgcttgaacgcaggagaatcgcttgaacccaggaggcggaggttgcagtgagcaaagatcacaccactgcactccagcctggcgacagagtgagactctgtctcaaaaacaagcaacaaaacaaaacaaacaaacaaaaaatttagctgtaaatacatgctaccttttatgaaaaagaatgactctgaaggtggaatgagcctgggtccagagggtagacccttgagccacagaggatatttttaggcctttagcctaatggagtatgactggttagattttaaaattgcttgggactggtagctctttttttctctttcgtttttctcccattttggatgggaatgcctgtaactatcaaactatgcctgtttcacctttgtattttgggagcagataattcgttttgcagtttaacaggtccactgatggaggtgaatttttccccaggatcctttatatctagagcctcacccatacctaaatgagatgacttacatgatgagatttgagacttttgagctgatgagacttacatgagattttggacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtttttgtcatgttgcccaggctggtcttgaattcctgagctcaagtgatccacacacctcagcctctcaaagcgctgggattacaggcatgagccaccgtgcccggcccgatgtgaatctttgggggccagagagtggactatcataggctgaataatggcctccaaagatgtccacattctaatccctgaaacttgtgaatatatgaccttacacgatgaaaagagactttgcagatatgattaagttaaggatagatattaaggtggggagattatcctgtattacccaatgtagtcgcaaagttccttataagggaggcaggagatttggagtcagaaagggaagatacaaggttggaagcagagatcagagagaagagaagatgctgcagtgcctactttgaagatggaagatggagccacgagccaaggaatgtaggtagactgtggaagctagaaactgcagggaactggattttccccaaaagcctccagaagtaatgctctgtattgacaccttaattttagcccagtgaaacagattttgcatttctgactatattagttcattctcgcactggtatagagaaatgcctgagactgggtaatttacaaagaaaagaggtttaattggctcacagttctgcaggctgtacaggaaacatagcagcttctgcttctggggaggcctcagaaaacttaacaatcatggcagaaggcatgtcttacgtggccggagcaggtggaagagagagagggggaaggtactatacacttttaaaacaaccagatcttgtgataactcattcactcattatcacaagaacagcaccaagtggatggtgctaaaccattcatgagaactccactctatgatccaaccacctcccatcaggccccacctccaacattggggattataattgaacatgagatttgggtgggaacagagatccaaaccgtatcagtgactttcacaactataagaaaatacatttgtattgttttaagcaactaagtttgtcataatttgttatagcagcaacaggatgattacaacttcttaaacaaacaaatatgtatctgtttaaaatgttgattatcaaatacatcaaacctatagaaaagaatcagaaaataacagggattcactatccagattaaaataaacattttaccacactttatttcaatgtcttgttaaaaagaaataaagtgtacaaatacaccttcagctcactctcatcccatttcccttgtttcctctgtaaaagtaaccattattctgagattggtatgtatccttttgggtcacgtttttggacatatacccctaaaatacatatagtattgttttctacgttctaaaatattgtataaatgctatcatactgtacctgttatttaactccttattcatcaacatgtttttagatttattgagttcatttttaactgctatatagtattgttgcagaattttgctccttagttcagctagaactgggttcttgtcacaagaccaggaaggattaggaacatggatacattgaagggtgaggggaatggaatttattgggtgaaaaggaaaaaaaaaaatcagcaaggggatcctgccagcagcaggctcccatctcacagattgaatgccaggccaccacacaggaaccgaagatgaagaggccaggctcctccccactgcaaagagtgaacttcccatggctccaccccattctcccagtgggcaaactagtcggagattctccgggggaccctcctcctatctctttctcctgcatttatcagtattacattttgtggtgtttatctttccattcctgatatgtcatataccaaatatggacatttacttgttgccagttttttcaatattacaatgctgaaatgagcattcttgtacaaatttcctgtgtacgtgtgcaagattttctctagaataggtatctagaagaggaattactgtatagtaagttatgtacatcttcagttagctagatgttgaaaaattgtggctgtgacactttaatttcaatttgtctccctatattttcagcactttgtattgttggacttttaaatttttgtcagtattatgggtgtgaaatggtatctaactttaatgtctcagataaactagggggatttgacatcttttcatatattgactggccattcttttttcatcttctgtgatttgccactttacatcctcttcctattgtgttgggtcttttttatatacctgcaagacttgttgttatatatttatatacaatggatatttatgttgattttacagtttataatatcttctagtctgcggcctgtcttttccatctgcttattgtgtattttaaccaagaccaccctcaggcttgatgatttgctagaaggattcacagaacttacaaaagctgttatactcatggttacaatttattaggatgtgtgacggtgcatgtgaagtgttgtcagccagggaagcatacctgaaccttggtgtcccgggcttttaaaattgggaatcagtcacataagaatgcagcacttgcatgactagccttagttactgagactacagcctcccctcacccataaagcacaaaaacaggcacttaccacaaatcacagcatttgcacaaactatctgatcataatggtactgtatggcccaaggcctcaggcatatgaaaacaacgtgaagcaaaatatgccggtggcttgagaactcatctcccaggaattgggcaagggccagccactcctggagacaggactttcctgagaatttgcagggtttgggggtttttgagttaaccctttcctgcacaggaggtatatattttaatagtcacatttatcttccttttccttcatgttgtactttttctgttttttatttcttttttttctctttttttttcttgcttccagtgggattaagatcttttctgttttttttttcatctcgtttaaggaattcttccttaccttgatgtcataaagatattctactataaattctcatgtaaaattttatagtttccttttcacaatttagctctgtggtccacttggaatttctttttgtagaaaagaaattctattagaagaatgtagggatgtaaggatcttacttaatttttttctgaatgattaatgagtggttccaggactattaattattctgttatttctgcacagatttataatgttatctcagtcgtataccaatttcctatatatatgtgtgtctgcttctaggctttctattctgttccattggttcgtttgtctatttctgtagctttataatgcatcttaatatttggtagggaaaggcctcttattcctctccctcaaaaatatgttcttttcatatgagtttaaggtcagcttactttaaatcttaaggtctgtaagaaacattgagatttgattagagctgcattttgtttatagattagagacagaactggcatctttacaaaaatgaaggtggttcatctctccctttatataggtgtttttcattattttgagaaagttttataagtttttttataagtatctaattcatagtttgctagatatatttttgtgtgcctattgctctcatgaatatttctaaattacattttgttattggttgtgccaggtgtataggaatgcttgattctggtatattgttgttaaatccatccaccttgctgacctctctctctaagtccaattatttgtttatatattttgctagggttttatataaatattatataaaacatgcttaaaagtacatgaaccataactatagagctaaatgaaatgtcacaaagtgtttttggtttatttatgtaatttgtgaataatttttttcccttttccttataccgccagaatttgatgtctttctatgtaaaataaaatagaatttcttttctgaaataatctctttttttttagacagagtcttgctctgtcgcccaggctggagtgcagtggcatgatctcggctcactgcaacctctgcctctgaggttcaagcaattcccctgcctagctgggactacaggtgcgcaacaccacgcctgtttaactttttatatttttagtagagatggggttttgccatgttggccaggctggtctcaaactcctggcctcaagtgatctgcccacctcgacctcccaaagtgctgggattacagacgtgaggcactgcgcccggcctgaaacaattttatttaagcacctgaggaggctcacgctctagtgagctgtgttggatgtgtcaatgcttttcaacttatcaaagaaaggaaattaccagtatttggaaattccaacagaacttaacaaaagggcctacagagtggtgatttcagttagttgaccacagtccaggatttggttctgagcatttgtgaaatgttgaaacaagacttggtggtaaacaaatacaaattaatttactgagactaacatagatacgggtacagagagaaaaacacacacatcatactaatgtattatttccactggtcaacacactcaggccttttatccagggcatgtcagtttcagtattgaggtacatgggaagtcaaactaagaaaacaaaatgctggctgggcgcagtggctcacacctttaataccagcactttgggaggccaaggcaggcacatcacctgaggtcaggagtttgagaccagcctggccaacatgatgaaaccctgtctctaccaaaaatacaaaaaattagccaggcatggtggcaggtgcctgtaatcccagctactcgggaggctgaggtaggagatttgcttgaacccgggaggtggaggttgcagtgagctgagatggtgccattgcactccagcctgggcgacaagagtgaaactccatctcaaaaacaaacaaacaaaaaaaagagaaagcaaaattctgtttactgtgacctagcactaaagcaaaggaaagtaaggaatcttgtaaacgtggaatcctttgtattaaggaatatattcagttactctgccttctctttatcacaccccaagcagtttgagaggcagcaagatgcagtggaaaagtactgggtttgataactgattgacagggatttgaatcctagctctttgtggatggaccttaggcaagttactgcacttaacttctcagagtttccattttctcactgttgaaatagaaatcatgacattgttaatttaaaagaaatacagcatctcaaagtaattattatagagtaaatccagcagaatcacaggcttgcatttgcttatccaggcctgtgagtaaagaagaaagtgccagtcaatgattatgcctaatttgccggaataaatcctagtaccagtctgtttccaagtacaagtagtccccgcttatcctccagggatacattccaagaccttcagtggatgcctgaaactgttgacagtactgaaccctatacatacactgtttttttcctatacataatgtacctgtaaattaggcacagttaacaacaataactaataatgaaatagaaagattataacaatagactgtaataacagttatggtaatgtggtctctttctctcttttctctcaaaatatcttattgcaccatacttaccttcttgtgatgttgagagatgataacctagccagctactagatgactcatagacagggagcatctatagcacagatacgctagacaaagggaggattcatggcccaggtggtacagccagagatttcatcatgctattcaggacagtgtgcaatttagaatatatgaattgtttatttctggaatttcccatttaatatttttggactgtagtttactgcaggtaactgaaactgcagaaagtgaaaccacagataagggggtactgctgtatagagatggcaactacaactttactaccagatgtattagtttcctattactgctgtagtaaattatgacaaacgtagtttaaaccacacacttttaatgttacaattctggaggttagtggtcctaaaatcaaggtgttggcagggctacccttcccttagggaccgctagaaaataatctgtcttcttgctttttccagtttctaaaggccacctaccttccttggctcctgctccctttctccatcttcagacataacagcaaagcattttcagctctctgactctgacctgctcccgttgccatctctcctctgactctgatcctcctgcctccttataaggatcccagtaattacactgggctcaccaagataatccaggataatctcttcatctcagaatcttaactcagtcacatctgcaaagcccatttgccatgtaaggtaacatcttcacaagggttgggatttgaacatcttgggaggaccattattctgcttaccacaccaggttaatgaattaccaagtaaaatacctaattagaattacacatctcttttgtaggttattttcactgaaacaggcattaatttctaaagttgtaggagtcataaaatggctttatttagacaatacttccaaggaaagatttgtattaacagagaatagaactagttggtaacagttacaaatattctcaaatcaccatattgcaaaggggaacaagatttacattcttgttaaagttctcaatttaatgcctttttaaattcagattatttgaaattattgtgcagcaaaatggtttccacgcctccacagcagcaggggagcgggcacagagccttcatatctttctgagtttccttttgttaattctgaagatttgcatttgtaaagctaggctctggaatttcttagctagttttaaataaaaaacatgtctgggtcctcgttatgctggcagaaatggagaaaaagctgaaaggattttattaccaatgaaattctatattttgtgccttgtaaagtagttgtgaagatttaatgtgaccacttacaagccctgactactgcttgatgaatgagagcagtttgagtctcttaccttcttttttgtactttccgcccttttgtatcttcctgctgagctcagataatttcgtcttacctgtctttaaatttaaattctctacttaatcttctaattaaagctatcccttgagtttttaattttgagtactgtattttttttctaaatgtttgattaggttcaattatggtctgccatttgttatggcttcctgttgcttggtaagatcttcaagttttttatttatctctttatgcatagtaaacatagtcgtcttatagtttgtgtttgataatcctattgtttaaagtctttttgtgaacatttctgttgtcagctgatcctgctgatttgcttctttatctaattcaaggctcaaggttcccagggcaagttatgtgatccaaatctgagctgcaaaactggcctgcttccattcaccctcccctttagggggtagccctttgaggtcccagctcattgttgggaatgtctcctcttagttttcccacttagtgtagctctgggttttaatctcttatctcttttgcctttcaaggcagccaaaatgaaagctgaaatttttggaatagacaaatgcccttaggacagaagttgcttcactgctctatttacctctaggttccccatttcccaggaatgttgccctagtgtttccatactgccattttattgtttttaagtaggtgttactacttttctttcatcaagatttttaaaatttgttttcaacctgatgattggtccaaataatgtggcaggcaatcatcagaactagaaacatttcttataactccttgctacattttctttgagattagatttaggctcagaacttcattatcttttgggttttgtttcttctgttttatagaggacacatctgatgctcagaaaagtacaaatacttgctcaaggtcacatagcaagtaagtggtaatattgggctttgaacccagctctgtccaaccctgaaacctacactgtgtcagtttttgttcctgggttctggaacttctttcttttaggaagcaggtaaatgactcgtgattttcttccttgagttttatctctcaaggtcaagaccatctatctccctgtctcttggaagcacacacagttctgtgcttttttcacaaggtccttgtcctgtttctaagacgtcctgataaataagtatccctttctaccacccaccttgtacctttcagaactgaattcagggacattcagtatccaactgtaaccataaagtttgatttccttttcaactgcagtattttcctcaaaagacctagatgaattccctgctgaatttggaaagagctaaggacaaagtgacccgggaagcaatccttttagatgaaaggaggagggagaatgatacaagtaggggttagagaacttacagtttagttgtatagtggtgggatagttgaagattttggattggtgaatgcccacaaggcaccttgtcatggtgacaaatacaggagctttggagccagacccacttcagctgaatatcagttcacctacatattaactctaaaatgttgggcaagtcagcttccctctcttgaccatcagtttcttcatccacaaacttggaataataatagcaaactttcaaggtttccgtgtgaaataccaatgatgtatttcagtgaagtgtttgtgtttggtgcatgcttactaaatggttgtggtagttattattattgttgtccccctcaaacttttcatctggtgggtgccctaagaccaggcaggagagttcatttttcatttgtgtgtatgcccagttactcctctctcctctgttgcatcatcttcttcagtctcctgaagatctcttaccgtctacgttcttcccaatccttgctttcctctcctagttctacacagtcaacacctcctttgttcagataatcttcccatttccctactcaatttaatctcttttcattgcctctgcattgtcctccagataaaccagtcatcctcatatcactttgtttcttcatgtccctctctccctgatttgggaggccaccccaaagtgagacatatcactgggtctcagcaggccttaatttctcagctgattctctgtcttattttgtcagcttcttttcattaagtaaaagttatgtttttctgtgtattattttttaagctgtttagttatggatatcttccttttttacgtattttacattataaaagtagagacatgctcattttgaagattttagagaacaacaaaactttattaggaaggaaataaaagtgacccacagttttattaactagagataaatactattcagtaattgatatatttcttttcagtatatacagttttgtatcatttgctaggactgtgtaccacagtctgggtggcttaaacaatagaaatttattttttcccaattctggaggctagacgtctgagatcaaggtgctggcagggttggtttcttctcaggcctctctccttggcatgtagatggccgtcttctccttcctgtgtcctcacatggttttccttctctgtatatctctgtctttatctcctcttctttttattttatttttgcaattctcctgcctcagtctcctgagtagctgggattgcaggtgcccaccaccatgcccggctaatttttgtgtttttagtagagacgggttttcaccatgttggccaggctggtctcaaactcctgacctcaaatgatctgcccgcctcggcctcccaaagtgctaggattacaggcatgagcccccgcaccgggcttatctcctcttcttataaggacaccaggcatgttggattagaactctaatgatgtcattttaatttaactacctaactagacactaatgatgtcatttttaatttaactacctttttaaagatcttgtctccagtgtagtcacgttctgaggtactaggggttgggacttcaccgtatgaattttgaggggacacagttcagcccataacacctgctttcttctctaaaagttatcttttaagaattcccacttgtcgataacaattctttgacaatagttctgatgactacataatatcccatcattaaaatataccacaatttacttaatcaatttcatattcttggacctttcaggtgttttcattttttcactaatataaatgcttccataagtagttttgtacatggatgtttggatatctgactatttgtttggaatagattgcttgaagagtgattattgggtcaaaaggtatgactattctctggtttttaattacatactgcaaaattgttttccagaaaattgtactaatttacattcataccaggaaggagaatagtcagttaggcattcatataagctgctggtgggaatgagaaaggaaaaataaactctcatggttgtttcactttacattaattgatgactaacaaaatggaatatttcatgtatttattaatctgtttgcatttccttttttgtgaactgttactcatgttctttgcccatttatgtatgtgagtctatcattttaggtgataagattatgatttagagtgagttctactctaaagagggaaatttcagaaaaagtgaaattccaaagaatgttatggatccagaatccaaggactattggtctgagtctcttctttggagaagacttggcatgtgatgacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagtttatactggacagaatccctatgagtgtactgactgtgggaaaggcctcaagacaaactcagactgttttttttaacatgagagaattcatagtggagaacaaccctatgctcataatgcatgtggaaaggctttcagatccagctcagactttactaaacatgagagaattcatagtggaaagtaaccttatgcaatgatgaatgtgggaaagggtatctggagataacagaccttcaaaaacattagaaaatttatagcggagatggaaagagatcctttcagtgtaatgaatatggaaatgtttttaatctagagctcaaattttatttgtcatcaaagataatcttttacaatgaatatacaaaaacctccaaacagaaatcaatccttgttcatcatctgcagattcatagtggacagacactctgtacctgtaatgaataagccttcaattagaggctaagtcttattcattatcagaggattcataaaggcatcaccttctatgtacgtaaaaaattatgggtatgctttcagcaggatatcagccttatttgatattggcaagtctatagcgagttcgcttaaatgcagtgagtgtggaaaggccttcaatctgaagtttaatcttactcagcatcagaaaatacagagtggcaggaatcttattaatgtaatgtgtgtgggaaagtctttatgagaaaatcacgtcttggtaaaaatgaaaaaaagattctttgtaaaagttaaaatagttaccacataattacacgcctgccagtgtgccaagcactacaagaactttacattgtttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcaggattcactcttcagtgagtattgggagccttcagtcagttttggaattagagactctacattgggttctatcaaatttagtaaggactataaagactttatcatatttatattatccctttgaatagggattacttccaatcttgaaagatttcattaataacaaaattctgttctcaaatgctcaccctaaccactttctgtggtgtagacaacgtggagtgggatggaaagcacaggctctgggattggccaggatagcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatccttataagagagaggcaggaggaccagacttatagagagagaatgtgaggactaaaggagaggtcagagagggaagaagatgctatgctgctggctttgaatttggagaaaggagccatgaacaaagaactgcctgggaggcagaggttgcagtgagctgagatcatgcaactgcactccaacctgggcaacagagtgagattctgtctcaaaaaagaaagaaagaaagaaagatcctgtgggtaggagtgtgatggatagccgggtgcattggctcacatctgtaatcccagcactttggaaggccgaggcgggcagatcatttgaggtcaggagttccagaccatcctggccaacactgtgaaaccctgtctctactacaaatacaaaattagccaggcatggtggtgcacatctgtagtcccagctacttgggaggctgaggcaggagaatcgcttgaacctgggagggggaggttgcagtgagctgagatcacgccactgcactccagcctgagtgacagagtgagactccgtctcaaaaagaaaagaaaaaaaggagtgtgatggatagattggaaaagagaactgggtgcagggagaccagttaggaggctatttataaagtagatactgaaatctgggttaaggcagtgggaatgaaatgagaataccatatatgcaataaatttggaacttggtcactgactagatatagggggactgacggagaagaaggaatcaaggatgatgcccagttgtctttctgccttggatggttaacaagttgcaaaaaccattcatggagaactcagaataaggagcaggtttgtggggaaagaatgacctttgcagtgtccaagaggaattattcagtaggtagtccggaattcattctgctgctgtgaagcaagtagggttacagatagaaatcagatagaaatttggtagtcatcaaatacagaagtggtggttttaattgaagtatcaatgagattgccccgggagagggtggtgtggagtgagaaaaaaaaaagacccaaggcagaatctcagaaacctaggcattttgagggaagacaaagctgagaatcagcagaagaaaggtaggagggggaccagaggagatacagcattcttgttctgccctcttgtggcaagctgagtgtgtcccagcataaatcttccctctcttgtcttcagtcttccaggtctctgactcataattccattcccaccctacctgggagaatggagctgccaggtcttctcatggtcatttctcaaatgtaaagctcctcttcgattatttctacaattcaagagcaatttggaccccacccccatgttgcaaaagaataaaaagcaaacagtggggcggggcttcagtttccacatttatatgctccaccatcttttgatctattctattggcctcattaattttagtacatctcaactctcatcatatcccttcgctccctttataattaaaagacattttattttgaatttttttattatagtaaatatactgtatattatagcaagacctatgtatggcttaaaaaagaaataacaaaaaatagcagtattagcttcactttttttcaccaccagacttgaacacttgaaggctagaatgcaaattagccaactttgaaatctacttcttttggtttttatctaaataccattatttcatgagttacctatttcagatattagctgttgacttcccattatggtagatgaagatttaattcactttttctccctcaattaccttctctattcttttagtatagctatagcatactttctggttaatgatgtttatactattgtgattgtgcaaacattgttcactaaagagacaggtagtgaattgtgtctatgtttctgttttgaacacatttgtatcatttctagagttataattcccttttatctgtgtatttttatatatttatatttgaggcagagtcttgccctgtcacccaggctatagtgcaatagtgcgatcttggctcactgcaacctctgcctcctgggttcaagcaattttcctgcctcagcctccaggcagctgggattacaggcgcccaccatatctggctaatttttttgtatttttagtagagatgggggttcaccatgttggccaggctggtttcgaactcctgacctcaagtgatctgctcgccttggcctcccaaaatatccttattttttctgttagctctatcatatgtctatttttgtgtaactgctaaaaaacgtcagagtattcagaatatttattttctagaaatcccctttgtagagccttctctcttgatccagtctgggctgttttcaatcctgaaagcttttgggatttccactttatccctaatattctaaactttcatgatgatgtgtggatatttgtatatctgttgtcctagatacctggtaggtagactctttcagtttgtatgtttttgtacttggactctggaaagttttattatttcttggatactttgtgagctccataaggacacatttttatctattttatttatttctgtttttccagtgcctaaaatagtgcctgatacatgatagacatttatttgttgaatgaattactatttacatttaaaataataaaaatgaaataatgcctccagacccaccgaccaggacaagaaatagaacattatcagtactttagtgccctatccaatcacaccttcctgtccgcctccacctagagataatactaccctgatttttgtattaacaatttctttggttttcgtatatttttatcacttgtatatatgtttttaaacaacatattgtttagttttgaaaaaatggaaaagcgaacacaaacctagttgtacgagaaaagggtactgttgcccctgttagatagtctcccaggaaaacagaggttctgcgtcaaaaactgattttagcttctctgagaactgtaaagccatttctgggataattagtgaatgaggtcatgaaatttactgttactgatgaaagtcctatctgtctaatttaatttttctattgcaggtgacattttctctcttttcagctctcagagttatagttgacaaaaattatacgtattcaaggtgtatacatattcaaagtgatattttgatataaatatacattgggaaatgatttctacagtcaagctaattaacatatccatcaactcacagttaccttttttgtgggaatacttaagatctactctcttaatgaatttcaagtatgtaatacattattactaactatattcaccatgctgtacattagatctccagaacttactcatcttacaaccacaagtttgtatcctttgaccatctctccacttcccccacacactggctgaccttgggtaaccacccatccactctctgtttctatgagttcaactttttaaagattcagcatataagtgagatgatgcagtatttgtctttccgtgtttggcttatatcacttagcatagtgtcctccaggttcatctgtgttgttgcaaatggcaggatttcctttatcaagggtgaacaatattccattgtgtgtgtgtatgtatgtgtgtgtgtgtatacacacaatttcttaatgcatctgttgcagacacttagattgttttcatattgtaactattgctaaaaatgcagcaatgaacaggggagttcagatgcttctttaagatagtgattttatctcctttggatatacacccagaagtggaattgctggatcatatgttcaattcttaattttgggggggaacctccatactgtttctgctagtgactgtaccactttatactctcaccaacaatgtataaaggttcactttttgccactttttgccaacacttgttatcatttgactttttgataataactatcataacaagtgtgagatgttatctcattgtggttttaatttgcatttccttgaagattagaaatgtttaacactttcaatatacctgttgggcatttgtatgtcttccttggaaaaaatgtctattcaggtcctttgcccatttttaaattgggttatttgtgtgtgtttttttttaactactgagttaactatgtgagttccttatatattttgtatattaaccccttatcagatatatggtttgtgtatattttctcctaatctgtgggttgccttttcattttgttgattgtttcccttgctgtgtagaaactttgtagtttgatgtagtcccacttgtttatgtttgcttttgttacctgcctttttggtgtaataacaaaaaaatcattgtcatgttcaatgtgaaggaccttttccgatgttttcttctagaagttgtatgttttaggacttgcatttaaatctctaatccaatttccaatttgagttgaggggtgtgagagagagagagagagagtgtgtgtgtgtgtgtgtgtgtgtgtaagataatgatccaatttcatttttttctgcaatggacattcagtttttccaacaccatttgttgaagaaactatcctttccacattatgtattcttgatgcctttgtcaaagattagttgactgtatatgcatggatttgtttctgggctattttatttatttgtctatgtgtctgtttttatgccagtaccatgttgttttgattactatagctttgtaacgtaatgtgaaatcaggaagtatgatgcctctgactttgttcttcttattcaagattgcttttagttattaataggggttttattgaatctgcagattgctttagttagtacggacattttgacaatattgattcttccaatccatgaacacagaatacttttcaatttatttgtgtctttttcaatttcttccattattgttttgtagttttcagtgtacagatcttttacctccttggttaaatttattcctaagtattttattggttttgatgttattataaatgggattattttcttaatttcccttttggattatttattgttagtacatagaaatattattgatttttctatgctgatagtatattatgtaacttaattcatttattagttctaatagtttgttttatggagtccttaggtttttctgtatatacgattatgtcatctgcaaacagatataatttcacttcttcctttccaatttggatgcattttatttccttttcttgactaattgctctggttagggcctccagtactatgatgaatagaaatggtgagagtgggcatccttgtcttgttcatgatcttagaggaaaagcttacaacttttcaacattgagtatgttgttagccatgggcttgtgatatacggcctttactgcctttgggtacattcctcttatacctaatttgttgagagtttttatcattgaagatttctaaattttgtttctctttctctttaagattgtaattttttttcttgtttccttgaattcaagaatttaatcagggtatcctgagtatatcttagaatgtaagctccacaaagacagggatttttgtctgttttgttcactgatatatcccaagtgcctagaataatgctggctatgtaataagtcctcattagatgagttgattaaattaatgtatgaatgcataaattgatgaatggatggatgaacaggtactcaatcttgtctggaattcaggtagccctttctttagctcagggaaattttcttctatcatttagttaaatattgcctttcttccttctatttcttttctcctttaactccccatccatctcccatattcacattttaggttcattgacactatcctctagataccttgtcttgtatctcattgtatctattgctttttgggtttttttgctcagtgccttgatataaatcttgcacttaattttctagtcaagtaattcagggctcatcattgacatcatttttcattttattgtttaattggaatttgatacagtttggatttgtgtccccacctaaatctcatgttgaattgtgatccctaatttgggagagaggcctggtgggaggtaattggatcaagagggcagatttcccccttgctgttctcatgatagtgagttctcacgagatctggttgtttaaaagtgtgtagcacctccacccttctctctcttcctcctgctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatgatttcattgatccattgtgtggagctgtgagggatcaataaataacattcatctttcctgactaggttcagaaccaattgaaattgaaagatgtaggaatccgataaatggaactcaaaacatcatctttattactgataacacttcagagaatatggctttaatgtggacttcctaatattggaccccagaattaagcagatttacctaaaccaccataagcaatggtgaaaaaccacaagactctgggccaaaagtgggccacttgatgcatgatatgttttctgtaagcatgtagatgaagggcagagagcaagagcctaagccaagctgtattagtcagggttctctagagggacagaactatatatacacataaaaataaaggggagcttattaagtattaacttacacgatcacaaggtctcacaataggctatcggcaagctgaggagcaagaagagccaatccgagtcccaaaactgaagaacttggagtctgatgttcaagggcaggaagcatccagcacgagagaaagatgtaggctgggaggctaggtcagtctctccttctcacgtttttctgcctgctttatattcgctggcagctgattagattgtgcccaccagttgaagggtatatctgccttccccagcccgctgactcaaatgttaatctcttttggcaacaccctcacagacacacccaggatcaatactttgtatccttcaattcaatcaagttgatactcagtattaaccatcacacaagcatactcagatgtttcttccaaacatactagtcacataactcattccttcttctgtggacagaaaagcaggagtgttagtctatttgaagttcttccacttagaaacatgagaagtaaagattaagtgttccctctaacatagctcagtgatgtattcagtattgccatgtgcttgaacttgtctatctcttcaggaccaaaaatatcataattttgctgtgacacgaaaggtattaggatattttaggaagactgtagtacaaatagctcaattacagaatatcatgttaatgacatatcaatagaatatttaaaactccatctaaatgctataacaaaacatgaagaaatgcttcttaaaggcagatgtaccaaaaggaatccattcaccactctctaccaatgggaacatcaaacattgtacctttagagcatggtatatttctccacttaacacctactagaactctgcagtgaggcttcaagtgagaaacttctctgttatatctgggttgatgtaagatccacatatcaggaaagtaagtgtgtgtgtgtgtttgtgtgtgtgtgtgtatgagagaataagataggagtgggggacaagaagggagaggagaggaaataaaagaaggaaaatgagatatcagggaatgagcaccacaagtgtaaaatcctaagtgatgtgggtcatgtgtttgatggagagatagggagagagtattgtgtggtagtggggtagtggaggtatgtggccaaggtatgtgtgataatggtgtcaatggggacagtgtaaggatggtatgaaatcactgtgatcatgaagacagaggcaatgtgagtgacagtaacaggaagagatcagaatgtatgtgacagttgtagttatggtcacagtgtatgtgaaagacaagaattgtgcatgtgtgtgaatatggttgtgtgagaaagtggggagggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagaccggtgtggtggcgggtacctgtggtcccagtgcctgggaggctgaggcgggagaattgcttgaacccaggaggcggagattgcagtgagccgagatcgtgccactgaactccagcctgggtgacagagtgagaccctgtctcaaaatgaaacaaaacaaaaagagacggagtcttgccctggcgcccaggctggggtgcagtggtgctatcatagctcactgcagcctaaactcctggggtcaggggatccttctgcctcagcctcctgagtagctgagactaggagggtgagccaccgtgctgggctaggatctccatttttagacactttatctcagtgtattcaaaatatggttcttggacaagtgtgggttggtgatctggtctgccatgaactgagcctaagtgtttggcaaattttactgcaattttagagtgattttatttatgttgaatcaataatttaaaaagtgaggcttgtattttgtattctataatttactgtaatatcattttttctagaaacagactcttatttcacaaaagtattggttgaaacgaattaaagtgaacaaaaaaccaactggttttgcacaagtagtttgaaatatattgctctatcttactcaaaattgatgcgtatgtgatttctttttctataatgtgaagttttttttgttgttgttctttggggatcttgtgctctactcctaaaatattaatgtcatgcaggattccagaattgttttgttttgttccagatatttgccttgcgtatataaagatgtggtcattctttgcatgctctttccccagagacacatgtaaatggagttgtaatttcctgttggtaaacagcaagtatttaaatttagaatcaggtggtaaggttgatatgtagaagggtaatacattggattgccttcaaagtgatatcttttccagttaactgttaactcactaatttactgtttttcttttctttcttatgcttcatgaatttatgtgtcatctgtacaggggccatgtgctaatctctgcacggttccaattttagtgtttgtgctgccaaagcaagcacggcttttcttaatcctatcaaatattacatggtatgttaaaacagtatagatctggcttaaggtatttcatggatgacaaatggacctcatgttatagaggaatgaaagatataaattaataaaacatgatcatgataagaataaaaccaaactaaatctcctctccagtgcttggcagcacactcccggagagggttcaggctgtatgtggccccccagcaggtgctcagagatggcttaatggcctcggtgacaacaggagcccagactgcataagactctgcctctgcagatgcagaacagtaggggcctctgatgtgcttgaacatctgttttggatctccatttctcctcaagaagagactcctttttaaaaattattttttttgaagctgcattacttactgatttccagagtcgttttacacctgcccttctcaagggaatattttgggcataatcttttttttttttttaattatactaagttatagggtacatgtgcacaacgtgcaggtttgttacttatgtatacatgtgccatgttggtgtgctgcacccattaactcgtcatttacattaggtatatctcctaatgctatccctccccccttcccccaccccacaacaggccctggtgtgtgatgttccccttcctgtgtccaagtgttctcattgttcagttcccacctatgagtgagaatatgcggtgtttggttttttgtccttgcaatagtttgctgagaatgatggtgtccagcttcatccatgtccctacaaaggacatgaactcatcattttttatggctgcatagtattccatggtgtatatgtgccacattgtcttaatccagtctatcattgatggacatttgggttggttccaagtctttgctattgtgaatagtgccacaataaacatacatgtgcatgtgtctttatagcagcatgatttatggaatcctttgagtatatacctagtaatgggatggctgggtcaaatggtatttctagttctagatccctgaggaatcgccacaccgacttctacagtggttgaactagtttccagtgccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcatttttttaatgtgttttttggctgcataaatgtcttcctttgaaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctggtggtagtttcttttgctgtgcagaagctctttagtttaattagatcccatttgtcaattttggcttttgttgccattgcttttggtgttttagacatgaagtccttgttgggcataatcttttaatctttctggaaagctaacaaaacattatctatgccaggctttccaccaggcacaccccattctttccatcacagtgctttttaaaggactttatcatttgttctctgggttcatttaactcttaacttacaccgatttagcatctttgctatatttcctttcttatttcattctttatatgttatgttacatttctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaataaaaaaataaaaagaaagagggtttaattgactcacagttctgcatggcttgggagggctcaggaaacttacaatcttggtggaaggggaagaggcacatcttgcatggcagcaggtgaaagagagtgagcaagagtagggaaaactgccttataaaaccatcagatctcatgagcactcactatcatgagaacagggtaagggaaaatgactccatgatccagtcacctcccaccgggtccctcccttgacatgtggggattatgaggattacaatttgagatgggatttgggtggggacacagagccaaaccatatcagcaggattgaaaggtaaagtgtgaatatgatagtttggagaactgggacaatatgtggagataatacttataagtcatagtcatgatcatgagtcagagagagtcatgtgaatgagatagtgtgttagactgtgtgtgtgtgtgtgtgtgtgagagagagagagagagagagagagaagttggggtaggggcatgtcatgttttaggatgggtatttggaatatcatttggatatgagtaacaaggacctaaaaatgagttgcttaaaataattaggggatatcttttccttacctgaaacaagcccaggacctccacaattttatcaatgtctcagtccccttatatatttttttgttccttggtccttggtatatagctctcatcttccaggtaccttctggttgaaggatgcctgctgcaactctggccatcatttctatgtttcaggtagaaagaatgaggaagaggagagggcaaaaataccttgtcagtggaattagtctccttatacagagctttcccaaaaatcctatccagttactgccaaatacatctcatgggaaagaactgtgacacatagccaccactatctgtagctgagagaacatggtaagaaaaaacagtttcttagtaaggaaaaggagatgttggtaggatatcaccagtagagaaggagaggttgaagatttgcgagagggagtataattaatagatgaaaatcacgatggtgctagatacagatgggatatgactggcagagtttgagatgctggaggatatcatggtaagcaaaaatagacatattgtctctgccctcatgaagctactgtcttgtgaagaagacagtaatcgcagactcaaatatttgtgaagttgtcactctggtaagtgctatggaggggaagtacatggttctgtgaataggttaaaagagggctttacctaatcagggaagtaaaagcagggaggaagtaatgatggagatgaaaccagaagacagattcagaattgattggttgaaggatctgtggatgggatggggtaaaagtgtttccagaagaggaaacagcatgaacaaagggacttatgctctgttgtcttttaaaatgtattttatttcacttagaatcttttccattatgtcttcaagttcactaatctttagtaattaatatcatctagcatttttttcttctcaaatattacagtttttatatctagatatatgacttggaccttattaaatagatctcatgtttttacttaacatgaccattctttcctctaagtttttggacacatggaaatagttataatggcttttaatgtgcttatctgctaattataacatctattaaatatttaagttctgggtaagtttggattgattgatttttctcctcaagatgggtcctatttttctgcttcttggtatgcctggtttttttttaattcgatgccaggcaatgtaaattttacctttcggtaaaattttggtgaaattttttcttttggtgctagatatttttatattcctacaaagctacctgagctttgttctgaaatgcacttctttggaaacagttagatctttttgagtcttgcttttatgatttgttaggcaggaccacagcagttttttgcataaagctaattatccctgactgatgaggcaagacccctctgagtatcccatgccaatgaattaggaagttttccactttagctggtgagaacagcatggtccccagacctgttggagcttctggcacttgttccctttaatcctttcaggtgactctttccccagcctcaggcaatttccttttatgaattcactgatcagtactctgtcaaatacttaatggcaatccttcaaagatctccagtgttctccctgtgtaactctctctttttgggtactctgctctgtgaactctagctaccttggtctttctggtctctcatctctgtcactccaattcaaggaatcccctggattctgactacattctcccttgttgctccacaaactggaacctctcaagcagtaagtgctcacttcttttttcctcatctctcagggattactcttcttcattgcctaatgttcagtgtcttcaaaaaccattatttcatattttatgtccatttttaagtgttttttgtcaggttggagggcaaaatcctgtctccagcttgcctcttaggaagttatatggtggagacctgttagataattattttcttttcttttacagttgtttgaccttctcactactgccaagtatcacaaatgagtgacagttataatttttttatcaaatgagaaaagcctgagaataagaaatgtattcaaaatcagggatttgaggaacaatttgggtcacaggggaatgtggccatatattacaaggataactcctcatgactctaaccacaaggaacttctgagcataaagacaagttagaaaaggagattaaccttctttcaaaggatagatgtttaaggcttggggtagatattcacaggattggttcccagccagggggcttccaagactatagtaagtgttagagtaattgtgctctaatctcagacatcctacgggaggatgaaaccatacataggacaaacccacacccacacccatagtgtgggtcacatgaccatagcttcagaccaatttcagagactataaatcagcacgaaaaggccatgatggtgagaaaatgtgtgaagagcattgaagagcctttggccaagcttcagatcttattaacatcaaataattcattagcagagataaactctatgaatgtagtgatcatggatggtctttctttctttttttttttttcttttcacattcagttgactttgtggatggtctttcaaccagagttcaaatgtcattcattattgttaaacacatactgaagccatagaaatgcagtcagtggaaaaaagccttcaggaacaaatcaaacctgagtaatcatgagaaatttcaacctggagagaaactgttgaatatacaaaatgtgatactccactctgttcttatcccatgcagactcccccaatctgtgtaagtgattcctttggatccctcctcacatggctttggtgagggagttgcatgcccctctccttcctcaagaaaaaggaaaacactcttccccaagccaaggactcacaacactgtaaattcttatctaattctttctagctttctgagtacatatgggctgaaaaggaatggaatgaataccagtagcatgactagtatgctctccccatgtaaggcccgtaggattgtgttcagatctcctgggatgttctttttagaatgtggaggcactgggtacctttttcttttcttttcttttcttttctttttaaaggctatatggctttaaccaaaattctgaggaaagtgtgaaagttccattcaataacctgctaaatttatattatcttttctcatttaatattacaatagaagcatgcttctgccattaaaaacatctgaatcggattttttatcactttcaatttaaagcatagtcttcaaaggtaaattactaagaaagtatagatattttttaggctctaaatatacgtttctgaattgttttctagtaaaaggaatatttgtttggcttttcaatagcaaaggacatcctcagcattttttttaatggagaaaatgatagtggaaaagaaagtcatagattgcattttttcctagatcaggaattcataaataagactaagaggcaagacaccaaccaaaaaaagcatttgcaacaagtgtgacagatacaaggttaataaccttaatgtacaaagaattctcacagcaaaatacaaatgattaagaaacgctgagagtatcttcccatcattaataataataataaatacagtttgaatcaattaaatgtcattttgtctgtcaaaatggcaaagatattttcaaagcaaatgttcagcactgttaagggtatgtgagaagtcttctgcattgctagtgttgacaaaaacctttctagaaagcaatttggtattattgaataacggccttaaaatagttcatacccgtttgaactagtaattccatttctaataatataccataaagaaataattggaggtatgcacagaggtttgttgggggaaaatcaccacaatgataatctagtgaacaaaaataaatggaaacaagatttttgttatttggtcaagtaggtaagttcatatgatgggatattacacgttatcataaagaattttgcaaagactttttaatgtcatagaaaatgttatgccaagataattgtgataaaacattatatacaaaaagaatctcagatgtagtatattaattacaactgtgcatgtatgtgtgtgatgttagacttggtatggaccattttcccaatgtttttcagatgatttttcttttataaaatgaaatcaggaaatgtcatactatgtagctgaactcatatgacttttctgagtccagctatatatctattttaattgttgttaatgttccatgattcccaaattaagtggtttatgaggtttatattgatgctgaacattgaggacacatatggcactaaatcatatcccaggtgtctgagagcattcagatatgtcttgaaattttccagtgcaaatcaaagagggactctatgtcacaagataccagaagctcacatggtaaggtcatctgatgcagtatcaaacaaatatccccaaactgtgcattgaggttctacttgcaggcttcctccccttgtctcttctgataaccttctgcttattaatggaatgtgagttgctgtggtgatgggggtgaggaattaactggaagggaattgtgcaatatgaaggaaggtgtaatctatttaagtctgtaagagattacaagtcaccaagaaagcctgcgatggtgagaaaatgtgtgaagagcattgaagagcctttagccaagcttcagatcttattaacatcaaaattcattagcagtgatgaactctatgaatgtagtaatcatggatggtcgttcaagcagagtttggatgttattcattattgttaaatacatactgaagccataggaacgcatttgatataatcctaagatgtcactttgcctgctcttatgatgcaaattggcaccagaaatccagccaactttattaaaattgtggaaatctgactggactcagatccattaatccttgaaagcaggtaatacatgtatttttgccatcattatttctccagcacttatcacaatgtgtagcactttactaggtatacttttaaaatgttttaaaattcttatacatatataaataaagaagataaaatcaagttgactcaagtctagaaaacatggatgagggatttaagaattctaaagtgtttattctgaggcaccatattgctttatgtttggaggctcagtgtatattatcaatgtagaggcttcaagagggacccattatttcatatggttattctatcctttacttaggggtgttataatctcatgctatgattttgtttttattatattttgctttaaagtactatgtctgatattaatacatcatctttttattatttgcatgtaataacttattccatccatttattttcatctttgctgtatctttatgtttaagatatttctcttgttaattgcatgtagctgcctttataatggaaagatacataaatttcctttaattacagcatcctcaaatattctgtaattggagatttgatttcctctttgaaggaaagcttcatttattccttctccagtgctctccctttctttatgtacttccaagtttctgccctatatcattttctttctgcccgaagaaaatcttctaatatttcttgcagggcaggtctgttggtgatcaattcattctgtttttgttcatctgagaatgtctttatttctcctttactttttttttcttctcctttacttttgaaagatcttttcctatatgtagaaatctagggtggtagtcatttttcttttaacactttaaatatttcactttactcttgttgcttgcatggtttctgatgaaagctgctagaattattattcttattctattataagtaagatatttggtgttctctgagcttcctggatctgtaatttggtgtctgtcattaattttggaaaattcttagccattattacttgatatttcttctgctgtattctctttctcttctccatctgatgttccagttatgcatatgtgactccagatttgcctatccatcaagattttagggtgatgatttgccctgaaatttcatttctctgacaggtccaaaaaagtgattgatttttagtttgtccaggttttttttctggttgttggtgcctccagcctcacattgattctgtggtggaagaaaagcatggggaagcaaagagtcagtagatattgtgggttccttaaaaaggaggaaccataagccccatattttagggatgggaagaaatgccaggtaggtttgcaagatccttaagcaatgtgttcttttgtctcaccttctggctaaggccagagaggacaagactacaaaatagaattgtctgcgtggtgtctataattatttggagcctcttcatgtggtttccctcagctcagggtatttacaggagtatatgtgagacaaagacagcctcacggaggttaatagacctcagcatatcataggaacagtagaatgttttccatgtatatgagtgatatatgatacccaaagagatagttggacccaaagcagctttacagtaaagaaggaagctcactcaacagctacctgcttggacagacattgatgaacaaatatgacatgtatgccagcatggatacatgatacccaacatatgttacccatcctgatgttttgacactatttaacatccctagaacttaaatacaaccccaaagcagagagtgagagggggactccatactgctggagattaagtttccaccactcagtagaatgggaacttgacatataatttatgttgagttgcagagaaaataacttacatttcctgcataccggagtttgtcagataatacccatacctgcagaataatcattaacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccttatctattccttaacctcttgtcttagtcagttcgggctgctgtaactgactaccatagactgggtggcttaaacaatagaaatatacttctcaccattctggaggctgggaagtccaagacaaaggcactggcagatctgctgtctgttgagggccctctttttcctggtttgcagatagccatcttctcgttgtgtcctcacaaggtggagagcagaccgaggaagcaagctttctcccttctcttcttataaggtcattaatctcattatgagggctctacccatatgaccttattacctcccaaagtccccatctccaatacagtcacactgaggatttaggtttcaacatctgaatttggtggggccacaaacattttgtccataccacccctctatctactcctgcctccctctcatgctcttccaccttacatcctcttctctttcctcttgctttttctttttcttttcttttctttttttttttgagatggagtttcgctctcgttgcccaggctggagtgcaatggtaagatcttggctcactgcaacctccgcctcctgggtagaagcgatattcctgcctcagcctcctgagtagctgggattacaggcacttgccaccatgaccagctaattttttgtattttcagtagagacggggtttcaccatgttggccaggctggtctcgaactcctgacctcaggtgatctacctgcctcagcctcccaaagtgctgggattacaggcatgaaccattgcacctggcctcctcttgctttttctacttcaacttagtatctgttctttctccattatcttatttttccttatcttcctaattccatttacttccagctgctattttcattcatcttttcttattcctattatattctttcttcttttcttcttccctctcttcctcctcaattcctttctttcctacttgaccttctttctcatttctcccactcttcatgctcccatctaacaagatagtggaaaagagagaaaaaggtaatagaatgcaataaaaatgtacttaaaatggtaacaggaataggtgatgggtttgactggggaataaggcagagagaggcattatgaataacccaaagtaaaatagggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaaaaaaaaaaaaaaagcttcaatgtaaatccactctttcttcacctaaagaacagacagcttagtaaggcaattattttttacttttatttttttttgagacggagtctcactcttgttgtccaggctggagtgcagtggtgcgatcttggctcactgcaacctccgcctcccgggttcaagcgattctcctgcctcagcctcctgagtagctggaattacaggcacgtgccaccacgcccggctaatttttgtatttttagtagagacgggattttgccatgttgtccaggctggtctctaactcgtgacctcaggtgatccgcctgcctcagcctcccaaagtgctgggattacaggcgtgagccactgcacctggctgacaaaattttttaaacaatgaccgctctattgtagctaaataccagagaagactatacctctacccctactagcaaaggccaactagagagacttccacccttgccagcctgtaataagacctctagttccctgatagagtggtaagatgaatggggagtgggaacattctagtcccctcagttagtagagactatgtggggagcctagatttccacccctaatgagtgataatgaggtgcctctcccctaacaaatggtgtggtatcaagaggaagcctaatgaagagtcaggtttttatcaccacccaacagtaacaatgatacctgtctatcagtggtctcaatggaggccatttggagagaagtaactgggcacccagtctctcccaagcagagtggtactggtaaaagctggaactgtcacttagcccatggtgacaggaagctcctcaaccccaggtatcagtggaatctgagtatggaacctggacttccacctacatgtggtaaaacagaagatttaaataagacccagatcttcataacataatatgcaaaaatatccaggattcaactgaaaatcacttgtcatagtgagaactgtaataatcacaacttgagtgacaaaagacggtcaacacacatcaacatcaagatggcacagttattagaatcatctgacaaagatttttaaacagccgtcctaaaaatgtttcagtgagcaattgtgaacatgcttagaacaaatgaaaaaaaggatgtcttagcaaagaaattggaaatctctaaaagaaatcagagatataaagaaaaattaataggaaattttaaaactgaaaattttaatacatggactttaaaaaacaaacctcagtagatgaactcaacagcaaaataaaaataacagaagaattaatcagggaacttgaagatagaacaatagaaattattcagtctgaatgacagagaaaaatatactgaaaaacaaaacaacaacaacaaaaaacagagccttaggcacttgttggactattacaaaagatttaaatatgtgtcattgtaatcacagaagagagagagaagaggtactgaaaaagtgttgagagatacaatggctgaaaatgtcccaaatttgggggtgggggagacaatcccacagattgagtgattcaagaagctgagcaaccccccaagaagatacggtcaaagaaaccactttcaaacttctgaaagcttaagacagaacaaaaaatcttgaaacccaccagagcaaaatgacaccttacctatagagaataccaaagcaatgacagacagaagctctctcattagataccatagaggccacaatatttttcaagtgctgcaagaaaagactcattaacctggaattaaatacccaatgaaaataaaatacccaatgaaaataaaatatcctttagtaatgaagagtaaatcaagacatttccagaagaaggaaaactaagaatttgtttctagcctacctatcctaaaataatggccaaaggaagttcttataaaagaaattaagaattctaacaattgttcaaagaaggatgaacagcatttctacacaatctcatccagaaaataagaggaaacaacttccattaattctatgaagtcagtcttaccctcatcccgaaaccaaagtacacgaaagaaacttacacattaatatgtctcacgaacatagacgcaaaagtctttaacagaatattagtaagtcaaatccagtgttgtagaaaacgttatacaccatgaccaagtggaatttattccatgtacggttcagcatccataaatccagcaatgtaatccattatatcaacaggctaaagaataaaagccattatcatattgattgacaaagaaaaagcattttagaaaatccaacagttcatttttgctaaaaactgtcagcaacccactaatagagagtaacttcctcaatttgattttttaagatatgcactaaaccttcacctggcatcagacttaatggtgagagactgaatttctccttgccatcaggaacaaggtaagtatttgcactcaccactgctatcaaaatagtattgggttgctggatcatatgacagttctgtttttagttttttgaggaacctctatactgtttctaaagtggctgtattaatttacattccaaaaaaaatgtatgagtgttcctctttctccacatccttgccaacatccattactttttgtctttttggtaatagccattattaactggagagaaattatatctctttgtggttttgatttatatttctctaatgactagtgatggtgagcattttaaaaatatattcccttggtcatttgtatgccttttgagaattatctattcaggtcatttacccatttttaaattggagtatttgcggagtgtgtatgtgtgtgtgtgtttctattgagttattggagttccttatatattctggttattaaattccttgtcagttgaatagtttgcaaatattttctcccatcctgtaggttttctcttcactttgttgattgtttcctttgctgtgcagaagctttttagcttgatgtgatcccatttgttcattttttctttgtttgaggtgcttttgaggtcttactaaaaaaatctttgcccaaaccaatcccggggcacttccctaatgttttcttccagtactttaatagttataggtcttatatttaagtctttaacccattctgacttgatttttgtatatggtgagagataggtccaaaagaaagaaaaatcaatatatcaaagagataactggattcttgtgtttattgtagcactattcacaatgccgagatagggaatcaacctaagggtccatcagtggatgaatggataaagaaaatatggtatatatgcacaatgaaatattattcagccataaaaataaggagagcctgtcatttgcagcaacatggatggaactggaggacattatattaagtgaaataagctagacacagaaagacaaatattacatattctcacttatatgcaggagctaaggaaaatttgatttcatggaagtagagagtagagtgatgattaccagaggctgagaagggtggggggtggggagcttaaagaggggttgtttaaggggtacaaaaatacagttagatagtaggaataagacttagtagtcagtagcacaatacagtgactatagttaacaatcatttattgtatgtttcaaaataactaggggagtggatttggaacgttcccaatacaaagaaatgataaatgtttgaggtgatggatatctcagttaccctgatgagatcattatacaagatcataccctgatgagatcattatacatcatatacatgtatcaaagtatcacatgtaacccatgaatatatacaacaaatatgtatccataaaaattaaaaattaaaggtaaatctaagcatgcttcttaaaaaacaaagcacaacaaaaagcaaaataataatggaaattctagccagctcagtaaagaaagaaaagcaatacagatcagaaaggaagaaataaaactcactatttccagatgtcatgatagtatatgtagaaattcccaaaatctacaaaaaaaaagaaaaaatctcctagaactaataagtgagtttagcaggtcacagggtacaaggtcaacttaccaatatcaattttatttctatatcctagcaatgagcacgtggaaattaaaaatagaatactgggctgggcacagtggctcacacttgtaatcccagcactttgggaggctgaggcgggagcaatcacttcagctcaggagttcgaaaccagcctaggcaacatagggagaccacatctctacaaaaattcaaataattaactgggcatggtgtcacgcacctgtggtcccagctacttgggaggctgaagtgggaggatcgcttgagcccaagagttgaaggctgcagtaagccatgatcgcaccattgcactccagcctcagcaacagaacaaggccctgtctcaaaacaaagaagaaaaaaaagagaatacaatgactcaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactagggcttgttgaagagttcttagaaatgaaataaaacccacaatccataaaaggaaaaaaaaaaaccaataaattgaatttcttcaaaatttcccctgcaaaagtctctgcaatctgggagaaagtatttgcaaaccatatatctgacaaaagactcatacataaaatacatgaactctcaatattcaacagtaaaagagaaaagaaagaaaacaatgcaattaagggtaatgggggctgggaaggaggtggggatggttaatgggtacaaaaaatacttagaaacaatggataagacctactacttgatagcacaatagggtgactatagttaattgtacattttaaagtaacatagtgtaattgggttgtttgtaactcaaaggataaatgcttgaggggatggattctcagtgatgtgcttattttacattgcattcctgtatcaaaacgtctcatgtaccccatgaatatatatacctactatgtacccacaaaatttttttaattaaaaaataggtaaaaggcatgaagaggcatttaatcaaagaggatatatggatggcagaaaagcacatgtaaagatgttcaacatcattagccattagggaaatgcaaattaaaaccacagtaagatattactacacacctatggccaaaatatactgacaccagcagatgctagcaaggatttggagaaactgtatccttcacacatagctggtgggaatgtcaaatggtatgatcactctaggaaagtttggtaatttcttgtaaaactaacatgcacttactatataccccaacaattgcactcttgggtacttatcccagagaattgggaacttaggttcacacagatacttgtacacaaatgtgtgtagcagcttcattcacagtagcccaaaactggaaatgacccagatgtctttcagtgggtgaatggttaaaccaactgttgtagcacctctataccatgtaatagtactcaacaataaaacaagaaactctgatacacaagacaactgggatgcatctcacaggcattatgctgagtgtgaaaaaagccaatctcaaaatgtgacatattgtatgattacattttcatgacctcttgaaatgataaaattatagagatggagaacacattagtggctgccaggggttagggatgggggcggtggaggagggttggttgtgactataatggggtagtaagagggaaatctttgtggtgatgaaatagttctgtgtcttgattgctgtggtgtttgtagagacttccacatgtgataaggtgatatagaactatatacacatattgtaccaatgtcagtgtcttggttttgattttgtactgcagttacacagatgtaaccattggggaagcagataaagggtacatagaacctcactgtactatcctcgcaattccctgtgtatctgtaattatttcaaaataaaaagtttaaaaagttttttaaaagcagaattaataaaatattacctaaaagcagtagggcatcagttatatttcaaaaatcatgtcatagggccgggcatggtggctcatgcctgtaatcctaacactttgggaggctgaggtgggtggatcacctgaggtcaggagttctacaccagcctggccaacatggtgaaaccccatctctcctgaaaatagaaaaattatccgggcgtggtggtgggtgcctgtaatcccagttactcgggaggctctagcaggagaatcacttgaacctgggaggtggaggttgtagtgagctgagatcatgccactgcactccagcctgagtgaaagagtgagactctgtctcaaaaaaaaaaaaaaaaaaaaaaaaagccatatgtattagctggttggataccattgctgccgctactgaacagtggacaccggatgttagccctgccactaatgctgcccctagaaactggattttcttgtggctgctgctcccaccaccacaactatggtggtgaattccatcactgcatatttgaatcactcctttgaaacaaagtgttaggtctaagttgtaactgcagtgaaagggttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggcccacactggatagtttgtgctaacagtgtgatttgtggtgtgagccttgggctgagagatactagtttaacctctgcatggactagagactgaataactaaggtcaaccacacaggtgctccatgcctatctgactgaaccccaaaaacaactctgggcaccaaggcttgggtgaacttccctggttgacagtatttcatacatgttttcacacatcattgttgggggaattaagcactggccatacaactccattgggagagtacaactgaaaagtcgtgcctggtctctcctgaatttttccctatgcactttttacttttgctgattttaatctgtatcctttcactgtaataaacaatagccataacactttttctgagttctccgaatccttctagcaaatcattgaatctgaggatggtcttcaggagcttgccacactggtaaatcctagatcacattctcttagctgccaagggcatgtgaagaagtgaatatctggcctttgtggcttttgcacttggaactgttaagtaagaatatatatgaccttactaaaatgttaaaaatcgaaatacatctggccccaagggttttcagtaaggatctataacgctatataaagaactcctaaaagtcagtaagacagacaacccaaatgaaaaacaggtaaaatatacaagcatattacaaaataaatctaatatgttcattaatgtataaaaatgtgttctaccacattgcttatcagaaatataaattaaaaccataaggagataccaataaatacacataagattggcaaaaaaaaaaaaaaaaaggaaaagtcttgtagagtatgtcagtcttactcctgggcttctggtgtcacggaaataaagacaaacattaattattaaagtataagaatacatgtacaagtatttttattgcaatgttgttgtattgccacgctccccacaaaaatcctgaaactaaaatggattccatccatgggggaatggttaaatacattgtggtacattcttaccatggaatattatgcagtcatttaaaagaacgaatcacaggtagactgttgtcaaataagataattcagacacataaaagttcatgtaatcttaaatttgtaaaaataaaaaacaacttttgagtatggaaggatatcaaatggtgttaaaaacaagtgtttggcaggtgaaggtagaattgaaaggaagtgggaagcagtaaggaaaagaatgcaatttaaggtctggcatatataacacatcatttatgtaacaacatatatgtgtgtaaagtatgaaaaggtagcaccaaatctaagcaattgtccaaggtgatgagatttagtgatgtttatttaatttctaaaatatttaggcagtgtttgaatgtatagtgatgagtgtgcattatttgtataatgaggaaaaataagtgaattgatcacaggaaaaattgcctctcaggtttcttgctttagcaatgggatggagagtgcgattcattcatttaacaaatatttattgaggatataaaaatgtgccaggcatggttctaggtgctggggaaacaacaatgaataaaacaaaaatctgtctccctaagaggtttacactctaaatgggggagaaaggcataactagaggagaaacactgtgttggtgggaaggaggaggcgtatgaaggaatcggtttgggacctgttaatttagagaatactgagagatatccatttggagaagtgaggtaggtagttactatggatctagaattcataggccaagtcatgaccgaagatacagatatggaaacagatagcatagaaaatggtgtttctgacctcctttcctgagtctgatcacgtctcactgcagacactttacagaggaagtgctgaggaaaaacaggcagctgacagaggaggttgctatgcaacagatgaggaaagtcatccagccaggcagaactgatgttggcccttggggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaattagatgtgctctctgcttctttttttccctatatttggggagcgagcaacatgtttatgtgggagagacaggacctcagctgtagtttgaagggtagatcagctttcagcaggtggaaatgtgggaagatctagctactggattgggatacaaaggcaggatcaatgaacacgagacccaagaactagtatagtttattcaataaatatcacttaagtgactctcatgtgatagatatgctgctaggtgtcttggagtgacattgcgagaagtcgcatagtgagagagggtattggtgctcagacagttgcacttaagaacacagaggaggtggagctccaggtgatgataaggtccagagagtaggtagttgaaggggacagaaggtgactattctggagataaggggtccatggcctgtgattctagggtgttggttatacaacccatgtggaaagtgaaagaactccaggagggcagcaggagtaggagtagagaacactatgagttagatgccagagtctcctctgtgagaaggaagatatacccctagccacattgctcataaagggatgggctcacaggcactcctccccatctctggaaatgctgcccaggatcctgtccctctaggaggccctcacaatcttcccacttgcacaggaccggggctgcctcctcgagacaggatcttatgggcagtgaaggaggcctcacaatggcctcttctctcctgcagggagaaagagaagactttgttacctcaagaacaagaattacaaagtaagacaaagctccatgcacaggctttgactgtgactgtgagcaggaacttggcttgagctgctgagttctatgctggaagcaaggctctcccactgaggacaaaattaggcctaggccatgacttccttgggtgcttggtggtatctggacatgtggacaagggcagagacgggagctcctggggcacaaaaaagagcaaaggcaatttggcctcctgggaagggtttggtagtgggtagggatggtgtccacagcttccttaggttcctgagtgatgtccacattctgaggagagagcccaggattaataggaaggagacagcagtgcagggccccaacgcctcccctgcctgttgtcctcattgccaggctcccctctttcagccaggcctggatcctgaccctcaggtaggcctggaggaaatctcagcctgaggcctttttggcagggattgcaccagccctgcatctccatgatgcctcaggtctgggctgtagttcctgcatttctgggtgctgttttttccaccttttggtgcaaaacacccaggctcggtggggttggggcagtctttctgtggagaaggtgcttccaccatgtgctgtgtccacagccagcttgggtaatggagtcccccacctacctcaggcttctcccggtgtgtgttcacggcctccacattcaggtggacggactccaccttgcagccttggaaaagaacaatccatctttccataagtccccaaggtaggcacaggtcttccatggggtatcacctccctcccatcaccacccacactcccagcttcatactgtgtacagatcatgacttgcctggggaatttagacagctgtgtgatgtgtggggaagacaccaggcctaagaggcagccaacagggcatcctgtcacctctgcccctaacagtcttagttctctgagctttagttgctcatttgtaaatggggatggagatgagagatgaactctacggctgcccacagctcttgaggtccgcaggacatcagtcgcatctgtgtaatattgatgtagctctgtggatcctccaagccgtgttaggtgctgaagaggtgcaagagtcctggggctactgccttgggtgatcagtaccaggcaaagtttatcaggaggacaatgtggttgtggcaacaccaggagtgtggaagatcacgtgggagttttagggaacctgaagaaggaagagggtgcatctttggggtttggggctgcatctttggggtttggggctgacagaggaggcctaatgcctgtggaagctctgtggactgcaccttactccaggcttcagtaggccattctgctctgtccacaccccagaataggtttgattctgtcccttccctgctcatgaaattcttgtgtaatttgcacaattggcaaaatcagaacaaagtctttagatttagattagacaacaatattatattaatgttagtggccttattttgattatattatttttttctgcaagagagtgtctttgtaatttagtctccaaatatttatggaagtgtgtgtgcgtgtgcacatacatagagagaaggagagacaaaagacagggaggataaaacaaatgtgataaaatgttaacattgaagaatctaggttaagtgtagacaggaattttttttaactagttttgcaacattttttgtaagtcttcaattatatcagaataaaaatttaaatttaaaaagtacttttatttttacaaatattcactgaaattcatctgactagcatgtactacacacacttctttttttatcaccaaatgctcacttccttttaattattattattatttttaattaatttctataggaattttttaaaattatactttaaattctagggtacatgtgcacaatgtgcaggtttcttacataggtatacatatgccatgttggtttgctgcacccatcaactcgtcatttacattaggtatttctccttatgctctcactccctcagtcccccaccccctgacaggccctggtgtgtgatgttccccgccctgtgtccatgtgttctcgttgtttaactcctacctatgagtgagaacatgcagtgtttggttttctatccgtgtgatagtttgctgagaatgatggtttccagcttcatccatgtccctgcaaaggacatgaactcatccttttttatggctgcatagtattccatggtactacacacacttcttgacattgcaccctttgggaaaaggtcactgtgcaacatgatgcagttattcttcatacaaacaaaagtgcattcactcctttccaaagcaagaaaaccaaaagtctcataagctgttgcatgcagatccaaatccagggataattgttcatcctaatttagcagggattttgaataaggacatgtgggaaaatatccaaaaaagaggtctagggaagtggtatgtggacttcttgggattgatccaaagcatgagacttagtgttaaatgtgcattctcaccaataagctcttagtaatcaggtgagcagtattacctactcattggaggtcaggaagactgttttctcagctattcctgtgcttgctcgatgggcacctatacaaagtcatatggtggcatgaacagaggctatgtatggcctcaacaaaaggcgctcacaaaggctgatatgactacccctactgctgagtgtgcaaatttccaaaactatcctgagtttctgatatgtaccaatccaaagaggaccagcccagtacctggcagtaaattaattacattgggcccattacatcatggaggggtttgttggctttatgatttgtcagcaataagtgaatattctaggtatggatttgccttccctacacacaatatttctgtcttatcaccacctgtgatcctacagaatgcctcattcactgttgtgaaatttcagcgtgggatgacaaaaaaatatgtgtatatgttagccaaatgaactgtggtgaatatttatcttgttggtatcctgattgcacccattttccttttaggataatacagtttccaattgtagtaaatgggattttaggatggccgacaagatccctaccctctggtgtacatagactttttggcagttattcagtaaaacactaatctagatgctgttgtgaaaggattttgtacatgtaattaacatccaaaatcagttgaccttaaaatcaggtgggcctgacctactcaagtaagactttagagggtactgcactcatcttgggaagagagatttgaagattgagagggatttatgcatggaaattctccattcctagatttgaagatggagatgctacatggcaaagaatatgagtggcctctatgggattaatgaggcctccagctgatagccagtaaagaaatgaggacctcagaactatagctgcaagtacaagagttctgccaataatctgaatgagactggaaggcatcagaaagaaaggcagccctgctgacaccttgatttccatcttgcttgaacagagaacctagccaaggcatgccacaccttttgtcctataataacttgcagataataaatggatgttgttttagccactcagtctgtggctgtttgctatgcattaaaagaaaaccaatatgtagtctttgtggaatgacatgtctagatgttttcctccccttattgacaaggagtaaatcagattattcctctctggttccaatattgccacgggacaggcatgcaacctattcttagtcaattacatgccctctccttggactttgaaacttaagtgattgacacaagagtgaaaaaaaaggcttatgtgatttttatccccagagcagcatccttatcagaccgttcctgtgtttcatgctcctatccagttctcaagttactttctccagtctccttccagttctgtgagcctctgacatctgtctaacaaaatccattttatttacattggcaaagaaaaattcttattgattgtgaccaatcatgtggtgaagccagtttgtaccagcttgagacagtgtattgtatgtacctcgtcccacctttgccttcagtgaaattggccatggtgggattattaactttgtgaaaaatggcagactaccaattgggaatttttaaaatcagagaactagttattaaccatttaccagcacatcattgcttgcaaacaaaatcttaagtaatggaatacgtatggattacaaaggggctggacactgagctctaggagggcaaaggcagcagggtattgtggaaagaacttggatttcaccatcagagaatcctagattctaatcccatgtttcttcagtggtgtgactttgagcaagtatcttcgcctctctgagtcttagtgtactcacctatgaaagtaggtgaggaaatacaccatttggcaaaaactgaattttcatgcactcccctacatttcccagccaactttcttgttgtgttggggtcatatgactatttctggccagtgtacagaagtgatatctgcacttctaggataagacacctaaaagcccaaatatcttcaaaataatgtgtgcccagcagagtcctggggtaggtaccctgaatgggtggttggatatcctcgcgggggcgagactggtgcagtaggatgataggggaaggactgggatggcctctgaacctggagcctggcatcaaccttccctgtctctgacagagcagtaagctgcaaaagggctcacatgtgggaggtgattttagtaagtttgatttggtgtggagaggggcaggagaatgatgcagaaagactggactagagggcccagaggggaccaaaataacaagtgtaggctgaggccagattgaagaaaggccttaaagacaagctttggcaggttacactttctcctggggcattagacacgtacataatgtcaatttttttcatcgactgattttagtatccattaattattcttcccttgtttaattattaccatgtttattgtgcaaaaataactttctatttccatgattctttctctttcagctttattgaggtacagttgacaaaaattgtgtgtgtatatatatatatatatatatatatatatatatatatatatatatatacagagtacaacatgatgttttgttttgtttttgagatagtgtttcactctgtcacccaggcaggagtacattggcgcgatcacagctcattgcagcctcaacctcccaagctcaagcgatatacctcatataaacagaattacatgatatacctcataaacagaattatacagtatttgtctttctgtaacttgtttattttacttagcataatgtcttcaaggttcattcatgttgtagcatgtggctaataaaagtccattatttttcaaatctgaataataaaacattttgtttatccattcatctgtcaatagatactttgaattctcccacctgttagctattgtgaatagtattgctatgaacatgggtgtgcaaacatgtctttgagaccccgatttcaattcttttggatatatacccagaagtggaaatactgaaacatatggtagttctattttttagtttttgaggaacagccatactattttccatagtagttgcacaattttacaatcccgccagcagtgcacaagggttccaatttctccgcatccccagtgacacttattttctctcttttgatagcagccatcctaatcggtatgaggtaatatctaattgtgtttttgatttgcatttgtctgatgatcagcaatgtttagcatctttcaatatgcttgctggccatttgcatataatctttggggaaatgtctgtcttttgtccattttacaattgggttacttgtgtttttcttttaagaaatagggtcttgctctgtcacccaggctggagtgcagtagtgcaatcgtagctcactgcagcctcaacctcctgggctccagtgatactcccacctcagcctcctgaacagtgaggactacaggtgaacgccaccatgtctggctaattgatttttttttttttttagaaacaggttctcactattttgcccaggctggtcttgaactcctcacctcaagtgatcctcccgcctctgctgagataggataacaggcatgaaccaccgtgctaagcaagttatttaattttttgttgtggagagtattttttatatattctgcttattaatcccttattaggtatatactttgcaaatatcttctcccattctgtatgttgccttttcactgtgttgactttgtcctctgatacacaaacgtatttgtttgatgtagtcccatttgtctattttttgcttttggtgtcataaccagaaattatttgccaaatccagtgtcatgaagattttctatctttacttctaggagtttttaaattttaggtcttacatttaaatctccaaactattttattaatttttatggtgtaaaaggtctattttacttttttgcagatggatgtccagttttcccagcaccatgtgttgaagattgtcatttccccattgagtaatcttggcacccttgtcaaagatcatttaactacatatatgagggttcatttcttgactcactattctatttcattggtctatatgtctatgccggtaccatatatatataataaatattataatatagaatatatatatacaatatattatatacaatatattattatatatatattatggttttcagtgtataagtctttttgctaccttggttgggtttattcctaagtattgtattctttttcattgtattgaaaatggaattgttttcttaattttctttttgaattgttcattgttactgtataaaatgcaatttatttttgtgtgttgattttagtatcctacaagtttcctagatttgtttattagagctaacagtttttgtgtgtggaatctttagagttttcagcatataagaaagatcatgtcatctgtaaacagagataattttacttcttcatttccagtatggatgctttttactttttcttttccttttcctgattgttctggataggactttaacactatgttgaatagaaatggctgcagtggtcatccttgtcttattccttaacttaaaggaaaatacttggctcattaaattagtttggaagtgttttctattcttatattatctgtatcttatattgtgtgaaatcaatactaattgtttaaatacttgattatattctcatgtgaagccacctggacctgtaggtttctttttatggagcattgaaattacaaattattttatttaatagttatatacttctttcatctcaattgaattttgttatcttgtagtatttaaggaattggttcatttcttctaagttgtagcttttataagcattaagttatttgtcatgttccctattatccttttaattcttgcagggtgtgtagtaatagtcttatttcattcttgatattggtcatttatatcttttctgtttttatttttgtcagctttactgaagtttgatcaattttattgatattttcaaagaaccagcttttgttgcattgatgttctgtataattttcttgtattcaatattattgttttctattctcgtctttattattactttccttctgcatgttttaggttcaatttactcttctttttctagttacttggaatagaaacttagatcattgattttacgtctttcttctttctaatgtaagcatgtagtactctaaatttccatttcatctttgctttatagtattccacacatattgatattttttgtttttattctcattctgttctatgtatttttaaaattttcttagaaacttctttgattcatggattatgtagaaatatgttgcttaattcacaagcatctgtagattttctgttgtttttctgttattgattactattttcatttctttatggatagagaacatactccgtatgatgtcaattgttttaatgttgttgaagttttccccatagtgtatcctattgaatgttccactggtgcttgaaaaaatgtgttttctgctgttgttagttggagtgctctttctatatatatgtgtcaattatatcatattggttgattgcattgctcatttcttttatgtccttccagatatactgtttagtagctttatcaattgctgggagtgcactgttgaagtcccctagtataaatttaaatgtgtctatttcttctttctgctctatcagcttttccttcatatattttgaggctcttttgtttgatgcatacacatttaggattgtagtttcctgtaaatcgttgtaaatctcggtgattgaccttttatcattacgcagtgtctctctgtctccagtaatttcctttgctctcaattctactttatttgatattaatatcaatactcctgctttcatttttgttttgagacggagtcttattctgtcgtccatgctggagtgcagtggctcactgcaacctccacctcccaggttcaagcgattctccggcctcagcctcccaagtagctgggattaccacgatgcccggctagtttttttttttttaatagaaaaggggtttctccatgttggccaggctgctcttgagatcctgatctcaagtgatccattcgccttggcctcccaaagtgctgggattacaggcgtgagccattgcgcccggcccctgctttcattcgttaatgtttgcattatacatcactttccatccttcactttcatcctactatgtctttgtatttttatttctttttaaattgatacataatagttgtacatattttgggggtacatgtgatattttgatacctgtatacaatgtgtaataattaaatcagggtaattgggatatctgtcaccaaacattatgttgtctttatgttgggagcattgtgattcttctagctattttgaaatatacaataaattattgttaactacagcttctctactgtactattgaatactataacttattccttctatctaactgtatttttgtacccctaaaacaatttcgcttcattgcccccttaccttttctggcctctggtaattacggttctactctctgcttccatgagattcactttttaagctcccattaaatgggcatgggaacatgcagtattcactcttaaatgaatgagaacatgcagcatttgtctttctgtgcccggcttatttcacttgaggtaatgacctccagttccatctatgttgctgcaaatgataagatttaatacttttttatgggtgaataatatttcattgtatacatgtaccacattttctttatccatttatctgttgatggacactgaagttgattccatgtcttggttattgtgaattgtaccatgataaacctgggagtgcagatatctcttaagtatacttatttcctttctcttggatatataccctgcagtggaatttctgagtcatatggaagttctgtttttagttttctgaggaacttttctatagtggctgtacaaatttaccttctcagcaacactgtaccagttttccccttactctgcattcttaccagcatttgttattcttgtcttttttataatagccattttaactggagtgagatgatatctcattgtgattttgatttgcattttcctagtgattgggtattttctctatatccattggtcatttgtttgtcttcttttgagaaatgtctattcagatcttttacccattttaaaattggattatttgttttttttttgctatgagttgtttgagttacccattgtattagttcgttttcatgctactgataaagacataaccaaaactgggaacaaaaagaggattaattggatttacagttccacatggctggggaagcctcagaatcatggtgggaggtgaaaggcacttcttatatgttggcagcaagagaaaatgaggaagaaacaacctttgataaacccatcagatctcgtgagacttattcactatcacgagaatagcactggagagaccagctcccatgattcaatcacctctccttgggtccctcccataacacatgggcattctgggagatgcaattcaagttgagatttggtggcgggacacagccaaaccatatcacctatatattctggttattaatcccttgtcagatgaatagtttccaaatattttttccattattcaggttgtatcttcactttgttgatggtttcctctgttgtgcaaaaggtgtttatcttgatgtaatcttatttgtctatttttacttttgctgcctatgcttttgaggtcttaaaaaaatctttgactagaccaacagtctaaaatgttcccccaatgttttcttttagtagttttatagttttaggtcttagatttaagtatttaatccattttgagttggtttgtgtatatggtgagagataggggtctagttttgttcttatacataaacacatcaagttttcccagcatcaattattgaagtgcctgtcctttctgtaatgtgtattttggttcctttgtcatttaggtctttttatccattttgagttgagttttgtgtatggtgtaagataacagtccaagttcatttttttcctcgtggaaacccagttttcccagcaccatttgttgaagagactatcttttcccccattgtgttctcttggtgcccttatctacaattagttgaccgtatatgtgtggatttattttgggactctctattttgttccactgttttgtatgtgtttgtttatgacactaccatactgttttgattactgtagctttgtaatataattttaaataaggaagtgtgatccctccaactttatttttcttcctcagaattcctttggctattcagtgtctttgtgattccacacaaattttaggattatttttcctattgctgggaggaatgccatggcaattttgatagagagtgtattgaatttgtatattgttttaggtagcatgggcattttaacaatattatcaggttagtgcaaaactatttgtggtttttactgtaaccaaaagaaatggcaaaacccacaattacttttgcagcaacctaatagttcttccatttcatgagaatggactatcattccatttatttgtatcttcttcaattactctcctcaatgttttatagttttccatgtgcaggtctttcatctccttggttaaatttactcttaaatgttttttaatgctaccataaatgggattgttttgtatcctgcaattttcctgaattgatttattagttctaacagtttttttgtgtggaatctttgaggttttctatatataggattatgtcatctgcaaatggagataattttacttttcttctttccaacttggataccttgtatttcttttttagcagaagtaagtaataatgatcagaacagaagtaaatcaaatagagaatagaaaaacaataagaaaaaatcaataaaactgagtgatttttttcaaaaaaagctagactaagaagaaaaggcagaagagtcaaatcaataaaatcagaaatgaaaggggtcataaggggctattatgaacaatacacctgcagactggataatttagataaaatggacaaattcctgaaaaaatacaacctaccaaggttgaatcaggaagaaatagaaagtctgaacagaacaataacaaatagattgaagtggtataataacttaaaagctcccagcaaaaaaaagcccaggaacagataactttatcgttgaattctgcaaaacattcaaagaagaattaatacaaatacttcttcaactcttccaaaaactagagctagagggactatttccaaacatattttatgaggccagcatcaccatgatacctaagccagacaaagacaccataaaaaaagaaaacttcaggccaatatctctgataaacattgatacaaaaattttctataaaatattagcaaacccaagttcaacaacacatcaaaaagattatacatcatgactgttatgatttgaatgtcttctccaaaactcatgttgaaactcaatccccagtgtgacaatattgagaagtagagcctttaagaggtgaataggtaatgagatctctgccttcatgaatggattaatccatttatagattaatggattaatgagttaatggactaatgggttatcatgggaatggaactggtggctttataagaagagaaagagactcaagcatgctctgccacctcaccatgtaatgccctgagccgcctcgggactctgcagtgtccccagcagcaagagggttcttaccatttgtagtcccttgaccttggacttctcagcatccataaatataagaataaattcctttttaaaataaagtaccctcttttggatattctgttataagcaacagaaaagactaagataatggccaaatggaatttatccttggcatgcaagcctgttttaaagtatgcatatgaatcaatgtgatacattaacagaatgaaagataaaaagcacacaaaaatcatctcaatttacacagaaaaagcatttgacaaagttcaacatccttccttgataaaaatgctgaacagtttaagtataaaaggaaagtttctcagcaaaataaaggtcatttatgaaaaacccacaattaatatcataatcaatggggaaaaatgaaaaacttttcctgtaagatccagtgcaaggtaaagattcccactctctccacttctattcaatatagtacaggaagtactatgatgtaaatttcttgtagatagtatacattggattttttgaaaattcatactgccaatctgtttttttgccaagtatttaaaaaaatttttttataattaacacataataattatacatgtttatggggtacactgtgatgtttcaatacatgtatacattgtataatggtaacatatattgaaacatgtatacattgggtatacatgtatacatgtttgggtaattcacagatccatcaccttaaacatctatcatttcttggtgatctaatctctttttaattggtatatttaaaccatttttatttacaataactgtccctattttaaggcttaagtatgccattttgttttctgtgcatccctctgttttttgtttctctctgtctctgtctctctctctctctgctccctataggttatatgaacatttgttaggattccacttagagtgaagtgtagaaacattacttttgatgtgtttttgatcctgtgttaacactgcttaattcttggtgtttcaatttggtataatatattgcttttgcctttatattttcgtatagtgcttgatttttataaagcaatgaatatataataaatttgtgaagtcactatccttctattatatttgtaaatgtagctatatattgtcaaggaaaaaatgtggctgatttacactgttattaaaacttgaaaatcctcagtatttatagtttttagacttgacacacttgagatttgagcagcaaaatccttttttacacatgacctaattttttctatgatcatatcagtttctacccaagcattagtgatttaggtcactcggatgggggcaggtttctcttacaactcatctccagctcaagaaaagcctctttctctcaagcttcttcctcactactcccttagaggaaggaagaccaatgtgataggtcaaattctggagcactgtaaggagtaccactgtgcattgctaagtgacacccatacatgtaagacacatctaagctcttctctttcttatgatactgaagtgatgagataagctggtgctgactgtgaaagctgggcattgacacactggcctctctttcttctcactggagattttgggctctgtcattcctgcctactaggggtcagctgatgataagatttctgtagaataaaagaggcaaagataccctgcttcattcttgtgcctaaacctgtgcttcaattcaagttgacctgagggctctgcactgaggggtcatgggaactggcccagtgaatgatatttcaggtccttgtgtgcatgtctttttcaaggaaagccctaagagggggcaataaagcagtgtaacataggagtagggtgttcttgtatcctctgaacaaatgctaacctcacactgtcagattcttaccagtaatgccacataattggataactctcgttctactgcaggtggtgcagatggcgacccaaatgtcataatccacattgaaatgtcacacatacccactcaaatagacatgccctcaggtgttgccatgcccccatccagatgtcagcactaggtatttgcagatatgattggtggacttcatgtatgaaaagacaagggtaactttctgtagttattagtagtttcaatcatttgcagagtcattattccctccctgttctcctttttgtttcttccccatttattctttagggtgttctatgatacttagccttattggcacctgctttcatttcctgaattcgtatcaggatgtcacccgtaccctgccttcttagaattcatggtgatgcaatacaggcaacttaaataaaaagactgatgggaggcctcttgaactctgttagtttccctactctttacttttctttttatgtttcatgcaccatgctcaggtgctgtgaaaccagttcctggtttttaatctagtctcacagtaagcaggttgtcctcatttagctaccattttacttctcaataatttaactttgacattaaattgtccaaactgacaaacacatcccaggtgaacttgctgtttttttgccacttctcagttgtcttaattacagttagaattggacaattaagttcatctttagtaactgcacacacatatttaactaattgttgtctttccttgcacataatgctattctatgtacctcatattatttgatttctttgaaagagagagcacatatcgctcttgtgtttttaagaagtaactttcagctctcagtaagttatgtatttgaaattttgtcctgcagcattgctaccactttccaatatacattttctcttgtacacaaacctcacacaggctcatgtcaaatatttatataagcatagtcaaaacagggtgaataaatttctctttggtggtcagtttccaattacaccttcacatgacaggtagagcctgctttagagtctctataatcaatcctcaactgtctgttacacaacagtttctccaccattggaaaatcaattctctgttcccataggctttggtagagttacattcctctgccatctcgaaacaaatccatttgtgagatcatactcatatcacatggtaccatcacacaagttgagccccagcggaatggtaataaagtaagtattcctaatacatgctcatgaaaggggactggaatcaccctatgacaaagttaagattggtgcagtaaagtggtctcaggatgggaggcacttttccatttcagtttctctgaatactgaaagtcttgacaaaaagactttatcagcttgtattaacaataccagctcatgaggaattaaaaaatttaataccaggccaggcgcagtggctcatgtctgtaatcccagcactttgggaggctgaggagggatggctcacctgaggtcaagagttcgagaccagcctggccaacatggtgaaacccagtctctactaaaaatacaaaaaattagctgagcatgatggcaggtgcctgtaatcccagctacttgggaagctaaggcaggaggatcgcttgaacccaggaggcggaggttgcagtgaaccaaggtcacaccactgcacttcagcctgggcaacaagagcgaaactttgtctcaaaaaaaaaaaaaaaaattaacgtgagaaacctgtaacaccatcctgcagctttgcaccaagattaccttgtttaatggtcatagttggtaatatttatttgtgtcaggggaataacattttcatggctcctgaatttaagtttcctatttagtaggtttatttttatctaatgaatttaaaataccagcatgagtattttgctaagagagaggattagataacaccctagtgtcccagaaaagggtatggatacttcaccacaaaatattcaaaatattcccaagagaaactttttagtttatgctattcactatgtgaaagaagaggcatccaccactcttgttcattccctaaagtgctggtagtatttgctttgtaacaacatacccctgttaaaattcttttgactatcacctataggataaacatagaactctgtgtcatgtgcctttaagattttctatgttttgactaaacttccttagcaggcccatttttctccctcttctcccgagagtcaccacccactcttacccagcaccttcattagcatagagctctctgtccttttttcttttttcttttttcatactttgcatgggaataactaaaacctttattagatatgattttccattaacaataatgtgaaaattacaattatgaattcaaaaggcagtgaagtctgaacatttaaaaagaagactaggtgttagggaacaaaaggtaaaggaaggtgagaatgtttcttttatactattcattatctcccctctgtacacagtgttgcatatatacaaccacttcatttttactgactttatataatagtgaaatccccttaagcaacctagggtatacagttggggtccaactttcagggggttgggggtggggagtagaaacacacttgattaacagttttcacccacacattttagacaatttttttctttttttgccaagattttagtagtaagttcacaaatataggaaatactttcacttcttcagtgttaaaatggaaaaccaaacagtgctgacagtagtggcttaattattggtatacaagaaaaacacaacaccaatgggttttcttaattatgcattttaaatatcagtatgtgcatttgtttttacagttataaattttctcatctgttttagacaacagcttgtaatagttttgaatccattaagatgttgctttcaatttgaaatattttgtgtatacacgtatataaaaaataacccaaagtatgactcatctgacagatgtttaagatcaataaaggcttatttttcaacatgcagttaggaagagagggaagcaagccaacctctctacactgtctttttgctggcttgtttttgcagtggtatcaatagtggtttttgaagggagccgtgtgccgtcagcctatctagttaagattagataccacaatcaacaagaggagtagaagagatggggaagggggagtaggtaagtgttagatatcaattttttttaagtgtgcattttgtactcttctaggtatgggattaaaagcaggccagtgaggaaaaaaatgttttaattaggaaaaaactgcaatcaatcaaatcaagacataatagccgaactaagttcttttaatagactgcatatatagatgtttagccatactcttagatgaactttttaagagtagaactttatatccaatttacatgctctagataccacctttcttattttttatagtaaggtctggtattaaaatacccacttgtacactgacagctttaagaaaaacaggacacagagtgagtcgtcatttttagcagcaatgaaataccactaacccatttttacataccaaattcaagtcactatcagaggtgagtgtcacacagtcaccaggtataaaattgctagttcatttttaaattaataacttgaaattacccatgcctccccaccccattacatctttttataaacagaaaacattttgctattttatacataggctagcagccttgttttaatatgaaagtgctaattcatttacagatttgtataatcagttatgtagtgctacagtaagtgtccaataatctacataggaacaacgatgaatgaaaatgatgaagattgaataaggctatcagattaccttattttatgtacatataaagaatagacacccaatggcgaggaagagatagaaattggacaaatacccacgggtgtaaacattacatctacttttgagctttatactgtaaatgaaacattttaaatagtcctgtagcccatgcctattttttcctcagaaaaagaaaagctgccttcatgacatcccctcttgtttcagatttccacagtgtcactttaaagcttcagagtcaggatcttactttcttcaaaaaataaagaaaatatgccccctaaggtacctaaggtaagatctccccaccccccaaatcccgctggtttcttttccagtgccaggttgcatgatcaggtcccatctcctggggttgttggtgtttgtttgtttgtttgtttgttttttccatctattgatcattagtttagaatagataacatgaaccagttctggagccactactaggaggaacgcaagctcttcactgcaatcacacagcaggaaagaaagagataactcaattcttccgtggtgctgggcctccaaaattcaaagaacttggcacaactgaagcactaaatttgtatcctccatgcttctcaatcattttggacttatgggctgctcttctttgattggccagagttgctatgtcttgtaactgttttctttgttcttcattaagactgtgtgagtcagagcctgataccacacaggattacgattttgaatagtttgaaagatagctttaaatatctgatactcatcaacagggttatcttcatcatcaatgattgtggaatagctttccagagcagtctcttcagcatcaccttcttcccaatcttcatcacctccatcttcacctgcctgcttagccagaatctccaaatattcttgctcatcttcatcaatataatcttcatcactccccagttcctcggtttcatcatcatcttcagcttcatcatcatcatcactgtcattcccgtgttctgcatggcaggcatatgctcttttaaatccgttaaatctactgaacaagagcatagaagatcttgaatatttgtttctgattgaggacagactgatcagactggtcagaaagaagctggataaaatgatcctttagaactggcagaaaatgttgcattgcctcctagtctggtctgtctgttctaaggtgaatttaccttggtcctgcagtgttgacaccgtgtttccaatcttttgtatttccttagggctcctcaaccctctgtgaaaggtgtggaggtacaaagaaatgttaagtcaagtcgccaggcaggtgatatcagttccctgcagaacaatgtgtgtaatagctgatgggtgagtccccttccccatccctttccctctctgcatctgcctcctggataatctaagctactttcttatctcctaattggatgacaacaggggggccagggttgcctcagggataatagaggcccttggttttggtggcctattgttgtgcatctggaaagcactaatgcttaggtttttagtcctagtaccaagtcagaaaaacatgaaagaggaggaaggaggatttagatttagcaatcaagagctagaatagaatttttacattactcccaaaacaatactgctgccttacttttcttcaatatatgtaaagtgcaaaacgaaaaagttaattgttacaccaacattttatatcatatatatattatatatgtacttgaaaaatcaatgtgaaatacaaatcttttgcgagaagtgaagactaagagaggttgttaccagcagaatagtactacaaataatgctaaatgaagttctttaggttgaaggaaaatgagattcaatggaaatttttatctacaatgaggaataaagagcagcagaaatgttaaatatgtaggtaagcataaaatattaccttttattttctcttaattataaaaaggaaaactaaagcaaaaaaattctattgtggagtctataatgaatgtagaaataaaatatatgttcacaactacacaattgagagacgtgaatgaatttttactattgtaaatgtattatgttttatgtgaagttgtaaatattaacgttaataggctgtgataagttaaagatgcatatggtaacccttgagcaacccctaaaattaataccaaaatttattattaaaaagataatagaggaagaaacatggcgatgccgacgttgactgcgaaactgtactccctgctgttccgcaggacttccaccttcgccctcaccatcgctgtgggcgtcctgttcttcgagcgagtcttccatcagggcgcggacgagatctaccagcacatcagcgaggggaagctatggaaacacatcaagcaaaagtatgagaaaaagtagttccttggaggcccccatccaggccagaaggaccaggtccactcgccagctgtttgcccagagttggggcctcagcttgaagacgatgctcaagttacttttcatgtaccactgttcactgttggcaagaaacagctttacctacagaacagactctttaccttctgccgtgtttgaagtatgtttagtcagcatcatcaagaaataaatgtgaattgcccttgaaaaaaaaagacaatagaggtattgaaataaaatactaaaaatgtttgattatccccaaataagtgaggaatgtgagacagaggaataataaacaaatgagacaaaaagaaaacaaatagcaaatgacagactgaatcgcatctataattacattaaatagaaagagactaaacactccaatagaaaggcagagattattagataggataagaaagcaaggcccaactatttgctaacaaaaagagatgcatttacatataaaaacttaaatagattgaaaataaaatgaagaaaaagcaaaatacaaacctaagaatactgttttggctatataaatatcagacaaactagaccaagaaaaagaatatcacatgagataggggtataaagatagtacattaataaatagtaatgctaaatatatatgtgtctaaaaacagagcctcaaaatttatgagacaaatgcagacagatctgaagggagaaagagacatatctaaaatcataattgatgatttttatcactcctttctcggtaattaatggaagaactaaaaaaaatcagtaaagatttaaaatatttctataatactgtcatccaaattaatgtaattgacattttataggacactactcctaattgctgaagaattcctattatttccaagggcacatggaatgctcatcaaagtaaattatattctgtaccataaaatatgtatccataaatatcaaaagtttgaaatcttacagagtatgttctctgaccacaacaaaatttaattagaaataaacatgaagtatctagaaatatctgtaaatgcctccaaatatttataaatgaaataacatatttgtaaataagatgttaatcacccagcactttgggaggccaaggcaggtgatggtcaggaattcgagatcagcctggccaaggtggcaaaacccctctctactaaaaatacaaaaattagccaggcatggtggtgtacacctgtaatcccagctactagggaggctgagagaggagaatcgcttgaacccggtaggaggaggttgcagtgagccgagatcgtgcaattgcactccagcctgggtgacagagcaagactccatatccaaaaaatatatatgtattttatcagagatgaatataaagtatatattttatcagagataatttgaaaagattaataaaaattataaattcctagagagaatgtccaaggaacaaagaaagagaaaactctggtaacaggaataaaagagtgtacatcactacagatttgatggatattagaagattgataacagtatattctctgaccacaacaaaattaaattagaaatgaatattactataaaaataaagatttcctctgagaatggcagacatattttttcctcagttatatgtctgattagcctatgtacttattgatttgatcccatattagttgagtagcacaaaagagaatggggaaagatgacattgtgggaattgcctggtaaagaggatttataggactgtcatagcattgataactgagagaagatgcgattgagggccatagtctttctagtactgccacagtatgtgggtggatagctaaaaggcacacacaatagagcgatgctatatgaaagccaccagttggaggacagtggggagtggtgaccaaatcttgcaaggtattcaatgtttagggaagttacattgaggtgagcccctcatcaataaggcattagtataattacaacccattctcgttaagcctcaaatgtggtctaaggaagaagttacatcaataagagagtgggactggaaaattcatccagttgagtaaagagttgcgtgtccctttttttgtctttccatatcccacaacaccacagaggggaaagtaagtgtctagaagggaggacaacaaagggagggaatgtacagtccttgacgtcttcatctcctttacgcgttatgatcttgaagtcacagcctgatctagcatgacctgaggtaggcaaggagatctgagatttacatcaagttcaaaaatcaaattgtaaaataaatgtgactgacttacatggcacatatatttactatatttataagtaaataattatatgagatcattctaataatatcaccaccaactaataggatgtggccaacccacgcaagtgtaaagggcatgttttcaactttcttagatggagaacagtcaatggaaaaaataacatcatgttttatgtttgcactctaatgagttgagaatccttaatatattcacttacagttgaagtttgactttatctcaactattatttctctttgcatccctgtccttttgcttgctcttcagcttgcccatttctcttttctctgtatttagtccttcatctcctcttctcaatctttattatccttcataatctctcctcttcctgcatctttccacccctcctacacttaaaattttattacatcctcctgtcattcctcttactcctctcttctgcctgatttctactacttctctgcatgtattggacctctacttagagttaatcatataatttatcgaccaagtggtgtcacttttgaaagtaaatgaaggtgctatttgtaattttgctaaggcaacaggtacaaaccagtactgtcctaggaaaactgggatatatggtcacgctagctgtagtaaagccccaatttagggtccagatgggtagggaaggtcattatgagaaaatgatattaagtcaatttctgtaggatgtgtaagagccagatgaagagtggggagaagcatattactggcaaaacaaatgagagtacagaggcgctgaggtgagaatgaaggaagttcaaagtagctggagaatggaaaaagatgggaaaagtggcataggctgaggctgccgatgtggataataatgaggagccagatcaggacaggaattgaaaaatggacatccagaattcctgtacatgggggaagggaacttagatgaggctttctggttgaaacgagggcaatagattatttgtcaacaaagttgcatttttataacaagcataggaattctatatagaattgcatgttacaggtcaataaaaatatcactgttttaaaaagatatttatattatcaaattgcatgacctaaggaagcaagaattcttattgaagaatgttattaatagttgaaatgaagtgatggtgaggaatggagatgaagaaaacagaagggagagaaggttaaagccctgccaaagccattgcttggccagggttaggagttgacttttattctaattgcaatgggaaggcaataggagatataagcagggaaatgacatgattcgatttacattttttaaaattttactttaatttctgggataactgtgcagaaggtgcaggtttgttacataggtatactcatgccatggtggtttgcagcacccatcaacctgtcatctaggttttagccccgcatgcatcacgtatttgtcctaatgctctctctctctttgcccccaccctccaacaggctccagtgtgtgatgttcccctccctgtgtccatgtgttctcattgttcatctgtcatttatgagtgtgaacatatggtgttggttttctgttcctgggatagtttactgagaatgatggtttccatcttcatccatgtccctgcaaaagacattaactcattctttttgatggctgcatagtattccatggtgtatatgtgccacattttctttatccagtctatcagtgatgggcatttgggttggttccaagtctttgctattgtaaatagtgctacaataaacatatgtgtgcatgtgtcattacagtagaatgatttataatcttttgggtatatacccagtaatgagattgctgagtcaaatagtatttccggttctagatccttgaggaatcgccacactgtctttcacagtggttgaactaatttacactcccaccaacagtgtaaaagtgtttctatttctccacatcctctccagcatctgttttttcctgactttttaatgatcgccattctgacttgtgtgacaaggtacctcactgtggttttgatttccatttctctaatgaccagtgatgatgagcttttttaaaatatgtttgttggccgcattaatgtcttcttttgaaaagtatctgttcatatccttacgtttgtttttttcttgtaaatttgtttaacttccttatagattctggatattagacctttgtcagatggatagattgcaaaaattttctcccattctgtaggttgcctgttcactttgatgatagtttcttttgctgtgcagagctctttagtttaattagataccatttgtcaattttggcttttgttgccattgcttttggtgttttagtcatgaagtctttgcccatgcctatgtcctgaatggtgttgcctaagttttcttctagggtttttatggttttaggtctaacatgtaagtctttaatccatcttgaattaatttttgtataaggtgtaaggaagggatccagtttcagttttctgcatatggctagccagttttcccagcactatttattaaacagggaatcctttccccattgcttgtttttgtcaggtttgttgaagatcagatggttgtagatgtgtggtgttatttctgaggcctctgttctgttccattggtctatatctctgttttggtaccagtactatgctgttttagttacggtagacttgtagtatagtttgaagtcaggtagcatgatgcctccagctttgttctttttgcttaggattgacttggcaatgcaggctcttttttggttccatatgaaatttaaagtagttttttctagttctgtgaagaaagtaaatggtagcttgatgagaatagcattgagtatacaaattactttgggcagtatggccattttcatgatatcgattcttcctatccatgagcatggaatgtttttccatttgtttgtgtcttctcttatttccttgagcagtggtttgtagttctccctgaagagttcctccacgtcccttgtaagttgtattcctaggtattttattctgtttgtagcaattgtgaatgggagtttgctcatgatttggctctctgcttgtctattattggtgtataggaattcttgcaatttttgcacattgattttatatcctgagactttgctgaagttgcttatcagcttaaggaatttttgggctaacacgatggggttttctaaatatacaatcatgtcatctgcaaatgaagacaatttgacttcctctcttcctatttgaataccctttatttctttctcttgccttattgccctggccagaacttccaatactatgttgaataggagtgatgagagagggcatccttgtcttgtgccagttgtcaaagcgtgccagcttttgcccattcagtataatattggctgtgggtttgtcataaatagctcttattattttgagatatgttctatcaatacctagtttattgagagtttttagcatgaaggggtgttgaattttattgaaggtcttttttgtctctattgagataatcatgtggtttttgtcattggttctgtttatgtgatagattacgtttattaatttgtgtgtgttgaatcagccttgcatcccagggatgaagccgacttgatcgtggtggataagctttttgatgtgctgctggattcagcttgccagtattttattgaggattttcacatcgaggttcatcagggatattggcctgaaattttctttttttgttgtgtctctgccaggttttggtatcaggatgatgctgtcctcataaaatgagtttaggaggagtccctctttttctattgtttgcaatagtttcagaaggaatggtaccagctcctctttgtacctctggtagaattcgtctgtgaatctgcctcgtcctgggctttttcttggttggtaggctattaattgctgccttaatttcagaacttgttattggtctattcagggattcgacttcttcctggtttagtcttgggagggtgtatgtgtccaggaatttatccatttcttctagattttctagtttatttgcatagaggtgtttgtagtactctctgatggtagtttgtatttctgtgggatcagtggtgatatcctctttatcatttttattgtgtctatttgattcttctctcttttcctctttattagtctggctagcagtctattttgttaatcttttccaaaaaacagctcctggatttattgattttttttgagggtttttcgtatctctgtaacaagatagttatttcttgtcttctgctagcttttgtatttgtttgctcttgcttctctagttcttttaattgtgatgttagggtgtcaattttaggtctttcctgctttctcttgtgggcatttagtgctataaatttccctcttaacactgttttagctgtgtcccagagattctggtacattgtctctttgttctcattggtttcaaagaacttatttatttctgccttagtttcgttatttacccagtagtcatttgggagcaggttgttcagtttccatgtagttgtgcagttttgattgagtttcttaatcccgatttctaatttgattgcactgtggtctgagagactgtttgttttgatttccattcttttgcatttgctgaggagtgttttaattccaattatgtggtcgattttaaaacaaatgctatgtagtgctgagaagaatgtatattctgttgatttggggtggagagttctgtagatatctattaggtctgcttggtccagagctgaatttaagtcctgaatatccttgttaattttctgtctcgttgatctgtctaatattggcagtggggtgttaaagtctcccactattattgcgtgggagtctaggtctctttgtaggtctctaagaacttgttttatgaatctgggtgctcctgtattgggtgcatatatatttaggatagttagctcttcttgttgcatggatccgtttaccattatgtaatgcccttctttgtcttttttgatctttgttgatttaaagtctgttttatcagagactaggattgcaactcttattttttttgccttccatttgctttgtaaatatgatttacactttaaagcaattgctgtaggtactctgtggagaactgattgtagaaggggaaatatttgaagtagggaggtcacttaagagactcttatgccagtggcctcaactaggatgatatagagataagttgatatatatttgaggtagaatattaaggattttgtggtatttttaatatgggataagagatcaggtaaagtaagcagtgatggaagactcataaatttctggtttgggaatctgaatgtatgtcggtggtattcactgagttgaaaaagtcaagtgaaggaatacataatgtttgtgagaaggatacattataagatatcaatatgagacatgttaattttgaatgtactgagagatttccaattatagaatggagataggcagttgcattatgggtctaaaaatcataggccaagttagtagaggagatacagatttgggagcaggaaacataaaatggtgttttaaacctcctttcctgaacctgtttacatttcactgtagagacattacagaggaagtgctgaggaaaagcatgcacctgaaagggaggttgctatgcaacagatgaggaaagtcattcagccaggcagaattgaagttggcctttgggaacaaaatgctgccgtccttcctagcattagttgcctttcatatgaaggcttctggcatgagttgatgccagaacaaatgtgaactgcacaaagatctgtcttgaattttggaaaagtatcagtttaatttgagtcagctcacatctgtatttaattttctgcctttttgagtttctccagttatcctggaagcatagcagcatgtgcgtccttgggtaggacccaattactgtgcattccactttgcacattgagaaaccaagctcagagaattgagtggcctgagcgggctcacacatcttgagacagacaggctgggcactccatccctggaattctgatgcccagcgcaggttctctccataagaccacagctgccccaggccccagctctgaaaggaaccagggcttgccatggctcagacacataggtctgattgtcctggctcttccagtgggcaccaggaaggcctcagggacattgtgattgtgtccctgataaggaagaggcctgaggttctgagtacagagtggataccaaggagcaattctcatgcctggatggacccacacagggcagggggagggtgggggcctctgcttgtgtcctcctgaatgcagagcatgagcttggacctcctagaacacaaacgttgcttatttggagcaaatgttggggtggaggaggtctgtcattcaaatgggaagggtgcctcggtccccaggccagcatgagcagaatgtgaactttggagttaggacgacccaggctcaaacttctttttgtaatttcaacttttattttcgatttaggaggtaaatgtgcaagtttgttacatgggtatattgcgtgatgctgaggtttggggtatgaatgatcccatcactcaggtaatgagcatagtacccaataggtaattttttagcccttgccccacttaatttatccattctctagtagtccacagtgtgtatttttaccatctttatctccatgtgtactcaatgcttagctcccacttatacgtgagaacatgaggtatttggttttctgttcctgcattaattcacttaggataatggcctccagttgcatccatgttcctgaaaaggacatgatttcattatgctttttgtggctctgtagtattctatggtgtatatgtaccacattttctttttttttattattattatactttaagctttagggtacctgtgcattatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaatttccacctatgagtgagaatatgctgtgtttggttttttgttcttgtgatagtttactgagaatgatgatttccaatttcatccatgtccctacaaaggacatgaactcatcattttttatggctgcatagtattccatggtgtatatgtgccgcattttcttaatccagtctatcattgttggacatttgggttggttccaagtctttgctatcatgaatagtgccgcaataaacatacgtgtgcatgtgtctgtatagcagcatgatttatagtcctttgggtatatacccagtaatgggatggctgggtcaaatggtattttcagctctagatccctgaggaatcaccacactgacttccacaatggttgaactagtttccagtcccaccaacagtgtaaaagtgttcctgtttctccacatcctctccagcacctgttgtttcctgactttttcatgattgccattctaactggtgtgagatggtatctcattgtgcttttgatttgcatttctctgatggccagtgatggtgagcattttttcatgtgttttttggctgcataaatgtcttcttttgagaagtgtctgttcatgtccttcgcccactttttgatggggttgtttgtttttttcctgtaaatttgtttgagttcattgtagattctggatattagccctttgtcagatgagtaggttgcaaaattttctcccattttgtaggttgcctgttcactctgatggtagtttcttttgctgtgcagaagctctttagtttaattagatctcatttgtcaatttgggcttttgttgccattgcttttggtgttttagacatgaagtccttgcttgtgcctatgtcctgaatggtaatgcctaggttttcttctagggtttttatggttttaggtctaacgtttaagtctttaatccatcttgaattaatttttgtataagatgtaaggaagggatccagtttcagctttctacatatggctagccagttttcccagcaccatttattaaatagggaatcctttccccattgcttgtttttctcaggtttgtcaaagatcagatacttgtagatacatggcgttctttctgagggctctgttctgttccattgatctatatctctgttttggtacacattttctttatctattacactactgatgggcacctgggttggttccatgtctttgctgttgtaaatagcatggtaatgaacttatgaatgcatgtttcttttaggtataataatctattttcttttggatatatatctagtaatgggattgctgggtcaaattgtagctctgttttaagttctttgagaaatgtccagctctgttttaagtcctttgagaaatatctagactactttccacagtggctagactaatttacattcccaccaatagcatataagcattcctttttctctgcagccttgccagcatctgttgtttttttaactttttaataacagccattctgagtggtgttaaatggtatctcattatgattttgatttgcatttctctaatgatagtgatgttgagcattttttcgtatgttctttggccacttgtatgtcttcttttgagaagtgtcagccaggtgtggtgacacatgcctgtaatcccagcactttgggaggctgaggagggcagattgcttgagtccagcagttcaaggctagcctaggcaacatggtgaaaccctgtctctacaaaaaacaaaaaagttagccgggtgtggtgatgcacacctgtagttccagctgctcaggaggctgaagtgggaggatcacttgagcctaggagattgaggctgcactgagccataattttgctactgcactccttcctgggtgacagagtgagaccctgtctcaaataaacaacaacaacaacaacaaaacacacacacacaaaaacagagaaatgttcatgtcctttgcccatcttaaattttttttgcttgttgaattatttaagttccttgtagattctggatattagacatttgttgaatgcatagtttgagaatactttcacctattctgtaggctgtttactccgttgataatttcttttgctgtgcagaagctctttagtttaattaggtcctacttgtcaatttttggttttgttgcaatttctattgaggacttttagccaataattctttcccaagatcaacgtccagaatggtgtttttaaggttttcttctaggattcttatcgtttaaggtattgtatttaaatctttaatccatcttgagctgatttttgtatatggtgtaaggaacggggtccagtttcaatcttctgcttatggctagccagttatcccaacaccatttattgaatagagagttctttcctccttgcttatttttgtcaactttgttgaagatcagatggctgtgggtgtgaagcttcatttctgggttctttattctcttccattggtttatgtttccgtttttgtaccagtaccatactgctttggttactgtagccttatagcatggtttgaagttggggaatgtgctgcccaggaccaaattttaaattttgtttactagctctgtggctttgtctagttcatgcaatatgtatgtctatgcctcagcttcttgtctgtaaaatgaagatgctgacatccacttcccagagctgctatgagaggaagacaagccccataacagatcctgctgtgatatccaagtctgccttgcccttctgtccttccccagcacacacaaaataagttcattgctgggcctacacaacaggcagggaagatacaggcaattcatgagtgaggtgctcatgtggaggcactcggcccccatttatgcgtcttctctcagtccttgcttttcctcagccctagagctgaggagtttttcaagaggtatttgatgtagcacttgtttcagttagaggccctcataaagatctcttttagagaagcagctgatatcttctactggccaccttgtggaaagtcctgtggttcacagtatttcatgttgttgacactcagcaaagatactgcctaaggaggctgatccatggcaattggactcacagaagtaattatagaacagaagccaatttattaacataaactcattttgactgcctggtgctcactcttgtgcaccttctctcccaataaaggaaaacagtcacaggtaacttgagggaggggaattgatggtcatgtcagtggctggaattcttgagttaaaattttccattcacagaagcttttacatggaatgtctggttacaaattttggtggtctgcagacaagttagtttgtctatgttccaagtttgaagcatgaagaaacagaaaaaccaaatagaccaataataagtaaagacattggatcaataagaaagcctcccaacaacaaaaggccagggaccaaatagcttcatttttgaattctaccaaactttaaaagaaaaactaatatcaatttatctcaaaatatttccaaaaattgaagatgagggaattctccctaactcatcctataagcctagcattaccctgggcccatacaaaaatcaaaatcagacaaggcccccccccaccccaaaaaatgaaattacagtacaatatttctgatgagtactgatgcaaaaatcctccacaaaatattagcacactgaatccaacagcatatcaaacaggttattcactatgagcaagctaaatttattctagggatgcaataatggttcaacatgcacgtatctataaatgtgacaaatgtgacacataacattaacaaatgaaggatgaaaagcatatgattatctcaatagatgtggaaaactcatttgacaaagttcagcatctcttcacgataaaaaacctctcaacaaattaggcataaaaagaacattcctcaaaaaaatgaaggccatatatgacaaacccaccactaacattatacttaatggagaaaaatagaaagtctttcctttaagatctggaacaagacaagaatgcccatgtacaccacttttgttcaacatagtattggaaatcctagctagagcaattaggcaagaaaaagaaataaagagcatttatattggaaaaaaataagtcaaattgtccttgttttcagatgacataatcttatacttagaaaaacttaacaaccccaccaaaaaaacttgaaactgataaatgaattcagtaaagaggcaggatacaaaatcaggactcacaaatcagtagcatttatatataccaacagcaaacaatctgaaaaaaggaatcaagacatcaattccatttacaatagctataaaaatggaatacttaagaattaattaaacaaagaagtcaaagatctctgcaatgaaaactataaaacaccgatgaaggatattgaagaggacacaaaaaacggaaatatatcccatgtacatggattggaagaattaatattgttaaaatgtccatactacccaaagcaatctacagattcaatgcaatccctatcaaaataccaatgtcatccttcacagaaacagaaaaagtaattctaaaatgtatatggaaccaaaaaagaccttgaatagccacagtgattctgagcaaaatgaacaaagctggagacatcacattatctgacttcaaaatatactccacaggtataactaaaacagcacggtactggcataaaaacagccacatagaccaatgtatcagaatagaaaacccagaagtaaatctatacatttacagctaactcatttttgacaaagacatcaagaacaaagacgtaaatatcaaacctgaaactatgaaacttctagaaaaaacacattggggaaatgcttcaggacattggtcttggtaaaacttttgtgtaggacctcaaaagcacaggcagctaaagcaaaaatagacaaatcgaattatgtcaagctaaaaccttctgaacagcgaaagacacaacagattgaagaggcaacctacagaatgggagaaaatgtttgcaaactattcatgtgacaagggattattaaccagaatatataagaaactcaaagaactcaacagtgaaaaaaacaaataatctgatcttaaaataggcaaatgatctgaatagacatttctcaaaagaagacattcaatggcaaacagatatattaaaagtactcaacattgctaatcatcagggaaatgaaaatcaaaaccatgaggcataatctcatcccagttaatactgctattaccaaaaagacaaaaagtaacagatgctggcgagactgtagagaaagggaaactcctgtatattgttagtgcaaatgtaaattagtacaggcattttggaaaacagtatgtaggtttctaaaaaatctaaaaataggaataccatatgatccagcaatcccactgctggacatatatccaaacaaagagaaatcatatcagcatgcccatgtttactgcagcactatttgcagtagccgagatataaaatccatctaaatccccatcaatagatgaatggataaagaaaatgtggtgtatttatacacaattgaataatattcagccatcaaaagaatgaaatcctgtcatttgaagcaacatagatgaacctggagggcactgtgcaacagatgaatggagaaacaaatgtggtatatccatacaatggaatattactcgaccataaacaggaacaaagtacgattgagtcttgaacaatggtcgggggtggggctagctgtgcccatcctccacacagttgaaaactcacgtctaactttagactcccccaaaacttaactgctaatagcctactgttgactggaagacttactggtaacataaacagttgattaaaacctattttctgttatatatattatatactctattcttacagtaaaataagatagagaaaagaaaatgtaattaagaaaatcataagaaagagaaaatatacttactatattttaccacaataaaaaataaacttaaaaaatattttagtgggcctgtcagcagccaggtcatcctctcacagctagactgcctcagacaaaagtactacacatattttttgctgcttagatgtccccttcatagattccatacagcccacctccctccttcctacacagtcctttctttattttttagtgtaattattaagttttaattgagatatttatataactttttactttacagatcatttactctctttccaggcatcaaagaatcatttataaaaatttattttataccaactcacaaagaaaacctcaaaaaattcccaaaagtagaaagtataaaacaaccttctctgtgaccacaatgccaaaagcaatctagagcaatgctgtttaaaagaactttgtgtaatgatggaaatagtccatatctgcagtgtccaatatggtgatcactagccacatgagactagtgggcacttgaaatgtggctactttattggagggactgatttttaacttttagttaattgtgattaatctgaatgtaactagccacatgtggccagtggcaaccatattggacagggcaaatctaggaaattagaacaaaagttaaacagaaaccatacttttaagttaaaaagcacttgtacccacaaataaaactgtgcatacacatatacatgcacactctcacacatgcacttcaaagtaactattgaattaaagagaagagcaaatccacagggcacttagaaaatgaaaacattgcatatatcaaagcaaacaggatgcatataaaactacatattcatagtattaaatattttcttccttattaaagaaaaagaagcaaaacaagtgaactagacactacaatccagacatcaaagataagcacagaaaccttttaatgaaaatcagaaaactagaaattatcataaatccaggagctgatcatttggaaaaaaaaaaatggattttttttttttttgtaaatcacatgaagaaaaaactgaaattaaaataagaaattataataggatgtacacttttatataaatatacaatgtgatataaaactattctaataaatttaaaatcttgatactaatcaaattagaatcaaatcagaatattagcaaaaactacttgagaaataaaaagaaataaaaaatttttgaaattctaatttttattttagatacgggggtacatgtgatttgttatatgggaatattgcatgatgctgaggtttggagtattgatcctgtcacccaggtagtgaacatagtgtcaaataggtaggtttttaacctacccttcttctctccatcctctagtattccacagtgactattgttcctatatttatgtccatatatattcaatgattatcttccacttctaagtgagaatatacagtatttggttttccattcttgcattaatttgctcaggattatggcctgtagctccatcgatgttgctgcaaaggacatgattttatttctatttatggccgtgtagtgttccatggtatatatgtaccacattttctttatccagtctaccattgatgagcacctaggttgattccatatctttgctattgtgaatagagtggtgatgaacatatgaatgggtgcttctttttgatataataatttattttcacctcgcagagatacaacaaaaaaaagagaaaacttcaggccaatatccctgatgaacatcgatgcaaaaatcgtcaacaaaatactggcaaactgaaatgagcagcacatcaaaaagcttatttaccacgatcaagtaggctttatccccaggatgcaagtctggttcaacatatgcaaatcaaaaaatgtgattcatcccataagcaaaactgaagacaaaaaccacacgattatctcaatagatgcagaaaaggcctttgataaaactcaacatccctttatgttaaaaactttcaataaactaggtattgaagtaacatacctcaaaataataagagccatctatgacaaacccacagccaatatcgtaatgaatgggcaaaagctggaagcatttcccttgaaaactggcacaagacaaagttgccctctctcatcactcttattcaacatagtattggaagttttggtcagggcaatcaggcaaaagaaagaaacaaagggtattcaaatgggaagagaggaagtcaaactatctttgtttgcagatgacatgatcctatatctagaaaaccccatcgtctcagcccaaaagcttcctaagctgataagcaacttcagtaaagtctcaggatacaaaaccaatgtgcaaaaattgctagcattcctatacacaaacaacagggaagctgagggccaaattatgattgaactcccattcacaattgccaaaaaaagaacaaaatacctaggaatacagctaacaaggtaagtgaaggacctcttcaaggagaactacaaaccatggctcaaagaatcagagatgacacaaacaaatggaaaatcattccgtgctcatggatagaaagagtcaatattgtgaaaatggcgatactgcccaaagcaatttatacattcaatgctatgcccattacactaccattgacgttcttcacagaattagaaaaaactattttaaaattcaaatggaaccaaaaaagagcccaaatagccaaggcaattcctaagcaaaaagaacaaagctggaggcatcgtgctatttgacttcaaactatactacagggtgacaataagcaaaccagcatggtactgctacaaaagtagactaatggaatacaatagtaaactcagaaattagaccacacatctacagccaactgatctttgacaaacctgttgaaaacaagcaatggggaaatgattccctatttaataaatggtgctgggagaactggctagccttatgcagaaaattaaaactggaccccttccttacaccatatacacaaatcaactcaaaatggatccaagacttaaatgtaaaactcaaaactgtaaaaaccctagaagaaaacctaggcagtaccattcaggacataggcatgtgcaaacatttcatgatgaacatgccaaaagcaattgcaacaaaatcaacaactgacaaatgggatgtaattaaactaaagagcttctgcacagcaaaagaaattatcaacagagtaaacagacaacttacggaatgggagaacatttttgcaaactatgcatctgacaaaggtctaatatccagtatctataaggaacttaaacaaatttaaaataaaaaacaaacaacctcattaaaaagtgaaaaaaagacatgaacagacacttctcaaaagaagacatacatacatacatgcagccaacaaacgtatgaaaaaaatcttcactgttcattagagaaatgcaaatcaaaaccacaatgagataccatttcatgccagtcagaatggctcttattaaaaagtccaaaaacaacagatgctagtgaggttgcagataaaaaggaatgcttttatgctgttgttgggagtgtaaattagttcaacaattgtggaagacagtgtggtgatttctcagagatgtagaggcagaaataccacttgacccagcaatctcattattaggtatatacctaataattaccatatatatatatatttctattataaagatatatgcacgtgtatgttcattgcagcactattcacaaatgcccatcaatgatagactggataaagaaaatgtcgtatatacaccatggaatactatgcagccataaaaagaagtgagacaatgtcctttgcaaggacatggatggagctggacgccactgtctttagcaaactaatgcaggaacagaaaaccaaataccaaaaaccgtgttctcacttataagtggaagctaaatgatgagaacacatggacacatgggggaggaaataacacattggggtctttggagggtcggggatgggaggagggagaggatcaggaagaatagctaatggatgctgggcttaacacctaggtgataggttggtctgtgcagtaaacaaccatggcacacatttacctacgtaacaaacctgcacatcctttacatgtaaccctgaacttaaaataaaagttggaaatcaaaaaaaataattatctattttcttttgggtatgtgataggattgctggttcgaatggtaactctgttttaagttctttgggaaatgaccagactgctttccatggtggctgggccaatttacattcccaccaacagtgtataaatattcccttttctctgcagccttgccagcatctgttatattttgacttttaaataatagccattctgactggtgaaagatggtgtctcattttggttttaatttgcgtttctctgatgattagtgatgctgaccatttttttgcgtgtttattagctgcttgtatgtcttattttgaaaagcgactgttcacataatttgcctatttttaatggggtttgtttttttgctccatgcagttttttctcatacaaaacacagtgtcattatattaggtattaatatcaatatagctttacctcctccacatgagaatctggccactggtgggaggagtgtcctcaggcttcccacatctacaaatgctctctaggattaatcttaaagataattttattccttaaattgtggtttttcctcaccctttcctaatgccatgaaaatattactcaaaaagatgtgttttttttttgtaagagcagaaaagtatgctaactgtggatttacattctttgtaatataataaaataattccatattgttggacattcaggtattttccaatttttacaattgcatatgaagcatgaatatttttacttttaaatattaaagtaaatctctgattgtttctttgcagttaattcctaaaactggaatcattgatatgtgaccatatgaacatttctaaagctttcatcaatacatttctctccggaatagctgtaccaattcataatgctacagctatgtgtgaatgccagttctactgcattatcatcaacactggccactattctctaaatatttgccgacctcatattgtttttattttgagacagagtctcactctgttgcccaggctggagtgcagtggtgcgatcttggctcactgcaacctctgcctcctgggtttaagcaattctcgtgcctcagattcccaagtagctgggattacagatgtgcaccaccatgcctggctaatttttttgtattcttagtagagacaggatttcaccatgttggccaggcagttctcaaacttctgacctcaagtgatccacctgccttggcctcccaaagtgctgggattacagacgtgagccatcacagctggccgccaacctcgtatttgaaaaataagtgatttaatattgttttatttaaaaatatatttactgccttttaattatagaaaccatttatatttatctaggaaactggaaaatacataagagaatgaagaacaaaataaagtctataatcttacactaatataactactgttatcattttaaatattttgtttacatttagttgtttattcaattatcattgactccttctttctcttcacattcaatatccaaccaatctttcaggaaaatattttggttttatcttcaaaatatatttaaaatttggcaacttattaccagttctatagttatcactctggttccaaccaccatcattgctcatgtggaccattacaatagtattttcactggtgatatggtttggttctgtgtccctacccaaatctcgtcttgaatggtaatcccctcctgttgagggagggacctggtgggaggtgattggaccatgggggtggtttcctccatgctgttctagtgatattgagtgagttgtcacgagatctaatggtttaaaagtgtttggcagttccccccttgctctctctctctcctgcagccatgtgaagaaggtccttgcttcgctttcaccttccactatgattgtaagtttcttgaggcctccccagccatgcagaactgtgagtcaattaaaccttttttcttcataaattacccagtcttaggtagttctttatagcagtgtgaaaatggactaatacaactggtctccttactttgaccctgtctcaggcagtctcctctccacacagcatctggaggtatcctgtgacatcttatgtcacttctctgctcaaaatctttccatatttcttatcaaactcagaggaaaattaaagttgttacagtggtttataaagtctaactggattcatttatcacctctatgatctaattgcctcaccgtctcatccactccactgtagccatattggcttccttccagatccttaaatataccaggcttgctctcccactttaggtatttttctcagctgttttcattgacagaaatactcttccataatacagctgcatgactaattccccccattagctcaagtgagcaccccaagaatattctgatcccctttgttatgctctatttttctcttctacacaactcttattttgtaatgcactatatggttatttacagaatatttcttccactagaaaataagattcaaaagggaagaaatatttgggtgttttgtcttatgtttctgaagaacattaaacaaggacctgacacatagaaggcacttagtaaatattttccatggtctacagtgaccataaagtcataacaaaccaattgcttatgagagatacaactgttcctgctaataatacaattcctttgttttgatggcaaataacatccttaataacagtgatttgcttatcagtaaaacatggatatttgtaccaatctaacttacaggtttgtcataagaactaaaatagataacatatttaaagaacttactgctttgcacatagtatacactcaataaatgttagctacactattttatagtgcttatgagtgctttgctcaggagttagtcctgggtttatcatctctttcttccactactggttacatggtattggtcaatttacttaataatgtatatacaaggggatattattcagccctagaaaaaaagaaaatcctgccctctgtgacaatatggttgaacctggtagacattatgctaagtgaattaagctagacacagaaagaaaattactgcgtaatcttatttacatgtggaatcttaaaaagttgaattcatagaagcagagagtagaatggtagttacaggaggaggggaagaatgggagatggtggtcaaagggtacaaagtttcaatggtgcagaatgaataatttctagcgatctaatgtacagcatggggacagtagttaatacctatgtggatatttaaaatttgctaaaaggttagatcttgagtattcttaccataaaaatgtaactatgtgaagagatagatatgttaattagcttgactgtaataatcagtttactgtttatttatatcaaaacatcacactgtacatattaaacacacaaaattttaagttaaaaacataaatgttatatgtttttaccacaatacaaaaaaaaaccaaagaaaaaaacaggcaattttttgtgtgcgaaatccagagaagggacagagttaatgagttttcctgtagttctagaaattattgaaaaatggagaagatacaaatcaagattatctaaatgtccaaagttcaaacatgtggggtacatatgataattaaatacattcacataatttgtaaaggtcaagtcattgtaattgggatatccatcaccttaaatatttgtctttatgctggaaagatttgatatatgcatataatctaaaagattcaaaagcagaatcttgaagagatatttgcacactcattttcatagcaattctattcacaatacctaatgagattggaagtattcttctagctgttttggaatatacagtagattgtacagacagttaccctactgatctatcaaacactaggtcttatttcttctatcaaactgtatatttgtaccctttaatcaacctctcttcatccacctctcccccatatgctccctggctctggccatcaccagtatacactctatcttcttatgttttcctctttaaattggctgctagaaacttagggtcatatttgcggttcacctaatggtgttccttctgtgttttaacttcttaatattgattttatttttttctacccatttcccttttgtcttaattattttcaaatgttaattacatgttgtgtgaatcatatgcattctcaaagcaaattttaaaataattacaaaagtattaaagtgcatataattacatatgcacttacatataatcaaataaatattatttaagccaaaacaatgagatatttttcagctaccaaattgtcgatagttaaaaattattcagtgctataatgaatacagcgtatgacactattatatgtttttagtgaaaggaatttagcaatatgtgttaaatgtggccaaatatgcaaaaagttcaatgttgcattattgaaataaaataaaaggcaataaagaaattgttaggcaacatatgacgattcttaccctctagtattgggcaatcagtcattaaatggtgtttacaaagaaatttgaattgtaaagggagaagccctgattatataatgtgtagcaaataaatatttaggattcggccaggcgcggtggctcacgcctgtaatcccagcactttgggaggccaaggctggtggatcacaaggtcaggagatcgagaccatcctgactaacacggtgaaaccccgtctctactaaaaaaatacaaaaaaaaaaaaaaattagccgggcgtggtggcgggcgaggcaggagaatggcgtgaacccgggaggcggagtttgcagtgagccgagatcgcgccactgcactacagcctgggtgacagagcaagactctgtctcaaaaaaaaaaaaaaaaaaaaaaagaaagaaagaaatatttaggattctgctatagtttggatgtttgtcccctcaaacctcatgttgaaatttgatctccagcattgaaggtggtgctaatgagaggtgtttgggtcactggggcaggtccctcacgaatggttcggtgctgtcctcactgtaataggtgatttctcactctgatagcttccaagagagctggttgttaaaaagggcctggtacctccctctcctttcttgctttctctcttgccatgggatctctgcacacgtcagcttcgctaaccttctgccatgaatgaaagcagtctgaggccctcaccagaagcagatgctggtgtcacgctacttgtgcagcctgcagaaccataagccaaataaacctctcttctttataaattaatagcctcagatattccttttgtagcaacactaaatggactaaagtagattcaatactggataatatattatcttgcgtgcaaaatttttttcttaaatgttgagaagactatccaaaaggtattgaaatggttatctatgagtggctggattctttatgctttccctgtattcccaagtgtttatatatgaaacaaatttcctttacagtctaaggcaaaaataatttactgaatatatgtataagacaaaactccttagaggctttgtaaactctcatgcttgtgaacaggatcaagagagcagtaggccgtctccacagagacaatgatgtaaagttgctggagaacagagacagtagaattactccatgtgtatttcacacaaatcttctctgcaaaactcaaatgtcttttatcttttaaatggtagaacaaattctggtaagaggactctatcactctattcaaatccttccttccttccatgctttctctttctttctttttctttctttctttctttctttctttttctttctttttctttcttttttctttctttctctttcttcctttcttccttccttccttcctttctctctctctctttctttcttttcttctttttttctttctctctttctttctttccctttctttttctctatatttgttcacagtttattgaggtataagtgatatacaaaaaactggacatatttaatatatacaatttgatggatttggagatatgcatacatttataagccatcatcacaatcaaggtagtgaacacatccatcacctccaaaattttcctcctgcctcctctttctatattcaaaacctttctttatcattatgtgttcctttcatactaaaataaccttacttgcacctccataaaataaccttatctgcacattggcttcaccaatgttatgggctgtttttaaaaaatttcctttgcaaatttattattgtttaatatctctagattcagaaactgtagacactttgataaatggattgaatttgtttgtctttggtcttcttctcttttaaggtgatatatctagatataatatgtgtgtgtgtgtatgtgtagtgcatgtttgtgcatgtttatcctgtttggtgttttttgagcttcttgaatgtgtggtttagtatctgtcattaatttgaaaagttcttgtccactatttcttcaaatatttcttctgtgacatttattctttcttctctttccagtattacaattattattattattattattttgtgatggagtctcactctgtcacccaggctggagtgcagtggtgcgatctcggctcactgcaagctctgcctcctgggttcacgccattctcctgcctcagcctcccaagtagctgggactacaggcgcccgccaccatgcctggctaatttttttgtatttttagtagagatggggtttcactgtgttaaccaggatggtctcgatctcttgacctcgtgatctgcccgcctcagcctcccaaagtgctgggattacaggcatgagccaccaagcccggccacaattatgtatatgttatatttgttcctattgttccacagttcttgtatgttctactctggtttttttctataattcttttttctctttctattttagtttggaaagattctattggtctatcatcaagttaactgattctattgatggctgtgtccattctattaacaaacttgtcaaaggcattcttcatttctgttgctgtattttttatttgtaaaatttccttttgattctttcttaaaattgccacctttctggtcatgcatgttgccttcttttacgttaaagcctaaatatattaaacattctccccatttcatatctgagtctggttctgataattgatatgtcccttcagagtattttccttcttgcctctctggtgtttcttttcatttttattgttgttgttaaaagctgtgtatggacttctggtttgtggttctgcatgtaaggagcttggaaatccatgccttcttaacaactacaaagctgaataggttgaaaaagtcaacaactcttcttggatctgtaagataggggaggacacagggaaactactactcccaaggttggagatacaggtaaatatagtcatgactcatgagcagaaactgccagaggaaccggtactagggtaggaaaatctaaactgtaattaaataattgctgaaggttcagtgcagacaagtctaagaattaaaaactccaggaggacccagtgatagacgggtttttacagtattatgagatttacctccaggagctcagccatgttgccatagtaaatattggaggaaaatcttctcacgctttcagcagtgggaaggaaaaaggaaccattttgaaatacaccaaagtactcagagtacataaagactaagacttattcataggaccatagaatgcttcttctccccaccccactttaccacattaccaagggcctatttgcagaagttcattttacatagtacatcatgtctcattattaagaaaaaattacaagacatatcaaaaggcaaaaaaaaaaaccccacaagttcaaaagatagggtaagcatcagaaccagatatggcagggtgttgaaattatcagacctggaatttaaaaatgccgagggttctaaaggatgaagtaggcagtatgcaagaagagatgggcaatgtaaacagagaaatggaaatcctaagagagaaccaaaaagaaatgctcaagatcaaaaacattgtaacagaaataaagaatgcctttgttgggtttattagtagacaggatacaactgagtaaagaatctctgagcttgaggatatatcattagaaacttcaaaaactaaaaaagcaaagagaacagaaactgaaataaaacaacagaatagattatccaaaaactgtgggaaaactgcaagggtataacatatgcataatgggaatacaagaaggggaagagaaagaaagaaatataagaaatattggagtcaataatgactgagaatttccctaaataattccagacaccaaaccacagatccaggtggttttgtgtctggcattatttggggagagtctcagttcagagaacatcaagcaggataaatgctaaaaaatgacacctaagcacatcattttcaaactgcagaaaatcaaagagaaaaaaatcctggaataagccaaagggttgggggggattcttatctatagagtaacaaagataagaattacttccaactcctcaaaaaccatgcaaacaagaagagagcggagcaaaatattcaaagtgttgagggaaaaatccaccaacctagaattgcatattttgcaaaattatccttcaaaagtgaaggatgaagactttcttagagaaacaaaaactgagggaatttattgttagtagaccggccttgcaagcaacgttagaagttctttagagagaaggaaaatgataaaggacagaaactctgatctacatgaagaaagtaaaaccatcaaagaaggaataagtaaaggtaaaatgaaaacttttattttacaattcttaattgatctaacagataacagtttgttcaaaataatagcagcaatataatcaattatgtaggtgaatgtatatatcatatatagcttatgtatgcttacatacaagtgaaatgaatgtatctttgatacaaggaacgggagggagaaattaggttattttgttattatgaggtattcacactgcctgcgaagcggtacagtgtcatttgaaaatggacttagattagttgtaattgtatgtccaaaataattgaaaacaggtattaaacaaaaaaacctaaaaacttgtacaccaatgttcatagcagtactagtcacaatagccaaagtaaggaatcaatgaaatttcgatcaactgatgaatagaccaacaattgtggcatatccatacaatgaaatattgatggctggcctcaatggctcatcctgtaatccaagctctttgggaggccaaggtgggcagatcgtttgagcccaggaattcaagaccagcctgggaaacaaggcaaaaccccatctctacgaaaaatacaaaaattagccagcctcataacttggtctcaaaataaataaataaatagatacaaattgaaaaataaaaacatttaaagaaatattgagccataaaaaggaatatagtactaatccatgatgcaacacagatgaacctcaaaaacgtgctaaatcaatgaaaccagacacaaaataccaagtattgtatgattccatttgtatgaaatatccagaatagttaaatccatacagagagaaagtggttagtggttgtcaggtactgaaggagaaggaaatggccagcgacttcttaatgggttcagggtttccttttgtagtgatgaaaatgtttcagagccaggtcaaggtgcttgttgcaacattgtaaatatgctagatgactctaaattgtgcactttaaaatggttattgtatgttatgtgaatttttcttcaataaaaaatttgatgaaaagcaatagattgcaaatttaacatgtgtaaaatctaactcgtgattccctcactgccaaatctgaaatcacagtctttcacactccagttaattgcaaatccattcttctttttcctcaggccaaaaaccttgtagtcatctttgactctctcacactccacatctaatccataggaaactatgaaaggatttacatttctaaatatatccagaatgtgacaacatctcaccattaccacttctatcattctcgtctaaactactataatctccttcactagattttcacaatagcctcttaactggcttcgatcttttcccctcttcagtccttttcagtacagcagccagaggatcctattaaagcatgttatataacataaattttctgttcaaaaccctccagtgattttctgctgctttcagagttaaagccaaagttcatacaatagcctgcagggctctagatgatatgaactaacgtaaaatctgtgacctaatctcctattcttttccccttcattcacattgccccatctgcaccacccttctggctgttagtaaaacttccaggaagaatatttcttcaggaaactgccattgatgtctcctctgtctgaaatatccaccacaactgccatcatcgttaccatcacagccgatatccaaatgattttctaccttacctccctcagttatttactcagatataacttacacagtgagcccatctctaacaaccctacctaacactgtaaccccctcatccttcccagctcacttccacaccttacatttctccttactgcttatcaccattaaaatcctatgcattttatttatttagattttttatctatcttcttcaattataatataaacttcacaagttcaggtaattttacctatctcattcactactatattttcagcacctaacacagtacttggtaaaccatagaagataagtaaatatttgttgagtgggagtggatgaatgacattgtaggaagaatctcctaatggccacctctctgcacaatatggttccataattactgcaggatctccttgcagaaagcctgcctgtcaattccttgctgagctctattctctcacatctagagtagttgtgtttctacctattcaaggaacaatgaggacactacctcacagaagtctggctggtatttattcttctgtggtgaacacctctaaacgaaaaggattttgagttgatctcttgcctatccataaatgggatcaagtccaggggttcagagagaaaagataatggggagcatcaccagagaaaaacctaagtctgttagcatgtaaacattattaattatgtgtatgtgtcttgggggaaaagtgcaagaagagctggataataatttttataagagaagaatgattcatatttgcagcttaatagaagtctgtaatatctagatatgtctgtaatgtcaaagtccagagcaaagacagaatagagataagggaacaggacaaaaggtcatgtttggacagagaagggagactgatttttggaggggcagagatgcatttaactcaagttaaatctagcttatttgtagtttggaaacagcaagaggtttaggccatagtcaaagctatctacatatcttacctgtaaactggaataaatcaaatgcaacttgttcaactgatcactctctctggtattcaggatttgacagttccaaatctgttaccctccagagctgccgcaaaacatcaaagacttacaggtttcagagatactcttccccaattttaaaaaagtagatgtaccacatttcaaatgaaaagagttaggtctaaataaattgttaacatagttcaaagtgtaaagaaaatgtgaaatatgaatattgaaggaaaagctatgtaatgatctttaaataataaagactccctgaacacaacatacatgtactgtttctgtaatctgggtcctactttcctttcagcctcatagcattcctcttcaccacaacgaccacaacttcttttactctagtcacactgaatcactgtgctaatctgctcagaactgcacacctgtgaatgagcctccataatataacttgtgtctcaagtttcacttgttatttttgtcgtgactcagattagcttcggtttccataatagcctgtctcagtcgtttgccttaacctgtcaccacaagaagacaaagacagtagagagacatgttttctcacctgtccctggcttctattcaccaagcttcctgcctgacctgagcaatccagtgggcatgagcagaaaaatgctcatcaaaaagttggattccagcaactttttatagcagctagacccttttctttttcctctgccttttgagactctatacttaaacaaaatagactttaagtaaaaaactgtcactataaatgtaatcacaaaggagattgttacataatgataagagggccaattcaacagtaaaatataaaaattataaatatataagcacatatcatcaaagcacctaaatatgtaaagtaaacgttgtcagatctgaagggagaaatacatagcaatacaatggaagtaggagattttaagaccccacttacaactggggatagataatccagagataagatcaataaggaaaaactacagactgaatagacctaacaaaaatcttcaacaaaatattaccaaatgaaattcaacagcacattaaaagaattatatgccataaccaagtgtaagttagccctaggatgcaaggatggttcaacatactcaaatcaatcaatgtaatacaccacattaatggaatgaaggctacacatcacatgatcatattaatagatgcacaaaaaatatgtgacaaaattcaagaccctttcatgctaaaaactcaacaaactaggtataaaaggaacttaaaacaatacagaccatatatgaaaatcccactgcaaacatcatattcaatgacgaaaaactgaaagctttttctgtaagatatggagcaagacaaggatgcctactcccaccacttcaatttaacacagtactggatgtcatagccagaggaattaggcaagagaaggaaataaaacacatccaaattgggaaggaaaaagtaaaaatatctgtttgcaggtgacatgatcttattagactttttcctatagagctgtttgaatgccttatattctggttattaattccttgtcagatgggtagttttcaaatattttctcccattctttgggctctttcttcactttgttgcttgtttcttttgctgtgcaggagctttctaacttcatgtgatcccatttgtacatatttgctttggttgcctgtgcttgtgggtattgctcaagaaatctttgcccagaccaatgtcctggaggttttcacaaatgttttcttgtagtagtttcatagtttgaggtcttacatttaaagctttaacccattttggtttgatttttgtatatagtgagatactggggtctacctttattcttctacatataaatacccaattttcccagcaccatttattgaagaaattgtcttttctctagtgtatattcttggcccctttgagctcactgcaggtgtgtgcatttgcttctgagtcctctattctgttccattggtctacctgccttttgggggtagtaccatgctgttttggttactatagctctgtagtataatttgaaatcaggtaatgtgattccttctgttttgttctttctgcttaggatagctttggctattatggactcttgcatttccacataaattttaaggttgtttttctatttctgtgaagaatgtcattgctattttgatagggattgcactaaatctgtagattgctttggatagtatgaacattttaacaatattgattcttccagtctatatatagttttatagttttcattgtagaggtttttcacttctttggttaagttgactggtaggtatttaatattatttgtggctattgtaaatgagattatgttttgatttctttttcaaattattcattgttggcatgtagaaaagctactggtttttgtatgttgaatttgtgtcctgcaatgttactgaatttatttaacagttctaaaagtttccctgtggcatctttaggcttttcccaaatataagaccatatcatctccaaacaaggataatttgacttcttcctttccaatttggatgtcctttatttctttctgttgtctaactactctagctggggtttccagtactatgttaaataacagaggtgaaaatgggcatcaatgtcatattccagattttagagaaaaggctttcagttttttcccattcagtacaatactagctgtaggtctgctgtatatggcttttattatgttgaggtattttccttttatgcccagttttttgaggatttttagcatgaagggatgttacattttatcaaatgccttttcagtatcagttgaaattatgatatagtttttatcctttgttttgttgataagatgtatcacattgattgatttgcatatgttgaaccatcattgtagcccagggataaatcccactgggtcatggtatatgattcttttactgcactttggtatttggcttgatagtaattttttgaggctttttgcatctatgttcatcagggatattggcctgtagttttcttttcttcttgtgtcttttctttctttcaaattcatttatttctgctctgatcttttcttttactaattttggattcagtttgctctaacttttctcattctttaagatgtatcattaggttatttatctgaaatgtttctccttttctgatgtaggcacatagctataagattctctcttagtactgcttttgctgtctcccacatgttctggtatgttgtgtttccactataatttgtttcaagaatttttaaaattgtcttcttaatttcttcattgacccactggtcattcaggagcacattgtttaactccatgtgtttatatagtttcaaaattttttcttgttattgatttctggttttattccattgcttgatataatcttaatttttttgaatgttttaagacttgtgttatgacctaacatatggtctatcattgagaatgattcatgtactaaagagaagaatgtgtattctacagccattggatgaaatgttctgtaaatatctattatgttcatttgttctatagtgcagattacgtctgatatttctttgaagtcttcaggtattattgtattgaggtctatctctctttagctctaataatgtttgcttcatatatcttgttgctccagtgttgtgtgcttatgtatttacaattgtaatatccttttgctgaattgacccctttgtcattatataataatcttctttgtctcttattttttattgtgaaatctattttgtttgatataattaaagttactccttctctttttttggtttccattggcatggaatacttttttccatccctttattttcaatctatgtgtatgtttataggtgaagtgtgtttcttgcaggcaacagacccttgggtcttttttttttttttgatggaatctcgctctgtcatcaggctggagtgcagcggtgtgatcttggctcaccgcaaccaccgcctcccggtttctgctgcctcagcctccggagtagctgggactacaggcacatgccaccacgcccagctaatttttttatttttagtagagacagggtttcaccatgttggctagtatattctcgaccccttgacctcgcgatccacctgccttggcctcccaaagtgctgggattataggcgtgaaccaccgtgcctggccaggccttgttttttttttaatctattcaacctgtctatgtcttgaattggagcatttgttccatttacattcaatgatattattgataaatatggacttacccctgcaattttatttgttttccagatcttttctagtcttctcttccttctttctttccttctttttttttattattattttactttaagtttcagggtacatgtgcacaatgtgcaggttagttatatatgtatacatgtgccatgctggtgtgctgcatccattaactcgtcacttagcattaggtatatctcttaatgctatccctcccccctccccccactccacaacagaccgagaatgtgatgttccccttcctgtgtccatgtgttctcattgtttaattcccatgtatgagtgagaatatgcagtgtttggttttctgtccttgcgatagtttactgagaatgatgatttccaacttcatccatgtccccacaaaggacatgaactcatcattttttatggcagcatagtattccattgtgtatatgtgccacattttcttaatccagtctatcattgttggacatttgggttggttccaagtctttgctattgtgaatagtgctgcaataaacatacttgtgcatgtgtctttatagcagcatgatttatagtcctttgggtatatacccagtaaggggatggctgggtcaaatgctatttgtagttctagatccctgaggaatcgccacactgacttccacaatggttgaactagtttccagtcccaccaacagtgtaaaagtgttcctatttctccacatcctctccagcacctgttgtttcctggctttttaatgattgccattctaactggtgtgagatggtatctcattgtggttttgatttgcatttctctgatggccagtgatgatgagcattttttcatgtgtcttttggctgcataaatgtcttctttcgagaagtgtctgttcatatcctttgcccactttttgatggggttgtttgtttttttcttgtaaatttgatggagttcattgtagattctggatattagccctttgtcagatgagtaggttgcaaaaattttctcccattttgtgggttgcctgttcactctgatggtagtttcttttgctgtgcagaagctctctagtttaattagatcccatttgtcaattttgacttttgttgccattgcttttggtattttagacatgaagtccttgcccatgcctatgtcctgaatggtaatgcctaggttttcttctagggtttttatggttttaggtctaacgtttaagtcttaatccatcttgaattaatttttgtataaggtgtaaggaagggatccagtttcagctttctacatatggctagccagttttcccagcaccatttattaaatagggaatcctttcctcattgcttgtttttgtcaggtttgtcaaagatcagatagttgtagatatgcggtgttatttctgagggctctgttctgtttcattaatctacatctctgttttggtacgagtaccatgctgttttggttactgtagccttgtagtatagtttgaagtcatgtagtgtgatgcatccagctttgctcttttggcttaggattgacttggcgatgtgggctcttttttggttccatatgaactttaaagtagttttttccaattctgtgaagaaagtctttggtagcttgatggggatggcattgaatctataaattaccttgggcagtatggccattttcacaatattgattcttcctacccatgagcaaggaatgttcttccatttgtttgtatcctcttttatttcattgagcagtggtttgtagttctccttgaagagatccttcacgtcccttgtaagttggattcctaggtattttattctctttgaagcaattgtgaatgggagttcactcatgatttgactctctgtttgtctgttgttggtgtataagaatgcttgtgatttttgtacattgatttgtatcctgagactttgctgaagttgcttatcagcttaaggagattttgggctgagacaatgggattttctagatatacaatcatgtcatctgcaaacagggacaatttgacttcctcttttcctaattgaatgccttttatttcctttccctgcctaattgccctggccagaacttccaacactatgttgaataggagtggtgagagagagcatccctgtcttgtgccagttttcaaagggaatgcttccagtttttgcccattcagtatgatattggctgtgggtttgtcatagatagttcttattattttgagatacgtcccatcaatacctaatttattgagagcttttagcatgaagctttgttgaattttgtcaaaggccttttctgcatctatcgagataatcatgtggtttttgtctttggttctgtttatatgctggattatatttattgatttgtgtatattgaaccagccttgcatcccagggatgaaacccacttgatcatggtggataagctttttgatgtgctgctgaattctgtttgccagtattttactggggatttttgcagcaatgttcatcaaggatattggtctaaaattctcttttttcattgtgtctctgcccggctttggtatcagggtgatgctggcctcataaaatgagttagggaggattccctctttttctattgattggaatagtttcagaaggaatggtaccagttcctccttgtacctctggtagaattcggctgtgaatccatctggtcctggactctttttgtttggtaagctattaattattgccacaatttcagatcctgttactggtctattcagagattcaacttctttctggtttagtcttgggagagtgtatgtgtcgaggaatttctccatttcttcgagattttctagtttatttgcatagaggtgtttgtagtattctctgagggtagtttgtatttctgtgggatcagtggtgatatccccttcatcattttttattgtgtctatttgattcttctctcttttcttctttattagtcttgctagcggtctatgaattttgttgatcctttcaaaaaaccagctcctggattcattaattttttgaagggttttttttgtctctatttccttcagttctgctgtgattttagttatttcttgccttctactagcttttgaatgtgtttgctcttgcttttctagttcctttaattgtgatgttaggttgtcaattttggatctttcctgctttctcttgtgggcatttagtgctataaatttccctctacacactgctttgaatgtgtcccagagattctggtatcttatgtctttgttctcattggtttcaaagaacatctttatttctgccttcatttcgttatgtacccagtagtcattcaggagcaggttgttcagtttccatgtagttgagcagttttgagtgagtttcttaatcctgagttgtagtttgattgtactgtggtctgagagacagtttgttataatttctgttcttttacatttgctgaggagagctttacttccaactatgtggtcaatgttggaataggtgtggtgtggtgctgaaaaaaatgtatattctgttgatttggggtggagagttctgtagatgtctattaggtccgcttgatgcagagctgagttcaattcctggatatccttgttaactttctgtctcgttgatctgtctaatgttgacaatggggtgttaaagtctcccattattattgtgtgggagtctaagtctctttgtatgtcactcaggacttgctttatgaatctgggtgctcctgtattgggtgcatatatatttaggatagttagctcttcttgttgaattgatccctttaccattatgtaatggccttctttgtctcttttgacctttgttggttgaaagtctgttttatcagagactaggattgcaacccctgcctttttttgttttccatttgctcggtagatcttcctccatccttttattttgagcctctgtgtgtctctgcacgtgagatgggtttcctgaatacagcacactgatgggtcttgactctttatccaatttgccagtctgtgtcttttaattgtagcatttagtccattgacatttaaagttaatattgttatgtttgaatttgatcctgtcattacgatgttagctcgttattttgctcgttagttgatgcagtttcttcctagtctcgatggtctttacattttggcatgattttgcagcggctggtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgagaattcttttctttaagagtgttgaatattggcccccactctcttctggcttgtagagtttctgctgagagatctgctgttagtctgatgggcttccctttgtgggtaacccgacctttctctctggctgcccttaacattttttccttcatttcaactttggtgaatctgacaattatgtgtcttggagttgctcttctcgaggagtatgtttgtggcgttctctgtatttcctgaatctgaatgttggcctgccttgctagattgaggaagttctcctggataatatactgcagagtgttttccaacttggttccattctccctgtcactttcgggtacaccaatcagacgtatatttggtcttttcacatagtcccatatttcttggaggctttgttcatttctttttattcttttttctctaaacttcccttctcacttcatttcattcatttcatcttccatcactgataccttttctttcagttgattgcatcggctcctgaggcttctgcattcttcacatagttctcgagccttggctttcagctccatcagctcctttaagcacttctctgtattggttattccagttatacattcgtctaaatttttttcaaggttttcaacttctttgccattggtttgaatttcctcctgtagctcggagtagtttcatcgtctgaagccttcttctctcaactcgtcaaagtcattctccatccagctttgttccgttgctggtgaggaactgcattcctttggaggaggagaggcactctgctttttagagtttccagtttttctgctctgttttttccccatctttgtggttttatctacttttggtctttgatgatggtgacgtacagatgggtttttggtgtggatgtcctttctgtttgttagttttccttctaacagacaggaccctcagctgcaggtctgttggagtttgctagaggtccactctagaccctgtttgcctgggtatcagcagcggtgtctgcagaaccgcggattttcgtgatccgtgaatgctgccttctgatcatttctctggaagttttgtctcagaggagtacctggtggtgtgaggtgtcagtctgcccctactgggtggtgcctcccagttaggctgctcgggggtcaggggtcagggacccacttgaggaggcagtctgcccattctcatatctccagctgcgtgctgggagaaccactgctcttctcaaagctgtcagacagggacatttaagtctgcagaggttactgctgtctttttgtttgtctgtggcctgcccccagaggtggagtctacagagtcaggcaggcctccttgagctgtggtgggctccacccagttcgagcttcctggcagttttgtttacctaagcgagcctgggcaatggcgggtgcccctcccccagcctcgctgccaccttgcagtttgatctcagactgctgtgctaccaatcagcaagactccatggtcgtaggaccctctgagccagatgcgggcgggatataatgtcctggtgagccatttcctaagccagtcagaaaagcgcagtattcgggtggggagtggcccgattttccaggtgccgtctgtcacccctttccttgaccaggaaagggaactccgtgatcccttgtgcttccctagtgaggcaatgcctggccctgctttggctggtgcacggtgcactgcacccactgtcctgcacccactgtctggcactccctagtgagatgaacctggtacctcagatggaaatgcagaaatcacccgtcttctgcgttgctcacgctgggagctgtagaccggagctgttcctattcggccatcttggctcctccctttctttccttcttgtctttcttttagtaaaggagattttctctggtggtatgatttaatttcttgctttttgttttttgtgtattcattgtatgtttttcaatttgaggttaccatgaggctttcaaatactatcttataacccactattttaaacagatgacaacttaaaactgattgcataaatgtgcaaaaagaaaactaataaaaactctacactttaaattcatccccccactttttaactttttgttgtttctctttatgtcttattgtactgtctatgtcttgaaaagttgcattttttattggctcattatttagtctttctacttaaaataagagcagtttatactctaaaattacagtgttataatatcttttgcttttctttgtgcttgctattaccagtgagttttgtaccttcatatgatttcttcttgctcattaacatcgttttctttctgattgaagaacaccttttagcaattcttgtacaagtctggttttatgaaatatctcagcttttgtttttctgggaaagtctttattgctccttcattcttggaggatatattcaccagatagactattccttcaatactctaaatatgtcatgctacactctcctgacctgtttgatttccactgagtagtctgctgccagatgtattggaacaccattgtatgttatttatttattttctcttgcttgttttacaatcatctcttcatccttgacctttgggaatttgagtattaaatgcctttaggcagtcttctttgggttaaatctgcttggtgcttaaaaccttcttatacttcaatgttgataacttactctaggtttcggtagttctctgattttttttttgaataaacttgctacccttatctctttctctgcttcatctttaaggggattaactcctagatttgcccctttgaggttattttctagagcttgtaggtatgcttcattttatttttgaattttttctcctttgacagtgtattttcaaataacctgtcttcaagctcactaattatttcttctgcttaataaattctgctattaagagactctgatgcattctttagtatatcaattgcatttttcaactctagaatttcttcttggttctttataattattttagtttctttgttgaatttatttgatagaattctgaattccttttctgtattatcttgaatttctttgagggcctcaagacagccattttgaattctcatctgaaaggccacatatctgtttctccaggtttggtcactggtgtcctgtttaattgatttgatgaggtcatgttttctggaagatcttgatgcttgtagatattcatcagtgtctggacattgaagagttaagtacttattttagtcttcacagtctgggcttgtttgctcctgtcgttattaagaaggctttccaggtattccaagggacttgggccctaagcccaataacactggtttttgcagacttgtataagtactgtgttggcggtcttagataagatccaaaagaattttctggattaccagtcagaggctcttgttctttttccttagtttctcccaaacaaatagtctctctctctttctctctctctctttttctgccaagccacatggagtgtgatggtgcaaggaccactgtggctacactactgggatttcactgagtcagacctgaagccaacacagcactgggtcttgcccaaggccctcagtaaccattacctggctaccgtctatgttcactcaaggccctagggctctatgaccagtagttggcaaattcacccaggtttgtgtccttcccttcagggcagtgaattcccccaggccccaggtgggtccagagatgctgtctgggagccagggatttgaggaaaaaaaacttagaaatttgcctgatgctctgtgctactgcagctaagctggcactcaaaccacaagatgcagtccttccctccctttccatagtcagaggaacatttccctgtggccaccaccaacactgccctataggggtttctgccaggccactgccagtgttcacttaaggcccaagttctcttcagtcagcttgtggtgaatgatgccaggccctaaactcacccttcagggcaatgatctcttctctggcccagagaaggcccagaaatgctgtccaagattctaggcctgaactcagggaccccaagagcatgcttgttgctctacccaattgtagtcaagctgatacttaaggtgcaagacaaaatctccttaacttttcactctacttttctcaaacagaaggagtctttatccatacaccacagctggcaatgtgctcagtgatacctgaagccagcaggtctcacagcccaaggcccatggcatactacctgggtattgctgctggttattcagggcccaagggctctttagtaagcaggtgatgaattctgccaagaccgtttcttcccttcaaggcagcgtgttcccttttgacccagggtatatctagaaatgctgtctgggagctagggcctggaacaggaacctcatgactgactctgcctgagctgaggaagtagtcacttttgctgctgtgagtttcactgcctgggttggggaaggggtcgtgcaagcattcctttacctgcccagcttgtctccctatgtcatgtgccaccctagtcctctggctctgggcccagcccagcagtaagagttgtctaggaattgcagttcttgtgtgctagactgcctttcaagtttatcaaggaccccagagcactgtgacccacagtagcaaggcttgccaagaaattcaagttccaactgctggagtgggaagttctcctctggctgagtctggtccaaatgctctctctctgcatgaatgctggctgaacccagcacagtttgctctcctctctgctgtgatagagcattaccgagttcgatgttaagtcttccagttactgcactctccctcccccaagtgcacagagtctccatgcagcatggctctactgggggatggaggagatgtggcattggcgactcaagactgtctctttgactctcttcaatgcctctttcaaagatatgaagttaaaaacatgtactatgattgctcacctgatttttggttctgcggtggtgcttttctgtgtgcagacagttgttaaaatttggtgttcctgcatgtgagacaaatggtgtaggctcctattctgccatcttgctccaacccatcctattctatatttttatttttatttgccatatataatgaggagtgaaactgcatttaactctgtcaagtttctctgcaatttagtacctatgtaaatcacaatagcatttaccaaatattccattttctgctcttgatttctcacacaaccacttggtgaggcagagtcatatgacttgttctggctagatactcagagtataaaaccttctgaagtggagggaaaaagaaagtagcaaccatagcaaagttagagtagttataccattatcaatcaagagagactttaaaccaaaaagtatgttactagagacacaaagggacattttataatgataaaagagtcaatgcattagaaagttataacaattatatatgcatctaataacagagcaccaagatacatgcagtaaaaactgacaggaatgaaggtaaaaatatataaatcaaaaatagttgttgaagatgtcaatatcccattttcaataatgatacaatgaccacacataagattagcaagagattaggtttgaacaacactataaagccatgagtcctaagagacatcaatagagccttccattcaacgacaatagaatatacattcttctcaagtgcatatggaacattctccaggatagagcaaatgctagtccatagacaaaacttcagtaaatttaaaatgagagaaataatatgaagtatgttctctgaccacaaaatatttaatttgaaatcaataataagaatttgggaaactcacatatatgtgaaaattaagcaagatactcccaaataaccaatgggtcaaagaacaaatgaaaggggaaattagataatctcttgaaatgaataacatgacgacatagaataacaaaatttatgcaatgcaacaaactcggtgcttagagggtaatttatagctgtaaatacctatgttaagaaagaagaaagactacaaatctataacctaaccttccaacttaagacacaaaaagaaaaacaacccaaaccttaaacaagcagaggaaatagtaaagattagaatgggaattaatgaaatagataataggaaacctatcaagaaaatcaaagaaacaaaaagctatttttttaaaagctcaacaaaattgaaaaacttttatctaggttgaccaagtaaaaagggagtggagacacaaattaccagaatcagaaattaaagagagatgattactactgaccttacagaaataagaaggggtataaagaaatactatgaataattgtacaccaacaaattagattacttagatgaaatggacaaattcctggaaacacaaactgctgaaactgattcaagtatgagtcttcataggcccataaccagtgaagagcttgaatcaataatttaaaaccacccataaagaaaagacgagacccacattgctttatcactaaagtctatcaatcattttttgaaatactaattcttcctgaactcttccaaaaaacagaagaaggaatgcttctcatctcattttataaatttatagctttttataccctgacaccgaaaccaaatacaccacaagaaaaaaaaaacctacagatcaaaatctcttatgaatatggatacagacattttcaacaaaatactagcaaactgaatatggcagcacataaaaagagctatacaccatgaccaagtggtatttatcccaggaatgcaagattggtttaatattttaaaaaatcacttaatataatacatcatattaataaaacaaaactaaaaaatacatgactatctccataaatgcaaaaaaaggatttgacaaaatccaacattctttcatgacaaaaacactaaaaaactgggagtaggtggggacttcctcaacatgataatgaacatctatgaaaaatcaacagcttatgtcatacttctgttcaaagactgaaggcttccccctgagatcaggaacatgacaaggatgtctgctctcaccgtttttactcaggattttactggaggttataaccagtgcaattagtccagcaaaataaataaaatgtatccagattacaaaggaagggttaaaactatctctatttgaagatggcatcatcttgtatacagaaaatcttaaggaatccataaaaaacgatagaactaatcaatgaagaatcagaaagaaaagttggaaaagcaatcttatttacaatagcatccaaaagaataaaatatttagaaataactttaaccatggaggtaaaatatctgtacagtgaaaactataggacattgatgaaagaaattgaagacacacgtaagtagaaagatatcctgagttattgaaacagaagaattaacattgttacaatgtccatactactcaaagcaatccgatgaaaataaatgaaaatcctatcaaaattctaatcttatttttcacagaaaataaaaaatcctaaatttgcatgaaaccacgaaagaccctgatttcaaagcaatcttaagaaagactaacaaatttagaggcatcacacttcctatttcaagctgtattgcaaagctgtagaaagcaaaacagcatggtactggcataaaagcagacacatagagcaatagaatagagagcccagaaatatactcatccatctacagtcaatttatctttgacaaaggtgtcaaaaccatgtcatggggaaaggctcttcaataaattgtattgggaaaactggatatccacaggcaaaaaaaaaaaaaaaaaaaaggacccttattttacactacttacaaaaatgaactcaaaatgaattaaagacatacatgtaacacttgaaaccttaaactcctaccaaaaaaaacaggaaaaagatctccttgacattgttctcaacaataattttttgcacatgacaccaaaagcaaaaataaacaagtggggttacatcaaactaaaaagcttttgcacaacaatgaaaacaatcaataaaatgaaaatgtaactgacagaatgggagaaaatatttgtaaaccatatacctgataaagggttgatatttgaaatttataaggaagtcctacaactccttagcaaaaacaaaacaagaaaaacaaaacccagaaaacaacaaaaaacccactcctaataatcctattaaaaatgggcaaagaagctgaatagacatttttgcaaagaagatatacaaatggccaacagatataatgaaaagttgctcaacattactaatcatcaaagaaaacaaaaccacaatgaaatatcacctcacatctgttaggatagctattataaaaaagacaagagataacaaatgttgactaggatatagagaaaagtgaacccttgcacaggttgatgggaatgtaaattggtgtacattaaggaaaacagtatggagaattcttgaaaaattaaaaacagaactaccatatgataaaacaatctcacttctcattatatatccaaaagaattgaaatcaagatcttgaagagatagctgcactcccaaattcattgtagcattattcagaagagccaagatatgaaaacaacttgtatgtctattgacagatgaatggataagaaaaaaaactgtggcatatacaaacaatggaatattattcagtctttaaaaagaaggtaatcctgccatatgtgactatgtgaattaatctagagaacattatgctaagtaaaataagctagtcacaaaagacaaatactcaatgattccactaacagaaggtatctaaaatagtcaaactcatagaagcagagagtaaaatggtggttgtaggggctggggcaaggaagaaatggggaatatgttaaatgtgtataaagtttcagttatgcaggatgagtaacttctagagatctgctatacaagttggtgtctatagtcaacaatactgtattgtgcactttaaaaaattgctgagggtagacctcataatgagcattcttactacaataaaaggagagtcctgaggaaacttttagagatgatggatatatgttaattactttaattgtagtgatggatttattgtgtatgcctatgtccaaacttaccaaattgcttgcattatatatatgcaggtgtgtgtgtgtgtgtgtgtgtgtgtgtgtgtgtgtgaaatcttaccatcaagccagtaatcaagaaggtgtggtattggtataaacacaggcatattgaacaatggaacagaataacaacccttaataagtgaaataattccagtcagtaaaaacacaattctaaaagataaaaatataacccagaaattttactcctgagtatcttccaaatagatacagaaatattcattcgtgcaaagatttttacatgaatgtttatagcagaaatcctaacaatggttaaaaagtgaaagcaacacaaatgtccatcaattgctgaatggacaaaccacattcctcaaaatctgaatttgtcagtctagattaacctctgttactcagtctggatctcatggacctcaaacctcatttcttcaccctctggatatctcagccttgccaatccctcattctcaattttgtcatccactgggatgtaggttatcagcatttaagggtatgaaacttgaggctgacgagtcacaatttttaaaaagccagtatctccagttgatctaatctttatctcccactctttaaaaattttaactcctacacataaccaccatttctcttccatcttcaaattctcctactctagtggttacttccatcaatgtacaatttatgctctactgtcctccattttcaacaaataccttcccttgatgacacttccctaccagctattgttctatatatctgctgtcctgtttatatgctggattacatttattgatttgcatatgttgaaccagccttgcatcccagggatgaagcccacttgatcatggtggataagattttgatgtgctgctggattcggtttgccagtattttattgaggatttttgcatcgatgttcatcagggatattggtctaaaattctcttttttggttgtttctctgccaggctttggtatcaggatgatgctggcctcataaaatgagttagggaggattccctctttttctattgattggaatagtttcagaaggaacggtaccagctcctccttgtacctctggtagaattcggctgtgaatccatctggtcctggactttttttggttggtaagctattgattattgcctcaatttcagagcctgttattggtctattcagagattcaacttcttcctggtttagtcttgggaggacgtatgtgtcgaggaatttatccatttcttctagattttctagtttatttgtgtagagttgtttatagtagtctctgatggtagtttgtatttagaatgccgatcattaaaacgtcaggaaacaacaggtgctggagaggatgtggagaaataggagcacttttacactgttggtgggactgttaatgcccctagggaggcattaacatcattgattgagatataatctcttgaacaatataagaggcatagtaggcgcacaacgaatggttctgggtcaacaaaaaactgacagcctcacaaatctacattcatgttgcttagggttgccagtctgggaccaagaggaattatggcatttgaagagaaataatgtgtatcgattattttaaagcatcctctgtttcaagaggcaaagcttgaatgtgcaatggggtgataacttcggttttctcaatctagcttgaactgtattatagaaaagatactaataataataggcactgtttattgagttactaagagccataaaaaggcctactttgttagagtgccagcaacattttccagatgcttcaggtggaatccgtttcttactcttgtgtcagctgaaatttgagcttgaaagagacactctattatgagggaatccacttttacaagccattttcattatgcagccatcaaaatagacatatctatgtattattttgagaaaatccatgcactggggcatgatttatatgcagatgcttcaaattaaggtagtaaatactaagctgaataatataaaaagctgtattgataatataaggtatatcttggcagagatcaagacgttacctcctttttggctgggccagagagaatgggagttagttttctagtcttagagaatgtggggcagagtcaagtgggatcacagtctgacgaagtaattagattcctgcaatattgtggtaggtcagtgcataagtagtggacattccatgatatggaaaaccatagtgtcacccttttgtgcactgtaatatcctctagtttcctaaaatgggtagcatgtttgttaaacgttatagtctgctgttagcagtgttttgggaatgaaggaacaggtagatctgggaaaggaaagagcagtagcctgcggaattggatggagaccctgacagttccccgctagagaaggctggaactgccaactaagccggaggtgacaagtaacaacccccatggatttctggaacatgtaagcactgcccggggaatttaatatatattaagagagagttcctgtagtcagccaggtaaccgtctcagaaggaacttacttggtattgttggaagagacagacagggagagagagagagagagagagagagaggcttttctccacctctgcctctccgtttttcagcccacagagaagatcaaacagaacttgaaatgggtatgtgtttacatatgagagctgaaaaaagacagtagaatattctcttgctcagtctcagctgggaacatgtgtgtcaggtgactcaatgtttttgctggtctgtgcatgtctgcaaatgaccacaaacatgctacaagtattgatttgggggttacaaataaattttagcaagtatacaaattccagtgtacaccagaattcaacaaggcgatgatgaagaacttcggaggcacagaaactcgagatagcagcatagagagggaagtgaagcccctggcctaaataggctttggagtcaagaggcactccccattgtgggaaaaaggtaagcagaaaatccctagcagtgctcattctcaccatggatgcctgcaatcctagctacaggagatcctgacagccctcacaggtcctgagtccagtatagggagctgcctagagttcatgtgactgcattcttttagagagggaattcacactacattttcccgtgaccccaggactcacggggactcagactgctgcagtatggtgccattttgagagcagagtcacgggagtatgtattgcccttgatgttcaatggcccctgtatctccacatccctggagccctgtcaatatcccaccacaaccacctacagggctgcacagtggggtgttgaagtcctcaactattatttattggggtctggttatccctttagctttaataatatttgctttatatatctgggtgctctggtgttgtgtgcacacatatatttacaattgtgatattcttttgttggatgtttttttactgtataatgtccttctttgtctctttttatagcttttgatttgaagtctgttttgtctgacataagcataattactcctgctcacttttggtttccatttgcaaggaatatctttttccatcccttcactttcagtatacgtgtgtgttttcacagatgaggtgagtttcttgtaggcagtatatagttgggtctttaaaaaaatcattcagccaatctatatcttttaaacagggaatgcaatccatttacattcaaagttgttattgattaggtgaggacttactcctttcattttattgattttctagttgttttgtatgtactttgttccttacttcttctcttattgtttatttttgcagttgggtggctttctgtagagataaggtttgacttttttctttttctcctttgtgtgttggctctaccagtgagttttgtagtttcacatgttttcatgatcatcttttcacttccagatgtaaaactcctttgagcatttcctgtaagtctggtctagtggcaattaattcccttattttttgcttgtttgtgaaatgttttacttctgaaggatatatttgctgggaaatattttatgggtaaaacttcaaaagcacaggcaaaaaagcaaaaatagacaacttggttatatcaaactaaaaagcttctttacagtaaagaaaacaatgaacagggtgaagagcaggcaaatatatttgcaaactattcatctgacaagagattaatatccagactatacaatgaactcaaaaacctcaacaggaaaaaaacagattatctaataaatgtgggcaaatgatatgaacagagatttctaaaaaaaaaaaaacatgcaaatggccaataagtgcacgtaaaaatgctcaacatcactaatcatcagggaaatgcaaatcaaaaccataatgagctattatctcactccagttaaaatggctaatatcaaaagaaaaaaaataacaaatgctggtgaggatgtgaggaaaaaggaactcctatactgttgatgggagtgtaaattgctgtaacttttatggaatacagtatggcagttcctcaaaaagttaaaaatagaactaccatatgatccagcaattctactactgggcatttatccagaggaaaggaaagagatgtctgaatccccatgcttattgcagtactattcacaatagtcaagatatggaatcaacctaagtgtctgtcaacacatgaatggataacgagaacgtggtatatatacacaatggaatactattcagtcataaaaaagtaaatcctatcattcattgcaatatggttaagcctagaggacattatgctaagtgaaatatcgggcatagctgggcacagtggctcacacctgtaatcccagcactttgggaggccagtgtgggtggatcacttgagcccaggagttcaagaccagcctgggcaacataatgagaccctgtctctacaaaaaattaagaaattagctaggtgtagtggctcatgtctgtagtcccagctacttagagggctgaggtgggatgattgcttgagcctgggaggtcaaggctgcagtgagccatgatcatgccactgcactacagcctaggcaacaaagcaagcacctgtctcaataaataaataaataaataaataaataaatgaaaaagaaatatcaagcacaggtacataaatattgcatgtttttactcatgtgggagctaaaaaagttgagctcataaaagtattagaagagtaggattgtggttgttagaggttaggaagggtagggaggaggaaaggatagggagaggttgatcgatggatacaaaatttcagctagataggaggaacacattctagtattctatagaactatagagtcactgtagttaagaataattttgtaacttaaaaaattagtacaacttgggaatattttgcttcacatagactggattatttaattaaaatttatttgtttattgattctgttacacctaaaattatgtatggagaatatgtgtgaaaagggatactagaatttgagtaaaaacacaagggtttatagtaaaagataatcttttatataactcttgggaccatcttgaactctattgaagtgttacgtccttcaatcattctaaatttcataaagattgtcagtttttctgccaggtggggtggctcagcctgtaatcccagcatttggggaggctgaagtgggaggattgcttgaacccagggtttcagaccagcctgggcaacatggcaagacctcgtctctacaaaaaattaaagaaaaaattagctgggtatggtggcatgtgcctgtggtccaagctacttgggaggctgcggtgagagggtggcttaaacacaggaggttgaggctgcagtgagcaatgtttgtgccactgcacttcagcctgggtaacagagtgagaccccatctcaaaaaaaaataatgtcggtttttctaggtctgctatatttatgtaatatgcattgcatttttcttttattttttaattatacaaataatacatgccgattgatttttaaaaggtctttcagtctatatgacacacaggtataatctttcaccatcatactctcctcttcaaaggagctactttaccattttactatgtaagttcttctaaaaacttctatgcatttttgagcaagaatctactatattatttataagcaataaaaaattcatccattacattttgaggcctcagcataattttcaattgctcagaaattcaaaaactcaaaaacattttgatgttactttattttacttacatcttacttacttttctgtaaatagatacaatcttttaaaaatgtggtcaattcccaaacttttatgttattcctcaaaagcaccaaccttctcaagacaacgaatattacatactgtactgaacagcctttcaatttcagcaagtagaacacaaaatggtgggcctgcatgtttagttggatcataagaaagaacacacatgaggtactgaaaccctttacccaggttggacgacattataactgcatagcatttgtgatcagctggattaatggcaactaatgctcttccatcctaaatcctgtcaaatttgccaatatttgctctaggaggataaaaaatacagcaacagtacaatgaaatgttccccaaagaactcttaaacactttggctccaggaattttggtgattggctcttctgagtaagaaagattctgctctgtaaaaaaatctcatatcccacaccaagtacttggtgatttccacagcaagtacttggtgatttccacaccaaaagtacttggtaatttccacatcaagtacactgtgtccccagtctgcaaaatatttcatctcaactgcttttccacacagaggaaaaaataccctcactccactcttgcctttaagaaaagtatctaaatgctgctttaatagctgatgtccttgtttttgacgaaaaccaatatttcagttcacccacttgtcttgccattcttgcagagttagtacttgttttttttgcacctcagtatctgggtactattcaatatcaagtgaagttcttgtaccatccatagttttgtagacacttttgtctcacaatcacatatcttcaatgcctttatgggtttattataaaggatattgcaaaggataaagatgaagagatgtgtagagtgaggtaggcatgccatgctccaggaacctctaaatgttcagctaccaggaagctctctgatatgtttaggctatgtctccatccaaatctcatcttgaattgtagttcccataatcctcatatgtggtgagagagacccagtgggaggtaattgaatcatggtgatggttacccccatccagttcttgtgatagtgaatgagttttcacaagatctgatggttttataaggggcttttcaccctttgctcggcacttctctctccttccaccctgtgaagaaggatgtgttttcaaaatgattgtaagtttcctgaggcctccccagccatgcagaactgtaagtcaattaaacctcttttctttataaattacccagtcttgggtatttcctcatagcagtgtgagaacaaactaatacactctccaataataatttacagtatatttttaaacagttagaaacaaggattttgaatgttcccaacacaaagaaattgtaaatgtttgaggtgatatacattctaattaccccaatttggtcattacatattgtatacatttattgaaatatcacttcctactccataaatatgtatgattattatgtgtcaattaaaagaaaatttccaaaaaattgtttgactatgtatgcaggggattatttctggactgtctattctattccattggtctatgtgtctgtctttatgccagtaccaacactattgattactgtagctttgaagtaacttttgaaattgagaattgtgattcctccaacttcgttcttccttttcaagattatattggtgatttagaatcccttgaaattttttatacattttatggttctactactccatttctacacaaaaggccactggaatttgataaggattaaactaaatctgtacatcactttagatagcattgatattttgagaataatgtctttcaagacacgaaaatatattttttcaattttttaaaggttttctttaatgtctttcagcaatgttctatagttttcagtgtgcaagtctttcacatccttgggtaaatttattcccaggtattctttgtatgttattgcaaatgtcatagatttctttattttttgtttagttcattgctggtatgtagaaacaactgaattttagactatcatataattttgctgaattcatttattaactctagtagctttttttgtggattatatgtgattgtctacatataggattatcgcacctgcaaatagagataggtttactttttcctattttgaatgccttttatttcatttttttgcctaattgccccagttagaactttcagtacaatgttgaatatcagtgataaaagcttgtcttgttcctgatctgggggaaagcttttagtgttttgaaactgagcatggtgatagctatagttttttaaataaatgccttttaacatgttgaagaagttaccttttacacttaggattttttttctgtttttatcatgaaagggtgttggatcttgtcacatgtcttttaaacatcaatttggttggttatagtttttcttttcttcattctattaacgtggtttattgcattgattgatagtaatatgttgaaacacccttacattctttgaataaatttacttgttcatggtttataatcctttcaatatgctgttggattcagtttgtatgcattaagtatttttgcacttgtattcataggggatattggtgtgtagttttcttgtgaagactttatctggtttttgtatcagaataatgctgacctcataaaatgaattaggaagtgtccttttactactttttttggaagagcttgagtagaactctcatttcttcttatttaaatatttggcaaaattcatagtgaagccatctgttcctggtctcctctttgtggagaggtctttaaaattactgattcaatctctttacttgatatacattttcagattttctatttctttttaagacagttgtggtaatttgtgttttgtaggaagttggccattatatatagtttatctcattccttggaatacagttcttaatagaattctatttcttatttcattaaggtcagtagtaatagccctgctttcacttataatttagttgtttacctgttctctctttttaaattcaggttagctaaagttttgtcagtttagttggtatttgcaaggaaataaattgagttttgttgcttctcctattggtttcctatttcacagattgccactctgatctattatttccttccttctactagatttggcttttgtttgctcttgtttctccagtttctaaaggtttaaagttagtttactgattagagatttgtgtttttttaaaaaagtatttaattgacaaagattgtaaatattgtaggtgtgccatgggatgatctgatttatatgttatataatggttaccaccatcaaataaattaagacctatcaccacctatgctgtactttaggtctacagacttgttcatcttataacttaaagtttgtttcctttgaccaatatcttcccatttcctccacgcccctctcctagaaccaccattctactctccaatgctgtgagtttgacttttttagattctctacataagagagatcatacagtatttgtctttctgtgtctcattttttttcacttagcataatgtcctccagactcatctatgttattgaaaatagtatattttttatagctgagtaatatttcattgtatatatatcacattttcttttttttaacttttattttaagttctagggtacatgtgaaggtttgttgcataggtaaacttgtgtcatgggagtttattttacagattatttcatcatccaggtattaagccgagtacccaataattatcttttctgcttctctccctccactctcaagtacacctcagtgtctgttgttttcttctttgtgttcatcagttctcataatttatttagctcccacttataagtaagaacatgtggtattttgttttctgctccggggttagttttctaaggataagagcctccagctccgtccatgttcccacaaaagacattatcttgctctttttaatggctgcatagtattccatggtgtgtacgtaccacatattctttatccactctgtcactgatgggcatttatattgattccatgtctttgctattgtgaatagtgctgcaatgaacatttgcatgcatatatttttatggtagaatgatctgtattgttttgggtgtatacccggtaatgtcattgcggggttgaatggtagttctgcttttaactctttaaggaattaccatactgcttttcaaaatggttgaactaatttacactcccaccaacagtgtataagtgttcccttttctctgcaccctcagcagcatctgcctttttttttttttactttttaataatggtcattctgactggcatgagatggtatctcattttggttttggcttgcatttctctaatgatcagtgacattgagctttttctcaaatgcttgttggcctcatgtatgtcttctcttcataagtgtctgttcatgttctttgcccactttaaatggggtcgtttgtttttctcttgtaaatttgtttaagttccttatagatgctggatattagacctttgtcagatgcatagtttgcacattttttctcccattctgtaggttgtcagtttattctgttgacagtttgttttgctgtgcagaagctcttcagtttaagtagattccatttgtcaatttttgcttttattacgattgcttttggtgtcttcatcatgaaatcttcaccctttcctatgtccaggatggtattgcctaggttgtcctccagggtttttatagttttgggttttatatttaagtccttaatgcatcttgagattatttttatatgtgatgtaaggaagggttccagcttcaatcttgtttatatggctagccagttatcccagcaccatttattgaatagggagtcttttccccattgcttgtttttgtcagctttattgaagatcaaatgattgtaggtgtatggccttaattctgggctatctattctgttccattggtctatatgcctgtttttgtaacagtaccatgctgttttatactgtagccctgcagtatagtttgcagttgggttacatgatgcctccagctttgttctttttgtttagaactgccttggctatttggactcctttttggttccatatgagttttaaaatagttttttttctagttctgtgaagaatgtcattggtagtttggtaggaatagcattgaatctttaaattgctttgggcagtatggccattttaatgatattgattcttcctatctatgagcatgggatgttttcccatttgtttgtgtcttctctcatttctttgagcagggttttataattctcattgtagagttctttcacctccatggttagatgtattcttaggtattttattctttttgtggcaactgtgaatgggattgcctttatgatttggctctcggctttgctgttgctggtgtataggaatggtagtaatttttgtacagtgattttatatcctgcaactttgctgaagttgtttatcagctgaaggagcttttgggtctagattatggggttttctaggtatagaatcatgtcgtctgcagagatagcttgacttcttgtctttctatttggatgtcctttatttctttctcttgcctgattgctctggctatgacttctaatactatgttgaataggagtggtgagagagaacatccttgtcttgtgccagttttcaacaggaatgctcccagcttttacccattcagtataatgttgaccgtgggtttgcaatagatggctcttattattttgaggcatgttcctttaatatgtaatttattgagagtttttatcatgaaggggtgctgaattttatcaaaaaccttttctgcatctattgagataatcatgtatatcgcgttttctttatccatttatccattgatggacatttaggttgctttaatattgtgactattgtgaataatgcggcaatgaacatggaggtgcagacacctctttgaaacagtgatttcatttcctttggatatatgcccaaaagaaatgcttagctagactaaccaagaagaaagaaagatctcaatcaaattaataaaattataagtgaaagaacagactttacaattgataccagagaaatacaaaggatcataagagactgctataaacaattatacaacaacatattgaataactcagaagaaatggataaattcctagatacttacaacctaccaaaactgaatcatgaaaaattagaacatctgagcagagcaataataataaagtgattgattcactaaccaaactctccgaacaaagaaaagcataggaccacatggctttactggtaaatttgaccaataatttaaaggaggtccgggagtggtggctcacgcctgtaatcccagcactttgggagatgggtggatcacgaggttaggagatcgagaccatcctggctaacacggtgaaaccccatctctactacatgcaaaaaattagccaggcatggtggcaggagcctgtagtcccagctactcaggaggctgaggcaggagaatggcatgaacccgggaggcagagcttgcagtgggccaagatcacaccactgcactccagcctgggcaacagagcatcactccatctcaaataataataataataataataataataataataataataataacttaaaggagaattaatgccaagctttctcaaactccttcaaaaaatcgtagaggagggaaaacttccaaactcattttataaggccagcattaccctgacaacaaagcaagataagaacaaaacaagaagagaaaattacaggccaatatccctagtgaagatagatggaaaaatcctgaacaaaatacaaggaaactgaatttgacagcacattaaaaggatcatacactgtgatcaagttagatttttctctgagatacatgatggtatctcacatcaataaatgtgatacacaacatcaacagaataaaagataaaatcatataatcatgacaatagagaaaaagcatttgacaaaattcaatatctttttctgataataaattatgtgtagaaggaatgtacctcaacataataagggccatatatgacaatcccacaactgacatcatacttggtaatggaaaggtggaagcatttcctctaagatcaaaacaagacgaggatgtccactctcacaaattccattcaacatagtacgggaagccctagccagataaattgggcaataaaaagaaataaaaagacatctattggaaaggaagaagttgaattgtttttatctttttattttagacttttacagcaatagatttcctcctgagcactgcttccactgcatcccataaattttggaatgttatctttcatggtcatttatctctaggtattttcaaatttccttcgtgatttgttttccgatctggtggttaagactgtgtggcttaacttctacatatttgtgaattttcttttttgtctactgttatgatttttagcttcattccattttgaacatgttaggtctagttggtttatagtggtgttcaagtgctctgttttcttatctcctgtctagatgttctatgaagtattgaaagtggagtcttgaaatctccagctattattgtagaatggtctatttcacccatagatttgatctgtcaatatttggttcacatatttgggggctcctttgttttgtgtatatatatttataatggttatatcttcttaatatattaatatttttatcaatatgtaatgcccatcattttctcttatagtaaatgtaaacttggaatctatttggtctgatattagcatagttatccttttctcctttgatgactatttgcataggatcttttctttttttgagacatggccttgctatattgcccagggtggacataaactcctggctcaagcaatccttccacctcagcctcctgagtacctaggactacaggcgcctgccactgtactcagtagaatatatttttcttttcttttcttttttgacttatgttagtggttagcttttatttcattttatttttttcttcaacttttattttaagttcaggggtacatgtacagaatgtggaggtttttagcatgggtaaacgtgcgccatgttcgtttgctgcacacatcatcccatcacctaggtattaagcccaggatccattaactattcttacagatgctctcccttccccgacctcactcaacaggccccagtgtgtgttgttccccaccatgtgtccatgtgttctcattattcagctcccacttaaaagtgagaacatgtggtgtttggttttctgttcctgcattagtttgctgaggttaatggcttccaattccattcatgtccctgcaaaagacattatctctttcctttttatggctgcatagtattccatggtgtatgcgtaccatattttctttacctagtctatcactgatgggcatttaggttgatttcatgtctttgctattgtatatagtgctgcagtgaacatacacatgcatgtatctttataatagaatgatttacattcctttgggtatatatctagtaatggaattgctgggccaaatggtatttctgcctccaggtctttcaagaattgccactctgtcttccacaatggttgaaataatttaccctcccaccaacagtataaaagtgttcctttttctctgcaacctcgccagcatctgtttttttctttaaatttcaataggtttttgggggaacaggtggtgtttggtttcatgaataagttcttcagtggtgattactgagattttggtgcacccatcacgtaagcagtgtacactatacccaatgtgtagtcttttatccctcaccacccctaccctttcccccaagtccccaaagtccagtgtatcattcttaggcctttgtgtactcatagcttagctctcccatatgagtgagaacaaacgatgtttggttttccattcctgagttatttcacttagaataatagtctccaattccatccaggttgctgcgaatgccattatatctttcctttttatggttgagtagtattccatggtatatatctaccacattttctttatccactcgttgattgatgggcatttgggctggttccatatttttacaatcgcaaattgtgctactataaacacgtgtgtgaaagtatctttttggtataatggcttcttttcctctgagtaaatacctagtagtgggattgctggatcaaacagtagaactacttttagttccttaaggaatctccacactgttttccatgtggttgtactagttgacattcctaccaacagtgtaaaaatgtttctttttcactacatccacttcaacatctgttattttttgagcctcttactgctcagcgttagggaagcccgagggcagaaaggaggagaatcgcagctgatgtaaagcactgtgaggtcaggcatgccaagacaagaaaacaattggtgtcaaaggtgggcacaaaaggtatctgatagagaaggtaatggagtaacctctgtagtgctctggggaaaaaaatggttgtagcccaagaattcccccagcacttgtcatttgagtgatggcaatggaaaggcgtgtgtattagatatcatcccctactttctactaaagcacgccttttatcctgtagatctttctctttttttttaacttttattttaagttacagggtacatatgcaggatgtgtaggtttgttacataggtaaacatgtgccatggtagtttgctgcacagatcaacccatcacatagatattaagctcagcatacactatctattcttcctgatgctctccctccccttacccaccccccaacaggaccctgtgtgtgttgttcccccccaccatgtgtccgtgtgtcctaatcattgagcccccacttataagtgagaacttgtggtgtttagtttcatgttcctgcattagtttgctgaggataatgacttccagctccatccatgtccctgcaaaggacatgatcttgttcctttttatggctgcataatattccatggtgtatatgtaccacattttctttatccagcctatcattgatgagcatttaggttgattccatgtatttgctattgtgaatagtgctgcagtgaacaaacatgtgtatgtatttttacaatggaattatttatgttcctttgggtatttacctggtagtgggacttgctgggtcaaacggtatttctggttctagatctttgaggaatcgtcactctgtcttccacaatgattgaactaatttatacgcccaccaacggtgtaaaagcactcctttttctctgcaacctcaccagcacaccagcatctgttgttttttgactttttaataacgccattctgactgatgtgggatggtgtctcgatgtggttttgatttgcatttctccaatgatcagtgatgttgagcttttcttcatgtgttttttggccacacaaatgtcttcttttgagaattgtcttttcatgtcctttgccctctttttaatggggttgtttgttttttttcttgtaaattattttaagttccttgtagattctggatattagactttggcaggtggacagattgcaaaattcttctcatattctgtagtttgtctgtttactccgatgatagcttcttttgctgtgcagaagctctttagtttaattagatcccatttgtcaatttttgcttttgtcgcaactgcttttggcgtttttgtcatgaaatcgttgcccgtgtctatgtcctgaatggtattacttagatcttactttagggtttttatagttttggactttacatttaagcccttaatccatattgagttaatttttgtataaggcataaggaaggggtccagtttcaattttctgcatatggctagccagttttcccaacaccatttattaaataagaagtccttttcccattgcttgtttttgtcaggtttgctgaagatcagatgcttgtaggtgtgcggtgtaatttctgagttctctattctgttccattggtctatgtgtttgtttttgcaacagtaccatgctgttttatactgtagctctgcagtatagtttgaagttgggtaacatgattcctccaggtttgttctttttgcttagattgtcttggatacttgggctcctttttggttccatatgaactttaaaacagtttcttctaattctttgaagaatgtcaatggtaatttaatgggaatagcattgaatctataaattactttgggcagtatgtccattttcaggatattgattctttctatccatgagcatggaatgtttttccatttgtttgtgtcctcccttatttccttgagcagtggtttgtagttctccttgaggaggtccctcacttcctttgttagccgaatttctggtattttttttttgtagtaattgtgaatgggagttcattcataatttggctctctgcttgcctgttattggtgtataggaatggtagcagtttttgctcattgattttgtatcctgagacttttctgaagtcgattatcagcttaaggagcttttgggctgaaacgatgctgttttctagatataggatcatgtcatacgcaaacaaagataatttgacttcctctttccctatttgagtaccctatatatctgtctcttgcctgattgacctgcccagaacttccaatgctatgtggaataagagtgcatataccacattttctttatccattaatccattcaatgaacgtttggatttcttccacctcttcactatggtgaatagtgctgcaatgaacacgggagtatgcatatttctttgagattttccttaaaattcctttggtatattgctaaaagtaggattgctggatcgtgcggtaaatcagttttcagtttcttgaggaacaattatactctgtctcttttttttattatgctttaagttttagggtgcatgtgcacaacgtgcagcttagttacatatgtatacatgtgccatgttggtgtactgccatttaacaccaggtatatctccaaatgctatccctccccactccccccaccccacaacaggccccagtgtgtgatattccccttcctgtgtccatgtgttctcattgttcaattcccacctatgagtgagaacatgcggtgtttggtattttgtccttgcgatagtagctgagaatgacggtttcagcttcatccatgtccctacaaaggacatgaactcatcattttttatggttgcatagtattccatggtgtatatgtgccacattttcttaatccagtctatcattgttggacatttgggttggttccaagtctttgctattgtggatagtgccgcaataaacatacgtgtgcatgtgtctttagagcagcatgatttatagtcctttgggtatatacccagtaatgggatggctgggtcaaatggtatttctagttctagatccctgaggaaccgccacaccgacttccacaatggttgaactagtttccagtcccaccaacagtgtaaaagtgttcctatttctccacatcctctccagcacctgttgtttcctggctttttaatgatcgccattctaactggtgtgagatggtatctcattgtggttttgatttgcatttctctgatggccagtgatgatgagcattttttcatgtgttttttggctgcataaatgtcttcctttgagaagtgtctgtttatatcctttgcccactttttgatggggttgtttgtttttttcttgtaaatatgtttgagttcattgtagattctggatattagccctttgtcagatgagtaggctgcaaaaattttcccccattctgtaggttgcctgttcactctgatggtggtttcttttgctgtgcagaagctctttagttgaattagatcccatttgtcagttttggcttttgttgccactgcttttggtgttttagacatgaagtccttggccatgcctatgtcctgaatggtaatgcctaggttttcttctagggtttttatggttttaggtctaacatgtaagtctttaatccatcttgaattaatttttgtataaggtgtaaggaacggattcagtttcagctttctacatatggctagccagttttcccagcaccatttattaaatagggaatcctttccccattgcttgtttttctcaggtttgtcaaataacagatagttgtagatgtgtggcattatttctgagggctctgttctgttccattggtctatatctctgcttcggtacgagtaccatgctgttttggttactgtagccttgtagtatagtttgaagtcaggtagcgtgatgcctccagctttgttcttttggcttgggattgacttggcaatgcgggctctttcttggttccatatgaacgttaaagtagtttttcccaattctgtgaagaaagtcactggtagcttgatggggatggcattgaatctataaattacattgggcagtatggccattttcatgatactgattcttcctacccatgagcatggaatgttcttccatttgtttgtatcctcttttatttccttgagcagtggtttgtagttttccttgaagaggtccttcacctcccttgtaagttggattcctaggtattttattctctttgaagccattgtgaatgggagttcactcatgatttggctctctgtttgactgttattgttgtataagaatgcttgtgatttttgcacattgattttgtatcctgagactttactgaagttgcttatcagtttaaggagattttgggttgagacgatggggttttctagatatacaatcatgtcatctgcaaacagagacaatttgacttcctcttttcctaattgaatgccctttacttccttctgcctgattgccctggccagaacttccaacactatgttgaataggagtggtgagagagggcatccctgtcttgtgccagttttcaaagggaatgcttccagtttttgtccattcagtatgatattggctctgggtttgtcatagatagctcttattattttgagatacatcccatcaatacctaatttattgagagtttttagcatgaaatgttgttgaattttgtcaaaggccttttctgcatctattgagataattatgtggtttctgtccttggttctgtttatatgctggattacatttattggtttgcgattgttgaaccagccttgcatcccagggatgaagcccacttgaccatgatggataagcttttggatgtgctgctggattcggtttgccagtattttattgaggatttttgcatcaatgttcatcaaggatattggtctaaaattctctttttgttgtgtctctgccaggctttggtgtctggatgatgctggcctcataaaatgagttagggaggattccctctttttctattgattggaatagtttcagaaggaatggtaccagttcctccttgtacctctggtagaattcggctgtgaatccgtctggttctggacattttttggttggtaatcaattaatgattgcctcaatttcagagcctgttattggtctattcagagattcaacttctttctggtttagtcttgggagagtgtatgtgtcgaggaatttatccatttcttcgagattttctagtttatttgtgtagaggtgtttacagtattctctgatggtagtttgtatttctatgggattggtggtgatgtcccctttatcattttttattgcatctatttgattcttctctcttttcttctttattagtcttgctagtggtctatcaattttgttgatcttttcaaaaaaccagctcctggattcattgattttttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtgccagagattctggtatgttgtgtcttttttctcattggtttcaaagaacatcttcatttctgccttcattttgttatgtacccagtagttattcaggagcaggttgttcagtttccatgtagttgagcggttttgagtgagtttcttaatcctgagttgtagtttgattgcactgtggtctgagagacagtttgttataatttctgttcttttacatttgctgaggagagctttacttccaactatgtggtcaattttggaataggtgtggtgtggtgctgaaaagaatgtatattctgttgatttaggggggagagttctgtagatgtctattaggtccgcttggtgcagagctgagttcaattcctggatatccttgttaactttctgtctcattgatctgtctaattttgacagtggggtgttaaagtctcccattattattgtctgggaatttaagtctctttctaggtctctaaggacttgctttatgaatctgggtgcttctgtattgggtgcatatatatttaggagagttagctcttcttgttgaattgatccctttaccattatgtaatggccttctttgtctcttttgatctttgttggtttaaagtctgttttatccgagactaggattgcaacccctgcctttttttgttttccatttgcttggtaggtctgcctccatccgtttattttgagcctatgtgtgtctctgcacatgagatggatttgctgaatacagcacactgatgggtcttgattctttatccaatttgccagtctttgccttttaattgtagcatttagcccatttacatttaaggttaatattcttatgtgtgaatttgatcctgtcattataatgttagctggttattttgctcgttagttgatgcagtttcttcctagcctcgatggtgtttacaatttggaatgtttttgcagtggctggtaccagtttttcctttccatgtttagtgcttccttcaggaactcttttagggcaggcctggtggtgacaaaatctctcagcatttgcttttctgtaaagtattttatttctccttcacttatgaagcttagtttggctggatatgaaattctgggttgagaattcttttctgtaataatgttgaatattggcccccactctcttctggcttgtagagtttctgctgagagatctgctgttagtctgatgggcttccctttgtgggtaacccgacctttctctctggctgcccttaacattttttccttcatttcaactttggtgaatctgacaattatgtatcttggagttgctcttctcgaggagtatctttgtggagttctttgtatttcctgaatttgaatgttggcctgccttgctagattgaggaagttctcctggataatatccttcggagtgttttccaatttggttgcattctccccatcactttcaggtacaccaatcagacgtagatttagtcttttcacatagtcccatattttttcgaggctttgttcatttctttttattcttttttctctaaacttctcttctcgcttcatttcattcatttgatcttccatcactgataccctttcttcaagttgatcgaattggctactgaggcttgtgcattcatcacgtagttcttgtgccatggttttcagctccatcaggtcttttaaggacttctctgcattggttattctagctagccattcgtctgattttttttcaaggtttttaacttctttgccatgggttggaacttcctcttttagcttggattagtttgatcatctgaagccttcttctctcaactcatcaaagtcattctccgtccagctttgttccgtggctggtgatgagctgtgttcctttggaggaggagaggcgctctgatttttagagtttccagtttttctgctctgtttttttcccatctttgtggttttatctaccattggtgtttgatgatggtgacgtacagatggggttttggtgtggatgtcctttctgtttgttagttttccttctaacagacaggatcctcaggtgcaagtctattggattttgctggaggtccaatgcagaccctgtttgtctgggtatcagcagcagaggctgcagaacagtggatattggtgagcagcaaattttgctgcctgattgttcctctggaagttttttctcagaggagtacttggccatgtgaggtgtcagtctgcccctactggggggtgcctcccagttaggctattcaggggtcagggacccacttgaggaggcagtctgtccgttctcagatcttcagctgcatgctgggagaaccactactctcttcaaagctgtcagacagggacatttaagtctgcagaggattctgctgccttttgtttggctatgccctgcccccagaggtggagtctatagagggctccacccagtttgagcttcctggccactttgtttacctactcaagcctgagcaatggcaggcgcccctcccccagcctcgcttatgccttgcagtttgatctcagactgctgtgctagaaatgagcaaggctccgtgggcataggaccctccgagccacacatgggatataatctcctggtgtgccgtttgctaagactgttggaaaagcacagtattagggtgggagtgacccaattttccaggtgccatctgtcacccctttctttgactaggaaacgaaattccctgaccccttgctcatcccaggtgagacaacacctcgctctgcttcagctcatgctcagtgcactgcacccactgtcctgcacccactttccaacactccccagtgagatgaacccagtacctcagttggaaatgcagaaatcacccgtcttctgcgtcgctcatgctgggagctgtagacgggagctattcctattcggccgtcttggctccaccccccccaaactgtgtttcatattgcttgcacatttaacatttccactaactgtgcacaaggttccaaattctccacatccttgacaacacttgttatttttgtttttgatatttgccatcctaatgaatgtgaagtgatatgtagatttaatttgcatttccttaatgattagtaatgttcagcttcttttcgtagactttttggccatttgattagttttgcaaaaaggtctattcaagtcctttttccgtttttaaaattttattttagattcagggggtacttgtgcaggtttgttaaatgggtagattgtatgatgctgaggttgggcttctaatgttcctgtcccccaagtagtaaaccctgtattcaatagatggtttttcagcccttttccccctactttcttcccccttttaaaatccccattgtttagtgttcctgtctttgtgcccatgtgtactcaatatttagctcctgcttataagtgagaacatgtggtatttagttttctgtttctgtgttaattcacttaggataatggtctccagttgcaactatgttcctgcaaaggacatgatttcattctttttttatggctgtgtggtattccatggtgtatatgtactatatttcctttatctaatccaccactgatggacacctaggttgattccaggtctttgctgttgtgaatagtgtggtgatgaacatatgagttcatgtgtctttttaatataatgatctattttcctatggatatgtagctctgttttaagttctttgaaaaatcttcagactactttccacagtggctggacagatttacatgcccaccaatagtatacaagttttcccttttctctgcaacctcaacaaaatctcttattttccaactttttagtaataaccattttgactggtgtgagatgatgtctcattgtagttttgatttgtatctttctgattattactgctgagcattttttcatatgttttttggctgcttttttgtcttcttttgagagatttttgttcatgtactttgctcgtttcttaatgatgttatttgttttactctttttgatttgttcaagttccttatagattctggatggtagtcctttgtcagatgcatagtttgcaaatattttcttcattccattctataggttgtcagtatactctgttgatagtttcttttgctgtggagaagctatttaatttaattagatctcatttgtcaatttttgttttatttgcatttgcttttgagaacttagtcataaattctttgcctaggccgatgtctagaagggtatttcccagggtttcttctaggacttttatagtttaaggtcttgcatttaagtctttaatccatcttaagttaagtatggtgagagatagtggtcccggttcattgttctgtacgtggttagccagtttttccagctccattttttgaatggcatgttctttcctcactgtttttttttttgattttgccaaagatcagttggttttaggtgtgtggctttatttcagaggtctctattctgttccatcggtctatgtgcctgtttttgtaccagtactttactgttttggttagtattgcctatagtatagtttgaagttcggtaatgtgatgcctccatctttgttctttttgcttaggattgccttggctattcaggctcttttgtggttctatatgaattttagaatagttttattctaatcctgtgaaaaatcacattgataatttggtaggaataacattgaatctatagattgctttgctttgcctatttttaaatggggttatttgtttttgttgttgagctgaaaaagttctttatacattctggatattaaccctgtatcagattacgatttgaaaatattttcttgcattccatacattgcctttccattctattgattgtatcctttgatttacagaagttttgaagttgtatgtagtctcaattgtttatttttgcttttgttacctgtgcttttgttgtcatatgtaagaaatcgttaccaaatccagtgtcatgaagactttttccctatgtttttgataaggtttgcctgtgtccccactcaaatctcatcctgaattgtagtttccataatccctgtgtgtcatgggagggactcagtgggaggtaattgaatcatggggtcggttaacttcatgctgttctcatgatagtgagtcagtttgcaggagatctgatggttttataagaggcttttaccccttttgcttggcatttctccttcctgagaaactttctgattgtaagtttcctgaggccttcccagccatgctgaactgtgagtcaattaaaccactttcctttttaaattacccagtctcaggtatgtctttattagcagtgtgggaagagactaatacaattttcttctaagagtttatagttttaggtcttatgtttaggtctttaatccatttttagttaatttttgtatatggcttaaggttaggattccactttaacctttttctgcttaagagaagcggtttcactttgtcacccacactggagtacagtggcctaatcaaagctcattgcagccttgaactcttattcttaagcaatcgtcccatctcagcctctcaagtagctgggattacaggtggaagctgccacatctggcccattttattcttttgcatgtaggttctcagttttatcaacagtgtttgttgaaaagactgttctttttttttcactatgtggtcttggcactcttgttgaaaatcatttggccatatacacaagagtttatttatgggctctatattctgttccattggcctatatgtctgtctttgaaccagtaccacaatgttttgattactgtagcatttttgtgtattttaaaatcaggaaaagtgagaccttcaactttgctcttctttttcaagattgttttggctattcagggtccttgaaatttcatatgaattttaagatggtttttcctatttctgtaaaaaatgtcactaggattttgatagggattgcactacatctatagattgctttgggtagtatgaagttgaaacaatattaagtcttctaatccaaaaacacaggattctttttttccatttacgtgttatctttgatttctttgagcaatgttttttagttttcagtgtgtaagtccttcaccttggttaagtttgtccctaagtgttttattatttttgaggctattgtaaattgtattgttttcttaattatctttttgtactgttcactgttagtagtacataggaaaaaaaaccttcttttttgtgatgattttgaaccttgcaactttgctaaatttatgtattaattatagcagtttttaaaaagaatacttggggttttctacatataagattattctaagtgaagtaactcaggaatggaaaaccaaatgccatatgttctcacttataactgggagctatgctgtgcatatgtaaaggcatacagagtggtataatggactttggagactcagaagagggagcatgggagggggtgaggggtaaaaacaactacatgttgggtacagtgttcaccacttgggtgataagtgcactaaaatctcagacttcaccactatacaattcatacatctaataaaaaaccacttggactccaaaagctattgaaataaaaaatattttaaaaagattatgtcatatgaacagacataattttacttcttcctttccagttttgacccttattatttattttttgtagtaggattattttattggccatattcactgatggactctcctattgaactgaataatctttaaacacattatatgtatcccctcagacaacaacaatggtgacattttcatatattattattttttattatagtttaagttctggggaacatgtgcagaatgtgcagttttgttacataggtatacacgtgccatggtggtttgctgctcccatcaacccatcacctacattaggtatttctcctaatgttatccctcccctagcccctgaccccccaacaggccccggtgtgtgatgttcccctccctatgtccatgtgttctcagttcaactcccacttatgaatgaaaacatgcagtgtttgattttctgttcttgtgatagtttgctgagaatgatggtttccagcttcatccatgtccctgcaaaggacattaactcatcctcttttatggctgcaaagcattccatggtgtatatgtgccacattttcttaatccagtctatcattgatggacatttgggttggttccaagtctttgctattgtgaatcatgccacaacaaacatacatgtgcatgtgtctttatagaagactgatttataatcttttgggtatatacccagtaatgggattgctggttcaaatggtatttctagttctagatccttgatgaatcgccacactgtcattgaactaatttacactcccacccacagtgtaaaagcgttcctatttctccacatcctctccagcatctgttgtttcctgactttttaatgattgccattctaactggcgtgagatggtatctcattgtggttttgatttgcatttctctaatgaccagtgatgataagcatttttcacatgtgtcttggctgcataaatgtcttcttttgaaaattttaaaattctatgtgtcatgagtccagtacagtcttagaacacaggcattattttattcctgcactgtgtttatgggacttggctaacaaatagatgggacatcatatccctctttaaaacatggaaggataatgtgaaaaggtagaaaaatatataggtgtcttcttcttccaaaattattcgtctaacagatgaaatgctaatagatgaaactgttgatccaagagaagaatgagagcttcacacccctaaatcacgaaatagtatggaattgttaacccattccctggattcctctcttccacatcttctaattcagtcctttcaaagtgcagctcttgtcttgtctttttcttgacaattttcttttaattaagtttaatttataaatggaacccatgttacatagccttcttgggaacagagtatcacaagtcacctggaataatcatgcaaagctcaagtctagaaatctagaatttgttggattctagaataagatatttccaaagagtgaacaggcataggggtcatggctttttaaaattacttcttaaagatgcattgagaaattatagacaaatgaaaatggtgtatattcaaggtatgcaatgtgatgcttcgatatacattgtaaaataattaacacaatcacactaacttattcatctccttacacagttaccgtgtgtgtgtgtatgtgtgtgtgtatacagtaagaatagctaaaatctagtctcttagcatatttcaagtatacaatatagtattattaattattgtcaccatggtgtacattgagtctccagaacttattcatctcataactggaagtttgtactcttgacaaacatttccccatttttcccacctctgaccaccagtaacaacccttctactcttttcctatgagttcaacttttttagatttcttgcatataagagaaatcgtacagtatttgctttctgtgtctggctcttttcgtctaggataatgttctccaggttcatccatgctgtcacaaatggtagaattaaggctaaattgtgtgtgtgcgtgtgtgtgtgtgtgtaaaactcattttctttacccattgatggaaacttgggttgtttgaatattttgactattgtgaatattgctgcaatgaacatgaaagtgctgatatctctttgaaacagtggttttatttcctttggatgtatacccagaagtgtaattgctggattatatggtagatctatttttaattattttaagaacctccatactgttttctctaatggctgtagcaaattatatttgcagtaacagtgtacaagggttgctttttctcaactcccttgccaacactttttatctcttgacattttgatagtagtcatgctaacagatatgaagtgacatttcatttgattttaattttcattcccttgggtaggagctgtaaaagtgaggctgcttgacgcatgcacaaactccttctagggagaatttgcagacctgaattaatcactggagtgagccaggggagatggcatggaaagtgcccacattctcattcaggctcccaaaggcctactgtttatctgccccatcagctcctggaatcaggttagtcagacatccaatcctctaacagcaactggaaaagtgtatagacaaataccaggaagaaactgggagcttgaagcttttgtcagttttctcttttttgagtacagaggtgaagaaaggggtaggatagtcactgaacctgctcacacacccgtttaaaactgtctctttgttctctgtggtctggggagatctggtaatgccaagtcttttctgcttccagagctgggtgatttaggacccaaacactgtgaggagagcagtaaaagttgaaatgctctatgtgtggtccaaagctttcactctttagggagaagttgggagttagggatttcttcctgattgtaaggtgctgtgcttgtgatgggatttgtgcatgaatatatcttagcctttcctacctaattggaagtgaatattttctcagctgcctggagtacaggagtcaggatttctggatttctctcagaggaaattgatccatgtgtagaacttatttggtgcatctgtggtaggaaggaaagcaggagcctcctattcttccatcttcctgatgtcacttccctaatttccttttcttgtagtgtccttgtctggctttgatatatcactgctgctgcctcacaacaagtttgaaagagttctctcctcttaacatttgtataagagttcaagaaggacttttattatttcttctctaaatggttggtagaattcacctaagaagacatgtccttggctttttaataatgggagatttttgagtactgattcaatctctttacaattactatctactattactattgttattactttactattactattattgctctgtggttttttatttcttcatgattcaacttgatagattgtatgcttttagaacgttatccacgtcttctaggttatccaatgttttggcatataattgttcatagtagcctcttataatccgttatatttctgtgctattagttgtaatgttcctctttcattttttattttattaacttgtgtctttttctttgttagtctagctaagggtttgtcaaatatttaattttttcagaaaaccaacaactaaagttttatttttatggtgttttttagtctctattatacttatttatgttctgatctgtgttatttcctttcttttactaactttggactttgttttctttttctagatccttgaggtataacattactttttttatttgaattctttcttccttttaaatgtaggtatttatcactgtaaatatccttcatagaactgcttttgctgcattccacgagttttggtatactgtgttttcattttcatttgtctcaagatactttttaatttctcctttgatttattctttgattattggttattctggagcctgttgtttaattttcacatatttgtgacattttcagtttttttcctgttactaatttctggtttcatcctgtcgtagttggaaaagatacttgatatgattgcaatcttcttgaattgttaagacatgttttatggcacaacctattatcctggagaatgttctatatgcccttgagaaaaatatgtattctactgctgttggatataatgttctgtatgtgttcgttagatccatttgatctaaaatacagttcaagttcaagatttccttactgattttctgtctggatgaactatccaatgttgcaagtttggtattgaagtcctttactattattgtattgcgcctatttctccctcagttctgttaacatttgcctaaatatttaagtgctctaatattgagtgcatatgtatttacaattgttatatcctcttgatgtattggcccttttatcattacatagtggtgttctttctctcttctgatagatttttactgaaagtctattttgtctgttataagatagctactcctgctctctcatagtttcaacttgcctggaatatttttaccgtctattcacttcagtccatgtgtgtttttaaagcttaagtaagtctcttgtaaacagcacagtgttttgtcttgtcttattattatttttttcattcattcagctgctctatatcttttgaaatggaataaacccactgatcagaaggtctgtacattctgatgaatggactttcttttttttgagacagagtttcgctctggttgcccatgctggagtgcaatggagtgatcttagctcatccgggttcaagcgattctcctgcctcagcctcccgagtagctgggattacaggcatgtgccaccatgcccagctaattttgtgtttttagtagagatggggtttctccatgttggtcaggctgttctcaaattcccgacctcaggtgatccacctgcctcggcatcccaaagtgctgggattacaggcatgagccaccatgcctggccgatgagtggatttttataaaaacagaatccagtgatatgcttagtacaagagatttactttatatttaatatgaaagaaaattaaatttctgtaccccaaacccactataccaatgagaaagttaagcttggaaacttagtcatgcaaaaaaacgtcctcttttagttcccacatagctgtaaatttcacatgattactttatcttacatagaatatggatctacccagcacaagatgaatgcatagtctttcccccgcactcttctcttttcagaggtaaaatgtggattcagtgagtgctattcaaagcctcacaagaatgtaacactgccctcacctcttacacctccattttccccctcctttccctcctgcctgctctttccccgttaaatattgcagtcctcaaacactctttggacaaagcacaggctacacatcctactgtgacttgtgtgctttttcctaggtgtgtcctcaaccttggcaaaataaaactctaaatcgattgagatctgtctcaaatactttttggtttacagttggcaacccctaagggattttgaatggagtttggtcctttggcttgcagcaattctcctagcaaggatctggtaccagctggaagctctttattgctctgactgattgaactatttgctgaaatatgggagcttctctctccagagatccctgatctcccaattttttttggttgaattttgagttgtattctgttgtagaactcatttccttggagttttcttcttttgtgcaggtgaaaatcagtcttcacattggcctccatcttcaagtaagaagctggtttggggtttcatttggggatttgatagctgaaggtcaaggtttattgtcagctggctataacttttatgctcagagatctcaactgtatgtaaattgtgtgatcactttttttctgtttttttttttgtttgtttgtttgtttcagttcatcttccactagatttgaccaactcctggccccctctactgttgactgaaattagaaagtcaaaattccatctctaaatagaaaactggccagttaagaaagttaaaaaatttgactacctgaaaagttttgcccacataacaaggccaccttttactaacttttgctaaccaagtcttttcctttcttcttccaataacctgtcttgccactaaaactatttttttgtttttgtttttttgtgtgtgtttttttacataccttgaaactgcatgctttctttcatttcaatatggtatatgagcttctgttatttattgggaaattgggccttcattctgaaggttcctatgaatatatattaaataaatttctatgccttttctccaattaatcaattgcctcattccagtgatttttcagtgaacctttgggcacaagcagtcatgacccccacagtttggtgcagcaagcaaggtgactaaagctgctcttctcctctggaacccatggtgaagggaacccaggaaactgatctgccaacaaagggggaagactttctttttttatttattttattttattattattatactttaagttttagggtacatgtgcacaatgcgcaggttagctacatatgtgtacatgtgccatgttggtgtgctgcacccattaactcgtcatttaacattaggtatatctcctaatgctatccctccccccttcccccaccccacaacagtccccggtgtgtgatgttccccttcctgtgcccatgtgttctcattgttcaattcccacctatgagtaagaacatgcagtgtttggttttttgtccttgcgatagtttactgagaatgatgatttccaatttcatccatgtccctacaaaggacatgaattcatcattttttatggctgcatagtattccatggtgtatatgtgacacattttcttaatccaatctatcattgtcagacatttgggttggttccaagtttttgctattgtgaatagtgccgcaataaacatacatgtgcatgtgtccttatagcagcatgatttatagtcctttgggtatatacccagtaaggggatggctggttcaaatggtatttcaagttctagatccctgaggaatcgccacactgacttccacaatggttgaactggtttccagtcccaccaacagtgtaaaagtgttcctgtttctccacatcctctccagcacctgttgtttcctgactttttaatgattgccattctaactggtgtgaaatggtatctcattgtggttttgatttgcatttctctgatggcctgtgatgttgaacattttttcatgtgttttttggctgcataaatgtcttcttttaagaagtgtctgttcatgtcctttgctcactttttgatggggttgtttgtttttttcttgtaaatttgttggagttcattgtagattctggatattagccctttgtcagatgagtagactgcaaaaattttctcccattttgtaggttgcctgttcactctggtggtagtttcttttgctgtgcagaagctctttagtttaattagatcccatttgtcaattttggcttttgttgccattgcttttggtgttttagacatgaagtccttgcttgtgcctatgtcctgaatggtaatgcctaggttttcttctagggttttcatggttctaggtctaacatttaagtctttaatccatcttgaattaatttctgtataaggtgtaaggaagggatccagtttcagctttctacatatggctagccagttttcccagcaccatttattaaatagggaatcctttcctcattgcttgtttttgtcaggtttgtcacagatcagatagttgtagatatgtggcgttatttctgagggctgtgttctgttccattgatctatatctctgttttggtaccagtaccatgctgttttggttactgtaggcttgtagtgtagtttgaagtcaggtagcatgatgcctccagctttgttcttttggcttaggattgacttggcgatgcgggctcttttttgattccatatgaactttaaagtagttttttccaattctgtgaagaaagtcattggtagcttgatggggatggcattgaatctataaattaccttgggcagtatggtcattttcatgatattgattcttcctacccatgagcatggaatgttcttccatttctttgtatcctcttttatttcattgagcagtggtttgtagttctccttgaagaggtccctcacatcccttgtaagctggattcctaggtattttattctctttgaagcaattgtgaatgggagttcactcatgatttggctctctgtttgtctgttattggtatataagaatttttgtgatttttgtacattgattttgtatcctgagactttgctgaagttgcttatcagcttaaggagattttgggctgagacaatgggattttctagatatacaatcatgtcatctgcaaatagggacaatttgacttcctcttttcctaattgaatacactttatttccttctcctgcctaattgccaaagggggaagactttcttaccagctaggctcctggcctctctctctgaactccaggtgaatggatggtaaaatcgtctcgtctgcaaagttttaatttttaaaaaaggatttttgtgactagccttggtatagtgactctggtgtatttttggtactttgtgctatgaatattcactattggaataaagtatattattgaaaattctgattgtcaatggccaaaagataaagattttagagatatcttattctaaacaattgatgagaaaattaaatttaaaaaggacacatagtagtgtcatgagacctcactaaattgaaaagcaaaaaaaaaaaaaaaattatttttgacttgaaagaaagttagaatcctttccaagctcaaaactgcctgctctagatttcttcttggaataacagtagagacttccccatgctgtagtttagtagctaaggttttgccctttcaccatagcagcctgtgttcagttcccagccagggaatgagtcttttttcatttgatatttgcaagaattttgccacttattgatccctttccctttgatggactgcttatgatttcctgtcttgaattttaccttctctaaggtatcttttgggtgattctggatcttgaaaaacctacttgccaccgctttggagacatctcatgcatctctggttaagtcataatcttggttaaggcacttgggaggatacctttggtaaagaacttcaaaagccaaaaatattggctgtttatcctggctaaaatctgataataagagatttaaaatggttgttttaaaaagaactctatggttaaaagtcagtttaattaaaagctgatatccaagctatatattaaatatttaaaggcctttatgccttttctttttatggatcctgatttggggaattttttttttccagctgactgaagtcttttttaaaatccttttgtaaaataaatttacattttaagaaaaatttctatttgtaagggagtctgcctgtgtacattaaaaccacttaccattgctgggaaaactggctagccatatgtagaaagctgaaactggatcccttccttacaccttatacaaaaattaattcaagatggattaacgacttaaatgttagacctaaaaccataaaaaccctagaagaaaacctaagcaataccattcaggactcaggcatgggtaaggacttcatgtttaaacaccaaaagcaatggcaacaaaagccaaaattgacaaatttgatctaattaaactaaagagcttctacacagcaaaagaaactaccatcagagtgaacaggcaacctacaaaatgggagaaactttttgcaatctacccatctgacacagggctaatatccagaatctgcagattactcaaacaaatttacaagaaaaaaacaaacaacccatcaacaagtgggcaaaggatatgaacagacacctctcaaaagaagacatttatgcagccaacagccacatgaaaaaatgctcatcatcactggccatcagagaaatgcaaatcacaaccacaatgagataccatctcataccagttagaatggcgatcattaaaaagtcaggaaacaaaagatgctggagaggatgtggagaaacaggaacacttttacgctgttggtgggactggaaaccagttcaaccattgtggaagtcagtgtggcgattcctcagggatctagaacttgaaataccatttgacccagccatcccattactgggtatatacccaaaggactataaatcatgctgctataaagacacatgaacacatatgtttattgaggcactattcacaatagcaaagacttggaaccaactcaagtgtccatcaatgatagactggattaagaaaatgtggcacattaggctgggcacggtggctcatgcctgtaatctcagcactttggaaggccgaggcgggcagttcatgaggtcaggagatcgagaccatcctggctaacatggtgaaaccccgtctctactaaaaatacaaaaaattagctgggcatagtggcaggcacctgtagtcccagctactcgggaggctgtggcaggagaatggcatgaacccgggaggtggagcttgcagtgagccgagatggcaccactgcactccagcctgggtgaaagagcaagactccgtctcagaaaaaaaaaagaaagaaaatgtggcacacatacaccatggaatactatgcagccataaaaaaggatgagttcatgtcctttgtagggacatggatgaagctggaaaccatcattctcagcaaactatcacaaggacaaaaaaaccaaacactgcatgttctcactcataggtgggaattgaacaatgagaacacttggacacaggaaggggaacgtcacacaccggggcctgttgtggggtggggtgagggggagggatagcattagaaggtatacctaatgtaaatgacgagttaatgcgtgcagcacaccaacatggcacatgtatacatatgtaacaaacctgctgtgcacatgtaccctagaacttaaagtgtaataaaaaaaaataaaataaaataaaaaataaaacctctcaccattgctttaaatttatgtcatatgcttgttgaagcacttttcctatcttatctgcaatttacttaccctggtttttgccctgggtttgagcaaataacgatacaatattaagaataacttcttagttctgaactttgacttgtaaattctctatcttatttcatctaggagttgtccctttagaaatgcaaatttaaggtgtcatggctaacaattgcctagaacaatgaaacagttaattaaaagagattgagcatctaaagcgggggaggggaactttaaaaactagcaaatgaaaaatcttataaatctataaaatctgtttctgtctatatgtcttcatgtctatgtgtttatacatgtcatgtgtttgtgatgtttcactaccaaaatatctaaaaagctctaattaataggcttatagacaaaagtaagtgctcaaatatttcatcagaaaaataaaaactttatttgaacaccttttcgttcttgtgactgtaataacctttagtaagtaaagctaatttaaattattggtaaaatagaatgaaaatgtcttcaaaatttaatttaatgatttgatctgatctggtcaggcaggtcagatactgtctttgttagatattttaaggtcataaactgcttctgtgacattttaaataattgtttgagttgtctatcttatagtaagccctggggaaatgtgaagttctccctggcccaactatgctacttgactatgttgggaagggttagacattatctgcaactccgtcttttgtcctgggttctgcatctgatacataattaaaattgcttacgtcctaggttgttcactaaaaaggagttgcttagagtaatacactaattactatatatgattaaaatgactagtataagagaaacatttctatatagagagtacataaggaaattaggatgtgtttggaaaaaggggttatagaaagtcatggaaatatgttctttgctaaagggaaagtaattttgtctagtttagaggttttaacgatgagtttgtttatgtgattttattaaaattagctttactgttaatacattatgcaaagataaaacttgattttctcttttgaacaaggttttcatgtaatattaagagatagtaaagatttttgtttgtgttttgagtaaactgcaaaaaagaggggagagaggacagatttagttgcccttttactgtctttcttaggtctcattatttgagaaattgagtttcctctctatcaaataataaaagtttttgctttttaaaaatctttaaattattactttggctaaaagaatattttgcagtgacctgtgatcctattttgtgatatcaaatgttttaaacctttgatatttaataaacattccaaaatcaagtctaaattcagtctttttgacttcattaactcttttaaatgttagattgtctgaattccaaagaagacatatttggcttatttgataggttaaaatcatacaggaagcatcgtcaaatatgaaatgtttagctttccttgggttctatttatataagcttgtaattaatatatgttccaaaactgtatgagattcctgtaattctggtatgtcttagtatatgttaccagtaatagttataattattatgttaaattgttgtatgccacagggaaaaaaaaacaaattttcatgtcagttgtgtctttaaccatgactgtcctaagattttggtcatcacaattattattttacttttattcttctaaaaaaaaggctgtttataaaaaagctgcagccccaaacgtgcttttttaggggaattcatgaaaaggactctgacaggtgttcttgaatgcaggtttctgataactttggagactgtgccatagtactagcaaataaaacagaaacaaaaacttccaagactctaattaaaagtctgatatgttcatgagtattgctaacccaatatcaagtggaatgacttaattacatgggactgaacaaacagaagactgaaataatttttatgaccattttttttgaaacattgctaaatatttctgatgtttttcagagtcaagaaaactaaccttttgagctacttatagcttttcttttaacaattgagtaaagtatactcttgtgagcaaaatttgaagcatatttctatttctttctctctacctgatttcttcagaattcggaaaccgtttgtgcatcttcttaatttctggcaatatagttatttgcataaattcaacaagaatctatttccttttataacagaacaccattggagatactggttattttaccaaggccttgactgaaatggtatatattcagatgtggagcagactgctttgaaaaatagaagttgacttatagagctgataaaagcaccttggaaaacctggccttgtaccttgtctatgtggttcctttacagggttcctgacctgtggaaagtaaatatgtcactttctgacagacccaggaaccccaagttatcttggtaccacaagaagagaagaattcactcaattcattcaagtatctacagacacagatgaatccttggctgggttcaggaggcttttgaaaagtcaaatctgagattccttatttttaagaaagttccagcaaagccaatttaaagaaagcctatgtggaaaatacttattcttgttgcattttatgcaaataatcaggccaagtataataagactgcaacttattttgcaaacaaattgattccattatgatttgtctttaataaaaatgaggaagtgaagagagaaaaatcacgtttcaaaagaaactatagtacacctcttattagattcaagccttggcctttgttttccacttttattatttgtctatggtttaactagattgaatcctgaattccttacaggctataagtctccaaactgttttcaattttttttctctcccatttttctgacttggaatcactggaaattaaaactatgcttttcttaaagctctgtaggctgaagctagacaacttaaactttgggagaaataacagcaacttatttatatacataaaccacttttttgcctgcctaatgatgtatggactttgcaatatagcctaaatcagttttccagggttgctttcccctttattgctataatctggatttggtcctttttttctccacctttcttcctcctgctatttctctccatgggatgtgagacttcacaactttctagaatgaggcttcctaacaacatgggacctaccatcctaggaataaaccatcctagcaatgaaggatcagaccaaacccattaccggagactcattttcttctacaatgctttctccaaaagattttgaagaacaagggggaaacatgaaaggaaaataaaatctcaggacccaaactcactatgccaaagagaaagttaagcttgggaactgagtcatgcaaaaatcgcaaaaatctgccttcctttttgttcccaggtaactgtaaatttcacatggttactttatcttacatcaagtgtaatgtatgcagcacaagacgaatgcataattgactgtccccactcctctcttttcacatgtaaaatgtgaattcagtgagcacaaatcaaagcctcacaagaatgcaacacttggttcaccacctaccccactttttctttctttgtttcccttccttttcctcctgcccactctttcccctttaaatactgaagtgctcaaaatcctctttggagaaagcacaggctacagatcttgctataactcgtgtttctttttcctgggcacatcctcaactttggcaaaagaaacctctaaattgattgagatttgtctcagacactttttggtttacattaaaggcattcatgggctgaaagtgctgagatagaaaaagacatttcatgcaaacagtaattgaaataggcagtagtggctatacttgtatcagacaaaatagattttaagtctaaaactttttgtacagacaaaaaagtcattgtagaatgatgaaaaggtcaattcaaccaaaagatctattgtaaatatataaacatccaatatgagaacacctaaatatataaaggaaatatggacagatctgaagacagaaattcacaggaataaattaatagtaggggacttctatattccattttggaatggatatccagtcagaaaaatcagtaaagaaagaactgacttgaacaacactacagatcaaagccaaaagacgtaagccaaactttccgttcaacagcagaagaatacacattattttcaagtgcacgtggaacattctaccaaatagatcacatttaggttgcaaaacaagtcttaacaaatgcaagaaaatcaaaatcatttcaagtatcttttttggtcacagtggaatctagaaatcaataacagcaagaaaaccagaaaatatacaggtgtggaacctaaacaacatgctcttaaacaatcattgtgtcaaagaggaaatcaaaacgtatctcaagacaaactaaaatgaaagcagaacataccaaaactttttagatgcagctaaagcagtactgaaagggtggtttataccaataaattcctacacgaagaaagaataaagctccccaaaatacaaactaactttccaactcagggaactagaaaatgaacaacaaactaagtctaaagttagcagaaagaggaaataataaaattagaactgaaataaatcaagcggaggatttttaaaaataaaaaactcaacaaaaccaagagtttgttttttgaaaagatgaacaaactcaacaaacctttagttgtactaattaataaaagagagaagactaaaattttaaaaaatcgtaactgaaagaggagacattgcagctgatgccttatgctatggtttgaatgtttgcgtctccttgtaatagtcaggtttctccagaggggcagaaacaatagtatatatgtgaaagagaatttattagggggaattggatcacacaatcagaaaggtaaagtctcataataggccatctgcaagctgaaggaccagagaagcttgtcatgtggctcccagagaagccagtagcctggctcagtacaagtctgaaagcctcaaaaccagggaagccaccagtgcaatcaccagtctgaggccaaagacctgagagcccatgtgaggccactagagcaagtctgaatctaaaagcaggagaaccaggagtctgatgtccaagggcaagagaagaacaaaggcctcctgctctggaaaggagagagagaagaagccagagcaaactgaatatccccatttctgcctgctttgtcctagacaagcccctagtcaatcagatgatgcctgcctacattagggtgggtttttctctctcagtccactgtctcatatgtcagtttccttgggaaacgtcctcacatatacacccatctgcaatgcttcactagccacgtaggcatctctcaattcaatcaatcaagttgacacataacgttaaccatcatacccttccaaaattcatgaaaattagtctttaattcgatagtattagaaggggcctttaggaggtgatcaggtcatgaaggctcctatctcatgaatgggattaaaactgctgtatagaaggcttcacacagcttttgactctttttacccttctgtcccttctgccgtgtgagactgcattattcatttcccaggaggatgtagcaatgaggcaccatcttggaagcagagagcagccctcaccagacgctgaacctaccattgccttgacgttagacttctcagcctccagaagtatgagaaataaatttccattctttataaattacctagtctcagatattttgttacaggagcacaaatagattaagacacctcagtatcaaatggatcataagagattattatgaacaattatatgccaacaaacgggataacctagaagaaatggataaattcctagaaacattataaaaaaaagaaagcccataccaataaaaaataagaaaatttaatccgtaaccagaactatcccagcaaacaaaaccaaggaccaagtaattcacagctgaattctatcaaactgtcaaagaagaattaatacctatctttctaaaagtcttcccaaagatagaagagggaacatttccaaactcatcatagaaggccagtatcagcctgatacccaaaacagacaaagacactacaagaaaactatagtctgatatacctgatgaacatatatgcaaaattattcaataaaatactagaaaactgaatacaaaaacattttaaaaggaacatatcccagttgaataaattccaagtggaatttattcctcagatgtaagaatagttcaatatacacaagtaattcattgtgatacaacgcattaagaaaatgaaagaaaaaatccacatgatcatctgaatagatgcataaaatccatttgacaaagttcaacatccattcatgattaaaactctcaacaaaataggtacacaagcaatttacctcaatacaataaaggatatatatgaaaatcccatagctaacacaataaatgaggaaaaattaaaagctttcactctaagatccagtacaaagcaaggatgcccacgcttgtcacttatttttatttttgtattttattatactttaagtcctggggtacatgtgcagaatggaacgtgcagttttgttacataggtatacatgtgccatggggtttgctgcacccatcaacccatcacctacattaggtatttctcctaatgctatcccttccctagccctccacccccaataggccccactgtgtgatgttcccctccctgtgtccttgtgttctcattgttcaactcccagttatgagtgagtacatgtggtgtttggacttctgctcttgtgttagtttgctgaaaatgatggtttccagcttcatccatgtccctgcaaaggacattaactcatcctttttatggctgcataatatttcatggcatatatgtgccacattttctttatccagtctatcattgatggacatttgggttggttccaagtttttgctattgtgaattatgccacaataaacatatgtgtgcatgtgtctttatagtagactgatttataatcctttgggtatatacccagtaatgggattgcatggtcaaatggttatttctaggtctagatacttgaggaatcaccacactgtcttccacaatggttgaactaattcacactcccaccaacagtgtaaaagcgttcctatttctccacatcctctccagcatctgctgtttcctgagattttaatgattgccattctaagtggtgtgagatgttatctcattgtggttttgatttgtatttctccagtgatgaacacttttccatttgtctgttggctgcaaaaatgtcttcttttgagaagtgtctgttcatatcctttgcccactttttgatggggtttttttttcttgtaaatttctttaagttccttatagattctggatattaggcttttgtcagatggatagattgcaaaaattttctctcattctgtaggttgcctgttcactttgttttattttattttattattattatactttaagttttagggtacatgtgcacaatgtgcaggttagttacatatgtatacatgtgccatgctggtgtgctgcacccattaactcgtcatctagcattaggtatatctcctaatactatccctcccccctccccctaccccacaacagtccccagagtgtgatgctccccttcctgtgtccatgtgttctcgttgttcagttcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttatttatttatttatttatttatttatttattttttattatactttaagttttagggtacatgtgcacattgtgcaggttagttacatatgtatacatgtgccgtgctggtgcgctgcacccactaactcctcatctagcattaggtatatctcccaatgctatccctcccccctccccccaccccaccacagtccccagagtgtgatattccccttcctgtgtccacgtgatctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctatcatgaatagtgccgcaataaacatatgtgtgcatgtgtctttatagcagcatgatttatagtcctttgggtatatacccagtaatgggatggctgggtcaaatgctatttgtagttctagatccctgaagaatcgctacactgacttccacaatggttgaacctgtttacagtcccaccaacagtgtaaagtgttcctatttctccacattctctccagcacctgttgtttcctgactttttaatgattgccattctaactggtgtgagatggtatttcattgtggtttcgatttgcatttctctgatggccagtgatggtgagcattttttcatgtgctttttggctgcataaatgtcttcttttgagaagtgtctgttcgtgtcctttgcccactttctgacggggttgtttgtttttttcctgtaaatttgtttgagttcattgtggattctggatattaaccctttgtcaggtgagtagtttgcaaaaattttctcccattttgtaggttgcctgttcactctgatggtagtttcttttgctgtgcagaagccctttagtttaattagatcccatttgtcaattttggcttttgtggccattggttttggtgttttagacatgaagtccttgcctgtgcctttgtcctgaatggtaatgcctaggttttcttctagggtttttatgggtttaggtataacgtttaagtctttaatccatcttgaattaatttctgtataaggtgtaaggaagggatctagtttcagctttctacatatggctagccagttttcccagcaccatttattaaatagggaatcctttccccattgcttgtttttttgtcaggtttgtcaaagatcagatagtagtagatgtgcagtgttatttctgagggctctgttctgttccattgatctatatctctgttttggtaccagtaccatgctgttttgggtactgtaggcttgtagtatagtttgaaatcaggtagtgtgatgcctccagctttgttcttttggcttaggattgatttggtgatgcaggccctttttttggttccataagaaatttaaagtagatttttccaattctgtgaagaaagtcattggtagcttgatggtgatggcattgaatctataaattaccttgggcagcatggccattttcacgatattgattcttcctacccatgagcatggaatattcttcgatttctttgtatcctgttttatttcattgagcagtggtttgtagttctccttgaagacgtccttcacatcccttgtaagctggattcctaggtattttattctctttgaagcaattgtgaatgggagttcactcatgatttggctctctgtttgtctgctattggtgtataagaatgcttgtgatttttgtacattgattttgtatcctgagactttgctgaagttgcgtatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaacactatgtggagtaggaatggtgagagagggcatccctgtcttgtgccagttttcaaagggaatgcttccagtttttgcccattcagtatgatattggcagtgggtttgtcatagatagctcttattattttgaaatacgtcccatcaatacctaatttattgagagtttttagcatgaagggttgttgaattttgtcaaaggctttctctgcatctatttagataatcatgtggtttttgtctttggctctgtttatatgctggattacatttattgatttgtgtatattgaaccagccttgcatcccagggatgaagcccacttgatcattgtggataagctttttgatgtgctgctggattcggtttgcagtattttattgaggatttttgcatcaatgtccatcaaggatattggtctaaaattctctcttttggctgtttctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttattcttgggaggttgtatctgtcgaggaatttatccatttcttctagattttctagtttatttgcatagaggtgtttatagtattctctgatggtagtttgtatttctgtgggatcggtggcgatatcccctttatcattttttgttgcgtctatttgattcttctctgttttcttctttattagtctcgctagtggtctatcaattttgttgatcctttcaaaaaaccagctcctggattcattgatttttcgaagggttttttgtgtctctatttccttcagttctcctctgattttagttatttcttgccttctgctagcttttgaatgtgtttgctcttgcttttcttgttcttttaattgtgatgtcagggtgtcaattttggatctttcctgctctctcctgtgggcatttactgctataaatttccctctacacactgctttgaatgcctcccagagattctggtatgttgtgtcttgttctcattggtttcaaagaacatctttatttctgccttcatttcgttatgtacccagtagtcattcaggagccggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccacttggtgcagagctgagttcaattcctggatatccttgttaactttctgtctcattgatctgtctaattttgacagtggggtgttaaagtctcctattactattgtctgggagtctaagtctctttgtaggtcactcaggacttgctttatgaatctgggtgcttctgtattgggtgcatatatatttaggatagttagctcttcttgttgaattgatccctttgccattatgtaatggccttctttgtctcttttgatctttgttggttgaaagtctgttttatcagagactaggattgcaagccctgcctttttttgttttccatttgcttggtagatcttcctccatccttttattttgagcctctgtgtgtctctgcacgtgagatgggtttcctgaatacagcacactgatgggtcttgactctttattcaatttgccagtctgtgtcttttaattggagcatttagtccatttacatttaaagttaatattgttatgtgtatttgatcctgtcattatgatgttagctggttattttgctctttagttgatgcagtttcttcctagcctcgatggtgtttacaatttggcatgattttgcagtggctggtaccagtttttcctttccatgtttagtgctttcttcaggagctcttttagggcaggcctggtggtaacaaaatctctcagcatttgcttgtctgtaaagtattttatttctccttcacttatgaagcttagtttggctggatatgaaattctgggttgaaaattctttgctttaagaatcttgaatattggcccccactctcttctggcttgtagagtttctcctgagagatccgctgttagtctgatggacttccctttgtgggtaacccgacctttctctctggctgcccttaacattttttccttcatttcaactttggtgaatctgataattatgtgtcttggagatgctcttctcgaggagtgtctttgtggccttctctgtatttcctgaatctgaatgttggcctgccttgctagattggggaagttctcctggataatatcctgcagagtgttttccaacttggttccattctccctgtcactttcaggtacaccaatcagacatagatttggtcttttcacatagtcccatatttcttggaggctttgttcgtttctttttattcttttttctctaaacttcctttctcacttcatttcattcatttcatcttccatcactgataccgtttcttccagttgatcacatcggctcctgaggcttctgcattcttcatgtagttctcgagccttggctttcagctccatcagctcctttaagcacttctctgtattggttattctaggtatccgttcgtctaaattttttctcaaagtttttaacttctttgcctttggtttgaatttcctcctgtagctcgcagtagtttgatcgtctgaagccttcttctctcaacttgtcaaagtcattctccatccagctttgttccattgctggtgaggaactgcgttcctttggaggaggagaggcactctgctttttagagtttccagtttttctgctctgttttccccccatctttgtggttttatctaattttggtctttgatgatagtgatgtacagatgggtttttggtgtggctgtcctttctgtttgttagttttccttctaacagacaggaccctcagctgcaggtctgttggagtttgctagaggtccacctcagaccctgtttgcccaggtatcagcagcagtcggtgcagaacagcggatttttgtgaaccgcaaatgctgctgtctgaccgttcctctggaagttttgtctcagaggagtaccccgctgtgtgaggtgtcagtctgcccctactggggggtgcctcccggttaggctactcgggggtcaggggtcaggaacccacttgaggaggcagtctgcccgttctcagatctcaagctgcatgctgggagaaccactgctctctttaaagctgtcagacagggacatttaagtctgcagaggttactgctgtctttttgtttgtctgtgccctgccctcagaggtggagcctacagaggcaggcaggcctccttgagctgtggtgggctccacccagttggagtttcccggctgcttttttcacctaagcaagcctgggcaatagcgggcgcccctcccccagcctcgctgccagcttgcagtttgatctcagactactgtgctagcaatcagtgagactccgtgggcgtaggaccctctgagccaggtgtgggatataatctccttgtgcgccgttttttaagcctgtcggaaaagcgcagtattagggtgggagtgacccgattttccaggtgctgtctgtcactcctttcattgactaggaaaggaaattccctgaccccttgtgcttcccgagtgaggcaatgcctcgccctgctttggctcgtgcattgtgcactgcacccactgtcctgcacccactgtctggcactccctagtgagatgaacccagtacctcagatggaaatgcagaaatcacccatcttctgtgtcgctcatgctgggagctgtagactggagctgttcctattcggccatcttggctgcccgaccgcctgttcactttgatgacagtttcttttgctgtgcagagtctctttgttttaattagattccattagaaaattttggcttctgttgccattgcttttggtgttttggacatgtagtctttgcccatgcctatatcctgaatggtatcacctaggttttcttctgggaattttatggctttaggtcttatgtttaagtctttaatctatctcaagttaatttttgtataaggtgtaaggaaggagtccagtttcagttttctgcatgtggctagccaattttcccaacagcatttattaaatagggaatcctttccccattgcttgtttttctcagggttgtcagatatcagatgattgtagatgtgtggtattaattctgaggcctctgttctgtttcattggtctatatatctgttttggtaccagtaccatgctgttttggttactgtagccttgtagtatagtttgaagtcaggtagcgtgatgcctccagctttgttctttttgcttaggattgtcttggctatgcaggcttttttttggttccatatgaagtttaaagtagttttttccaattatgtgaagaaagtcaatggtagcttgatggggatagcattgaatctatattctactttgggcagtatggccactttcatgctattgattcttcctatccgtgagaagaatgtttttccatttgtttgtgtcttctcttatttccttgagcagtgttttgtagttctccttgaagaggtccttcacatcccttgtaagttgtattcctaggtatgttattctcttagtagcagttgtgaatgggagttcactcatagtttggctctctgtttgtctgttattggtgtatgggaatgcttatgatttttgcacattgattttgtatcctgagactttgctgaagttgcttatctgcttaaggagatttggggccgagatgatacaataatgtcatctgcaaacagagacaatttgacttcctcttttcctatttgaataccctttatttctttctcttgtttgattgccctggccaaaacttccaatactatgttgaataggaatggtgagagagggcatccttgtcttgtgccagttttcaaagggaatgcttccagtttttgcccattcaatatgatattggctgtgggtttgtcataaatagttcttattattttgatatacgttctattgatacctagtttattgagagtttttagcatgaagggtgttgaattttgtcaaaggccttttctgcatctgttgagataattgtgtggtttttgtcattggttctgtttatgtggtagattacgtctattgattttcatatgttgaaccagccttgtgtcctaggtataaagccaacttgattgtggtgggtaagtttttgatgtgctgctgggttcagtttgccagtattttattgaggatttttgcatcgatgttcatcagggatattggcctgaaattttctttttttgttgtgtctctgccaagttttggtatcaggatgatgctgtcctcataaaacgagttcgggaggagtccctctttttctattgtttggaatagtttcagaaggaatggtaccagctcctctttatacctctggtagaattcgtctgtgaatccatctaatcctgtactttttttggttggtaggctattaattactgcctcaatttcagaactttttattggtctattcagggatttgacatcttcctagtttagtcttgggagggtgtatgtgtccaggaacttatccatttcttctagattttctagtttatttgtgtagaagtgtttatagtattctctgatggtagtttgtatttctatgggatcggtggtgatatcccctttatcattttgtattgcatctatttgattcttctctcttctttattagtctggctagtggtctatctatttttttgatcttttcaaaaaaacagctcctggattcattgatttttttggagggtttttgtgtctctatttccttcagttctgctctgatcttagttatttcttgtcttctgctagcttttgaatttgtttgctcttgcttctctagttcttttaattttgatgttagggtgttgattttagatctttcctgctttctcttgtgggcatttagtgctataaatttccctctacatactgctttgaatgtgtcccagagattctggtatgttgtgtctttgttctcattggtttcaaagaacatcttcatttctgccttcatttcgttacgtacccagtagtcattcaggagaaggttgttcagtttccatgtagttgtgcagttctgagtgtgtttcttaatcctgagttctaatttgattgcactgtggtctgagagactgtttgttatgatttctgttcttttgcatttgctgaggagtgttttacttccaattatgtggtcaattttagaataagtgcaatgaggtgctgagaagaatgtatattccattgatttggggtggagagttctgtagatatctattaggtccacttggtctagagctgagttcacgtcctgaatatccttgttaattttctgtctcattgatctgtctaatattgacagtggggtgttaaagtctcctgctattattgtgtgggagtctaagtctctttgtgggtctctgagaacttgttttaaagtctgttttatcagagattaggattgcaacttctgcctttttttttttttttgatttccatttgcttggtagatcttcctccatccctttattttgagtctatgtgtgtctctgcatgtgagataggtctccttaatacagtacactgatgggtcttgactctttatccaatttgccagtctatgtcttctaattgggacatttagcccatttacatttaaggttaatattattatgtgtgaatctgattctgtcattatgatgctagctggtttttttgcccattatttgatgcagtttctttatagtgtcaatggtctttacaatttggtatgtttttgcagtcttgtcacttatttttaacatggcactggaattcctagccacagcaactaggtaaggacaagaaataaaaatcattcaaaccagaaaggaagaagaaaaattatctccatttccagaagacatgatcatacacatagaaagccctaaacctaaactgaaatgacttaacaaaaataaactattagaactaataagtaaattcaataaaatacaagatacaaaatcaatacaccaaattaaaatcacatttttatacacaaagaacattccaaaagctcaggtaacaaaagcaaaaataaacaagtggagctacatcaaactaaaaagttctttcacagcaaaggaaaaaagaatcaacgaaatgaaaaagcctgtggattgagaggaaatatttgtaatcatatgttctataaggagttgataactaaaatatataaggaactcctacaaatcaacagcaaaaaaccctgatttaaaaaataggtaatggaactgggtcgatatttttccaaagacatactcatggctaaaagtatgtgaaatgatgttcaacattactaataatcaggaaatgaaaatcaaaaccaaaataagataccacctcacacctgttaggatgactattatcagtaagtcaaaagataaaagctgttggtgaagatgtggagaaattggagacctgatacactgttggtgggaatatgaactagtaaagtcattatggaaaacattacgaaagtttctcaaaaaattaaaaacagaacaaccaaccatatgatacagcaatcccactcctgtgtatgtaacagaaggaaatgaaatcaaagagatatctgcaccccatatttattgctgcatgatttataataggcaataaatggaaacagcctaagtccattgatggtccattgacaatggagaaagaaaatgtcatatgtatagcattattatgtcctctggacaaatactagccccaaactctccagttctcaccagtgaccacatatacttgatgtctctcagtgacattaaaatgtcacatatacccattcggatagtcatgccctcaggtgttgccatgccctcatctagagctctgcacttggtgttttcaggcatggttggtagatttcatgtgtgaaaagataaggtgaacgtttgttgatgagaggatggtcaaagcctcctgaatcccactggttccccaacacgtgtcttttccatccggggcccatgcaccaaaacctcaaataccagaaagccagtgttctggttctagaacaagtctcacagaaataggttgtcctcatttaggcctcattttatctgtcagaagtttaacctttaaatttacactgcccaagttggcaaatatcccatggctgacttactggcttctgctatttctcatttaaaattagaaatttctggtcatcttcagtaactgtttctacatatttaactaattatcagtttttcttcacccaaatgttaattatttacctcacattttacatttgctttgaaagagatgacacatatcagtaccatccttttaggaatggctttaagctatcactaagttgtgtattttaacttaccttttttcttagaggtagcccaaatgtcctgcagaatcactaccacttatcaacatgtaatattacccttgcacaaaaatctcacactcagacccgtgtcaattgttaattattgagagtcaaaaatcacatgagataagtttctcttaggtgatcagtttccaaatatgcctccacataaacaggtggcatcttccctatactctccataatctgttttataatgctggctccacaactttttctccatgactggaaaatcagttctctgttctcataggttgtggtcaagcctgcattcctctgccatccgaaaataaacccactactgagatcacactcgtgtcacatggtggcatcactcaaattaagccctagtggaatggtcataaagtaagtattccctaatacatactcaggaaaggggactgggagaaccttatgacaaagctaacattggtgcagtaaaatgacttcaggatgagaggcacttttccatttgagttcatcagactaccaataatcttggctaaaagactctgtatcagccagcattcaaaatatttgttcatggtgcattataacacagcataacttgagaaataactttaaaaaatacttagcttagtgcttagtggtcatagtttataatatgtacttgtgccaggggaataacattttcatgtctcctgaatgtaagtttcctatttaacagatttatttttatctaatgaatttaaaataccagcatgagtattttactaagagaggggattagataacatcccagtgtctgagacaggggcatggatacttcattatgaaatattcaaagaattcccaggagaaactttttagtgatgacaagtgcagcagtttatgctattcactacataagagaggaggccttcatcattttttctgtgccccatagtgcttctaatatgaattttacaaaagcacacccttgataaaaattatttcaaccatcactaataaaataaagttaaaactctttggcatgtgcctttaaaaaactttctatatttgcaccaaaataccttagcagacttatctctcaccctactcaactgaggtttattccattctcctttacctgacacccacgtcagcacagaactctctgttctttactaagtcattgatgtattcttccctgagggtctgggtcataacttatttttcggtgactgctctgtcctccttacagccactgacgtttggtgttttcttgtcctaaattgacagtgattctgggttgttcaccctggaacctatgggaagaatgttgttgtcattacatcaggaagagaaggcagcccgttgactcagtagtgctgctctgggcagggttgggagctgagcaatagacttttcattatttccaggtgtggcactcctttcagaagcattatatctctggcctctaaatattccacgctggggaaactggatgcattctaatcatgaaggagtttagtaacaactccccaaggtgaaagcctcccagtcttgtccttctgttctaattgaatttccctggttccatggggttgatgctgcgtttctaattttttatgtttcctttcatgcttttcaatcctatttgaaaggtgttagggcaaagtttaagtcaaggtaccaagaaggtgagagcagtgaggagtaagtctgcttccccacccttttccctctctttgcccaacctcctgaatattctaaactactttctcatctcctaagccaattataggaaaggaacaagggctgcctcagagatactaggggtccttgtttttggtggcctaatgttccgcatttggaaacctctaacacttgggtttttaatcccagaattagagcagtagaacatgaagaaagagcaaggagggtttgggcttagcaagtgagagcaagaataggatttttttagagcactcccaaaacaacattgctgccctaagtttgtttttgtactgttttcaaagtagataggattgacttgtatttaattcaatttctaagataagcatgaacaatctgactcctcatataaaccaaggaaggctactacaattctgtgatgtttgtgagggatgcaggtgggcaacatgattcaggttggtgatcagctcctggctgaaacttctggatagcctcttcaacctccagcccatgtcattctggaggataaacccacctttgccattgccaaggtcagtggcttttagtgaaaccaggttcttgtcaatgtccagtaggccttttgcaatatttaaaatttcgtagtcactactcactaagcaaactctgttcagagaggtaaatgtctagttctggtttatggattatgtagagtacacagagaactttataacttgagctgtgcaaaattttgcaatattaactaacttttccttccatatttcttcatacttctctggatttgcactacaaaatcagtcagtcattcagccagccattcactgatttagggaaagcagaaaagataggtacctccattctccctcacatgaggaggttgtctatgtgtcaatgaaggctgaatacggtccttctcttcccacaatcccattctatgtactcaaagattgtttctctgacagtagagattagataaccttttcccgggagagactgagacagacagaattttttagatcgtgtattgtttctaaattaatctgtgttctgcaaaaagcaatgaaaaatatgttaaatcccttttgagattaaattcctcctctcaatagaatggtgattgagatttgtaaaactagttatactagctgggctatgacatagtaactggctcatgacatgtacttacagtgtaagcaactataaaattgtacaaaattcattaggagaccgtttgggagcattgtaaaacaggcagtgcagaattgtgatctttgagagaaggaaatcccatgagataaaccaatgttttctacaggatacaatgtgcctgggggtatgttccaggctgtggcacaaggagatggagtccaaacaaagtgcaaggacttcgctgagctggagagacagtttgtggctactgaagcatttgaagttgcttgtcatatctggagagaaggcagttctggtcaagggtttagggcaagagtccaagaaacctatgacagagcaagtgatgtggggctaagcacagagaccttgctgaacattgtggacattcaattcagaccacaactaggccaggcattaggagtaaggacatatttcagagtaaatactttgccctagaactaagttcaaaactgatgtataaccatcctaacaaagaataaaagcaagcttggcaggaccaaaaggcccaatagtaattcaactacctgccacaacaaaactgagcaacctttctggaagatgttaaagtccaaatttcaaacaatgcatcattcacaatgtactgcacacaaaaacgtttctagacatatcaagaagtgtgaaccagaatcaacaaaagcagcaagtaatagaaatgatctcaagatatctaaatggtaggaattagaagaaaagttgaagaaaaaacatgttcacagttctcctatacatatatgccctcaccaacacaggtaccaccactgatccctgtgaatcaaagagacttgtttaataacttcttcaaggtcacacatcccgtggtggagtcaggatttgaacccagagaatttttcccactgcactcgttttagtgattatttttgatgcacaaatgtcttccatacttagtagctttgaagatagtttcctcttttttgcatggtataaaatgataatatataacaattatattaaatcagatatcttacatgttaattttttttttttgagatggagtttcactcttattgtccatgctggagtgcagtggtgcgatcttggctcactgcaacctccacctcccaggttcaagcaattctcctgcctcagccttccaagtagctggtattacaggcgcccgccaccaagcccggctaatttttgtacttctagtagagacgaggtttcaccatgttgaccaggctggtctcaaactccggacctcaggtgatccgcctgcctcggcgtcccaaagtgcagggattacaggtgtgaaccaccatgcccggcccatgttaatttttaatatgatcctagagaagatagtgaaggaaaaagagacagagaaagaatggacatgtggcttatggcccccctccccactcccagtgttgtccctgtgcctctacttctcatagggccttcacatgggcctggaatggagatgctgaatttaaactcttgcctggtaaatgagggggcttttaggctttctggtgtgaagaatattggcttcaaatggttggcatgatatggaatagcttggtactgtggtccacacatcaacccatgtgtgtacttagaagctctgttttatatgttatatggaaacagctttctaatatagagttggcaagatgaagccttaccagctggccagctattgtgtgagaaacagagtttacaccaggctcatccatcttgcaacacatcaccttcattcccagcaaaattctgctcttccaagtgccagactgtgactcagcagtacctaaaatgtcatgtggtaatgaaacttgaaaatcaagagccttttcaaaatatcaaaatgcaatattccctgcaattaatgtccttttgggtgatctctttgaagaatataatgcaaaccgtaatccttcaaagggaatttacaaggctaactacctcctgaactcatcttaaaggaaatggaagggaaatacggcaggggaaccataagaatcactagaccagcctcgccagtctgtgacatacctacatcttcccccttttcaataacaagccctcgttgcaagcatcttcctggcatctgagttactatgatgaagggaggagcaatgacctgagaagtaatggtcactagtaacatgaacaatgacattcatggtagctaaaatgtattgatcactcgctatttgccaggtatcctactactactttatagggactacctcatttaattctctcaaacaccccttgagtttggtcattatagaaatttcacagaagattttggaattgagaaagcaaaagtaattctcctattgtcacatggccagaagtgatggacctaggatttggaccaggatctgtgtctaacacccttactctaaatgattatattggtgtttctagattttcacgtgtttttctagttccctcaggtgtatatttaggttgtttatttcatatttttcttctttttaaaatgtaggtatatatcactatacattttcctcttaggattgctattgtatttatctattataaactataaaaaaagcaggtttagagaacataatgggatgcaagacattggagattgagaggaggaagtggggataacccatgtagacaatttataagaaaaattttgctgtgaagggaagcaggtatatagctggtagagaagtgtcatcagaagaaggtatttgtttaaaatggaggataatggagcataagtgtatgccgatggtaataaccactggaaaaggagaatttgaagatgcagagaaacagtggtcatctgcaggaattaaagctgtgcaagggtgagaggtaaagattagatcaactggagatgttggatttgttaaaatggtgacgcaccagccccaactttcatactcagtgataacctgcatgccaataacctacatcccagggatggtcaaattgagaatgagggattggcaagacagagatgtccagagaatgaggaaatgagaggcttgaagaccctaagactcagactgactactagaggctaatctgtactgacaaattcatattttgagaaatgtattggtttgggattattgtgtgccactcatagttccttcaagtttgtgtgtgtttatatgttcacagggaggtggaaatgtgggaagatcccattgttgattaaaaaagaaaaccccacagtaaagcagattaatggaggggactatctcctttccagggagagaaaagggcagtgttcaaagcaggaagaaaagccatgaacaggaattcacccgaaatggaatgtcatcagaagaccttatcttttccatgggaggcaggggatgggcaattctttttggactctaggagcatggatacatagccattgctcgccagtaatttgttccactataatttcatgtagtcactattgacctttcattgaagtctgtaactggcagagtctacagtcctgtgagtggtgcttttggagagttaagaagcagagcagtcaagagaagcattgctttcttggcattgccattccccattggtccttctccaagggaaactggtcctggtcatccagagaccagcagccaagtggatctgggatcccctgagagggatgtgaaacacagagaaatcactggcaggtggatactcaggagtgcgtatgagacaacccccttgtcccaaagcagactggatgtcacacaacatccctggaggtcagggagagcagcacacctccatgtgattccttctggtgtagggcatgactatggatgtgggttgctccattgcagtgaagacaaggttacatgggtatttcagacagaggagttccaggacataagaaatggtaggcagctgggccccaggaggggagagtgcagctggacagactttccaagactcgttggaataaggggaaagaagggaggggaaggtgggggcctatgaccagcttttttgttgtcttttttcacaaatttatggtgtgagggtgggggtggagcaagttggcagagtagaaggatccaccaattgtccctgcaacaagaacaccaatttaacaactatctacacagaaaaaagcatttttataggaacaaaaatcagctgaacactcacagtacctggtttcaaatttatattgctgaaagaggcatggaagaggtagtaaaaacagtcgtgaatcaccgacaccacctctctttcacaccccagcagcagcagcattgtgtgaagagcgtttctgtgctctgtggaaaggaagagccagcaattgtgaggcaccagactcaatgctgccctttatacagcagaaagcaaaatgggatcaaacttagcagatgtctgcccatggcaagagcatttaaaccagccttaatcagatgagaatcaccagtcccagcggtcagagcttgagttccagcaaatctcgcccctgtgggctaaagttctctgggatgctaaataatatgaaatgcagtctaggccacaaggactacaattcctaggcaagttctactgctgaacagggcccagagccagaagactagggggacacacaacctactgagacaacaaccaggatcctaagggagttctggcatcaccccttccctcaccccaggctgcagagcgtgtagctccaaaagaggtcccttcctaataactgaggagagaagagggaagagtgaggaggagtttctcttgcatcttggataccagcttagccacagcaggataaggcgacaggcagagtcataaatctacctttctaggacctagctcatggacaacatttctagacacaccctggacaaggagggaacataataccttgaagggaagcactcagtcttgtcaggattcatcacctgctaactgaagatcccttaggtcctgaataaccagcaatgatatccaggtactacatcaaggaccttggacaatactctaagacttgcgggcttcaggttagactcagaacattctcagctttggtggctgcagggcaagacccctgcttgagaaaaagcagagggagaagtaacaaataacataaaatggatctccaatatgcctggcagcagacatttaagtggaaaccttacaggccaggaggcagtagcatcacatatttaaagtgatgacctagatgacaggttgatgggtgcagcaaaccaccatggcacatgtatgcctatgtaacaaacgtgcacattctgcacacgtatcccagaactgaaagtaaaatttaaaaaaaaaataaagtgctgaaggaaaaaaccttttaccccagaatagcatttctggtgaaaatatccttgaaacataaggagaaatactttctcagataaacaaaagctgagggatttcatcaacactatacctgtcctacaagaaatgctaaaggaagtactccaatcagaaagaaaaggatattgatgagcagtcagaaatcatctaaaggtacaaaactcactggtaatagtaagtacacagaaaaacatagaatagtataacactgtaactgtagtgtgtaaagtactcttattttaagaaatattaaatagaaaaccaattaaaaataataactacaacaactgttcaagacatagacaatacaaaaatatataaatagtaacaaaaaatattaaaaagctgggggacaaagttaaggcatacagaatttattacctttttgcttgtttgtatgtttatttgttaaagaaaacagagttgttattagcttaatataatgcactataagatagtatttgcaagcctcatgttaacctcaaactaaaaaaatacgataaatacacaaaaaataaaaagtaagaaactaaatcatatcaccagagaaaatcaccttcactaaaaggaagacaggaagaaaagaaaaatggaagagaagactacaaacaatcagaaaacaaataacaaaatggcaggaataaattcatactatcaataataatattgaatgtaaatagactaaactttccaaactttccaactgaaagacagagtagctgaaaggatgaaaaaacaatatccaaggatctgtggcctacaagaaacacacttcacctataaatatacacatagactgaaaataaaatgatggaacaagacagtccatgccaatgaaaatcaaaagaaacaggagtagctatactcatataagataaaatagattttaagatgaaaattatcagaagagacaaagtcattgtattatgatgaatggatcaattcagcaagagtatataacaattttaaatacatatgcacctaacactggagcactcagatatataaagcaaatattattagagctaaagagagagataagaaacaatacaataatagttggagactttaacaccccactttcaatattggacatattttcttttctttctttctttttttttttttttctgagacgaagtttcgctcttgttgcccaggctgcagtgcagtggttcaatcttggctcactgcaacctccgcctctcaggttcaagtgattctcctgcttcagcctcccaggtagctgggattgcaggcatcagggaggcaggagatgggtggttctttttggactcccggggcaatgatatttagccattgctcactagtggtttgttccactatcatttcatatagaaactattgacttttcattgaagtctgtaagcggcatagagtctacagtcttgtaagtggtgttttttgaggacttaagagcaaagcagtcaagcgaagcattaccttcctcacataagcatttcccattggcccttctctaagggaaactggtactagtcatccagacagagaccagcacccaagtgggtctgggatcccctgagaggggtgtgaaacacagaggagtcactggcaggtgggtaccaaggagagcatatgagacaaacccccagaccaaaaggagactgggcgtcgcctactgtccatggaggtcaggaagatgggcagaccttcatgtggttccttctggtggagggcatggctatgggtgtgggttgctccactgcagtgaagatgagggatatggtttggacctgtgtctctgccaaaatctcatgtccagttgtaatccccagtgttggaggttgggcctgataggaggtgattggatgatgggggtggtttctaatggtttagcatcatttccctagtgctgttatcaggatagagctctcatgagagctggttgtttaacagtgtgtagcatctcctcctgactctcttctttctgccccacccatgtgaagttctccctccccctgtgaagtgctccttcttcctttgccttccgctaggattgcaagtttcctgaggccttgccagaagccgagcagatgccaaaatcaggcttcctgtacagcttgcagaactgtgagccaattaaaccttttttctttataaattacccagtctcaggtatttctttacagcaatgcaagaaaggaatagtacaatgaagttacttgggtattttgggccgagagtttccaggacatgggaaatggcagctgggtcccaggaaaggagagtgcagctggacaaagggacttcagagactcgctggaataaatggaaggaagggagttgaagttgggggcctatgcccagcttttgtgtgttttttcttcacaaatttatggtgtggaatgtgtcatgtcctgcctggaaccctatttgtccagcctctgatacagggagccaatacaaaggagatagctactcaggaaaaagggacagggaagaggcccctcattagtttggctgcttccccaaacaggagactgtcagaaacttccctcctttgggtctccccccaggccctggtggaatgggagtgtggcaggaagtgggagcccatgatctgggccgaggtctcccaggccacagaggagaaaagggagggagtcagttctgttctgtgcgatctggcaggaagggtcagggaacttttctggggcagcatttctgaaatcgggctggaactatctgacataaaatggggatgactgaaaacctcccatattatgatagcggctagtgggtggggaacagggcaagtggattgggatagcaagaatcctagattccacgggcatgatttggaggtacaacacattgttggtaagatggtggctaagggacaaggaagcctggatgtaaacgcttaagattggtattggatccctctgcctttccgttctcctccacccagcagtgaggggaggtcagggcagaactaaagtgaatgttcttttcatttgctgaataggggcttgtgtacctcacaggaagacagaatgtgcacatttctctgtgtttctctttgtctcattcttagtcctgagaccattagtcctagttaccatgggaaccaaagctgagtgtctgacgcattcactggactctgggagaaaattcgagttggtccctgatttcagtaatcatccgtttaccaccttcactctttttgcgatatttaattgtggtaaaactattataataccaaatgcttccgatctacgttaatatttcacttgcatttcttatagtttgtttagaattttaattcattaatatcacacgctatcttcattgtcgtgtttagaaggcatagtgttttcctttgaacaaaatagtttttcatcaataagtatattttcaaaggaaacttaatatcactaccataagtggaaatccaacatgacttgtcataaatagaaagttactgtaaaaaacaaacgtgaggcaaaatgtaccatttaggaaaaattatttaatgtgttttaaaattgtcaatgtttcattcaaatgatgcacctgacctcattttgtgtaccatatgggtataattttggtaaattttatcaatgtgaggcagtcttctgtagcccaattccctctggatgtgtggacaacgtttaattgctgcacctacaaaactgggaataacggtgatcatagcatggtactgacttcccctgtgggggacctgaccggatgacgagatggccttccccaggcatccttggagtcattataccttttaaaatgatgagaaccggcttgtgaatgtttcccttgccagttcagggtacatggattcattagtgatctggacagaggcattgttcatttcctctgtagctctcaaaacttgcacactatttggggaagacagagctctcaaaaaatgtgtgtcaaataagcttccttctttgcaaattctgttccttcttcccagaatgtcattgccacagctttgatggttgataacctgcaattcatcgcttaaacttggagcaagtgctcctgactccctcaggaagttgtttcttccctcctctttgttcctgtaagaaaggtaatattcactatgataagtatcattgtctatgagccttatctctcccaccggactctgaacttctcaatggcagtgactaattctcgtccatcttttcgaaggctcttcagcttatatagcacctttcgttgtattgaataatgtcatgtatgggtcccatttttcaaaccagattgggagttcccgtggtaagaggaagcctgatcttccattctgtatgctgtgtgattctacagccatcagtcctgctcctagtgccccagcaagcctttccttggctatgaagattgccaaaatactgaagcctcagtgaagcctcttcgttcccccaggtttcattttctggactcagggattttattacccactgtaaagactaaatatgcttttcactgtgtggaagaaagtatagaagttcaacggcacattgtttcttcatcatcctatgttctctgaaaaatatttgggttcggaaatattttgtgcgcctcttatccaatccactgttggagaaagagaaatttcatctaaagttctgcaaactccttcgaattccttgtggtagatgtaaatggggagggagagaggatgggcaggaaggtgaagggaggacctgggagataaggggtgcacaggatgatatctgaccccactatccatccactcctcattctactcctagcaggtgcctccgccccaccaccacctggagaagactgcttagagaaaagaagaccttccagactcagcccattcacattcctcttagtctttgaggttcatgaaagttaggtaacttgctcaaattcactgaagtcattctatgagaccaatattacccagaaaccaaaggcagaagaggacatcccaagaagagcatactacagaacaatatcttttataaatgtagaagaaaatgccctcaacaaaaccaaaaggagagattggcagaacagatttgtttaaatgctccagttacatgctatcttgaagaggtgtgctttactttcaaagacataaattgcttaaaataaaagcgtggaaaagtatagtgtggaaacaatcatgaaaagagagttggagtggctctactaatattctctgagacaaaaatatactttaagacaacaattcgatttagatacagagaaggacgttttatcacggtagagtgctcaatccatcaagaagatataaagatttttataaaaatatatagacacatagcaatagtgccccacaatacacgaagcaaaaatggacacaactgaagggagaaagatgcacacaagatcccagccttgtaggatgtggctaaattagctcttagatgcaaatgtatagctataaacacctatattgaaaaaagagtagtgctctcaaaaaattcttctaaatttttatgttaagacacaggagcaagaaaattaaactaaccccaaacaggcagaaggaaggaaataaggactgttagagtgatataaataaaaagaatataggaaataatagagaaaattaaccaaaccaaaagttggttcattaacaaagatcaacgaaattgacatgcttttgctagactaagaaagaatagaaaagatgcatattacaaaaatcaaaactagaatataggatattaatacaatcttacagaaataaaaaggttatgggaaatactgtgaacaacagcatggcaacaaattagataatcttgtgacaaggacaaatgtccagaaacacacaaattactgaaactgcctaaaggagaagtagaagatttgaattgatttacaacaagtaaagggattgaattactaacaaatatattcccccaaagaaaagtccagggttaactggtggaattctaccaaatatttaaaggacacttaacaccaaagcttcacaagattgctcaagaacagaagggcgcccttcccagctagtttttcgagcccaactttaaccaaactccaaaattagacaaggcatcagaaggaaataactaacctaattacagatgcatatctgttatgtatacacaaatctcctccacaaattacacacatacctaatccagcaacacacacacgtgcacacacacacacacacacacacacacagattttacacaaagaccaagtggaacttgctccaggaatgtaaagttggttcaacgtacaaaaatcaatcaatataatataccacactaaccaaataaaaaccccatattatcgtttccgtagacacagaaaaaacttgtgacagatccaaaaccgtttcacaattaaaaaaatatgaagaaactggagaaaaaaggtgcttctgcaactcagtagactctaccaaaaactcacaactgccatcatgattaatggtgaaaggctgaaaactttcaccctcaacaagcaacaatgtgtgctctcaccatttctatttaacattgtacaggagcttctagctaatgcatttaggcaagaaaaagagatagaagacctccagacttgaaaggaataagtaaaactctctctgctcacagatgacattatcttgtacatagaaaacactaaagaagccggaaaagaaaatactatcaggacgagtcattgaatttattccatataatatctacatcaatgtaaaacatacaattttatgtctttgtactaccaatgaataatccaataaaggacactttaaaaacaattccacttatcatagcatccaaagaaacacaatagttagaaataaattccacaaaagaagtgtaagacttgtacgcagaacactacaaaaccttattgaaagaaattaaagaagacctaaagaaatgtgaaggtgtcccttacacatggacggggaagactgtgtatcattaaaatagtaacagtccacaagtggatctatagatacaacatactcaccgtttcaaatcccaccaggatcttcttgccataattgacaatctgattctgacattcccttggcaacgcaagggacccagaaaagccaaaacaatcttgaaaaagagcaatgatggaggactcacacgtctctatttcaaaacttactgcaaagctacagtaatcaatgtgttgtggtactggcataaatttaggcatatatatatcagtgtcataaaaatgcaaattttagaaataaacctcttcttttaagttcagttgattttccacaagtgtatcaaggcaactcaaagtgagaaagaatagcattttccacaaacggtgctgggacaaatggttatgcccatggagaagaatgaagtggacccaccatctcatgccatgcctgaaaattaattcaaaatgaatgatagacataaacctaaggggaaaaaaactatgtaacttttggaaaaaaactttggggataaccttcatgaccttgaaattggaattggctttgtagatatggtacccatatcacgggtgaaaaacatgaaacacagaggaattgtacttcattaaaattaaatacttttgtgcttcaaagcccaccatcaaggacagggaagacaacttatgagatgattgaaaagattggaaaatcatatatctcatatttgactctatttgcaatatctactaaacacttacgactgcctaataaaaaagacacacagcccaaataaaagtgggcaaagcattgcaatagacatttctctaaagaacatgtacaaatggctaataagctcaagaaaagatgctcagtgtcattagtcattagggaagtgcaagtcaaatccacgttgtgataccacttcccactcactaagatggctgaaatcaaacagatagacaataacaaatgttggcaaggttgtggaggaactggaatcttaagacatttctcatgggattgtaagatggcccaatcactttgggagagggtgcagcagttcctccaaaagtaagagttcctttatgacccagcaagtccactccaggtgttcacccaagagatttcaaaaaataactcaggtaaaatcctgtacaagagtgtccataacagcctcctccatagtagccaaaaagtgaaagaatctaaaagtccatccacagttgaatgagtaaccaatatgtagtatcattatatggtagttaatggaatgtacgagccacaacattgattaatctggaaaacatagtgcttactgaaagaagccggtccaaaaggtcacgcattgtatgatctgatttataggaaacattcactacatgcaaaatcagagagccagaagatagatcagagggtaccagtggtttgaagaagaggggagattaggtcacttaaatacatacagcgtgttttttgaataaaaaagttcttaaattacatggttgtgatagttgcacaacttttccgttttttaaattttattttattgtgctaagaacacgtaacatgagatccgccctcactaaaattttaagtgcaaaataccatattcttaaccataggcacagggttgtacaggagatctcaagaatgtattcacctggcacaacggaaactttatacccatagaatagcaactccctgtttccccctccctccaggttcaagcagccgacactgcactctggtttttaaatttgactattttagatagctgaaatatttagaacccacattatttgggtgtgatggcaggaattccttcttcatggaagtggaataatgtcccattttatgtgtataccacatttttaatatccattcatctgtcgatgaacatttaggttgtttccacattgtttttaaattttgactgttagatgtaatgcttcaatagaggtgggagtgcatatatcccttcgaggtccagatttcaattcttttggatatatacccaaaagtgggattgccagatcacatggtcgttctattttcaattttttgaggaaccactacggtgtattccatagtggctgcaccgctttatgtgcctactccagtgtgcccgtgttggaatttttacacatcttctccaaaacaacacttgttatcttttctttctttctttctttctttcttttctttccttctttctttctttctttctttctttctttctttctttctttctttctttctttttctttcttctttctttctctttcttttttctttctctttctttcttctttctttcttttttgttttgataatagctatcgttcaaagtgtgaggtgatagctcattgtggtttggatttgcatttctctgctgagtagtgacgttgagcactttttcatatactgttgggcatgtgcatgtcctctttgaagaaatgtctattcaagtcttttgcccattctttagtcagtttgttgtcttcttttttggtattgagttgtaggagttccttgtatagcttggatattaatcccttatcatatatatccttttcaaatatcttttcctgtaaatctcctagaagagaacataggtgaaaagttccatggcatttgacttggaaattatctcttgaatatgacaaaaagcacaagcaacaaaaagccacgttagactggtgagactaagtcgaaccaaaaacctatggtgaacccaccggggcctgttgtgggtagggggaggggggaggggggagggatagcattaggagatatacctaatgcaaaagacgagttaatgggtgcagcacaccaacaggtaacaaacctgcacgttttgcacatgtacgttagaacttaaagtataataaatatatatatatatatatatatataaaaaataaaataaaatgaaagcaaaaaccaaaaacgaaaacaaaaacctatggtgaaccaaatgaaacaatcaacacggtgaaaaggccacctacggaatgggagttgctcaacttttggaatatactaacaaccactgcacggtacactttaaaagggtgagctttgtggtatctgaattatatctcaataaagctgtttcttttaatgaaggaggaaagaatctctgaaggaattcaaaatgttcataacttattcctaagttaacatacatgctagtatattaggatacaagttggagggatatttttgaattattacaaaacgaaacctatacgaagacttccataaggctgaaaaattaaatgtggtaggaggcttccaaagcggcctctctggcagagtagcaaggttgcaagaacaatgtcaaaacaaagctatttctcaggcatgacctttgtgattgtttctatgtctcagactcccgtggatcctacctgctttccaattctggttatgcagccctcttattgacttcgtgtgcaacctgatattcttgcatcaggtttgtttgtttgtttttttttttttttttggttgagcaatcgtgagtgtttttctgttgttgctaaccaaacattctgatggacacaggaggtggcagatgtaggtgttatttacatctgtaaagtgaaaggaaatttcttcgagaaaaaaatgtagaaaaggaggaaacaaggccacaatctggagcatatcaaaaagtagaggagtttacaagaagaggagccaggaaacaactcaaagaataggatctatcctggaaggaagatcaccagaagaagatggtttcatggaatccacaagatctcaagagaccgatagtggccagcacgttcaatgctactaagagggcaagccaggtcagagggatgataattggatttgacatcatgtaagttactaaagagcatgaaaaagaaaaaaagcatattggaggacagaaggccatgcaagacatcggaggtggagatgaggaagtggtgacaacctgttcagacaacttaccagaaaagttttgctgtgaaaggcagcaggtatgtgggagaacagctggtagggaagtgtcgccaagggaaggtatttgtttaaaatggaggacagtggagcgtaattgtatgctgaggggaatagccactggagcagaagaatttgaagatgcagagaaacagtggacatctgcaggaattcaaactgtgagaaacagtgaggggtaaagatggggtcaaccagagaggctggctttgttaaaaatatgagccaccagccccatgcttcatgctctcagttaaagccatgctgataacctccatccccggggatggccaaattgagaatgagggattggcagggcagagatgtccagaggatgaggaaatgaagtttgaagtccataggatccaggctgagtaacgaaggttaatgtaaactgacaaattcaaattttgagaaatgtatcggtcagagatatttttaatttttttaaatttaattttattttttttctgcagttggggtctcgctgtgatgcccaagctggtcttgaactcctgccttcaaagtgcagcctcccaaagctctgtgcagtggtgctgtcataactcactgcagcctcaaactcctgggctcaagtgatcctcctgcatgagtctcccgagtagctgggaccacagatgcgtgccaccatataaggctaattttttctatttttataattttagagatgaggtctcgctacattgaccaggctcgtgtccaactcctggcctcaaccaatcctcctgcctcggtgtcttgcatagctggggttataggtgtgagccactgcgcagagctaggtgagggattatgatgtgacactcatagctccttagtgtttggtgattgtctctgggtgttcacatgttcacagggaggtggagacatagacagatcccattactgagagataaagaaatccctacaatgaagcagattaatggagggacttccttctttccagggagagaaaagggcagtgctcaaaacaggaagaaaagccatgaacgggaattcaccggaaatggaatgtcctcagaagaccttatcttttccgtgggaggcaggggatgggtgattctttttggattctagcagcatggatgcttagccatcgctcactagtagtttgttccactataatttcatgtagtcactattgacccttcgctgaagtctgtaactggcatagcgtctacagtcctgtgagtggtgcttttggggatttaaggagcagagcagtcaagcgaagcgttgccttcctggcattgccattccccattggtccttctccaagggaaactggtcgtggtcatccagacagagaccaggagccgagtggatctgagatcccccgagaggggtgtgaaacacaggggagtcactggcaggtgggcactcaggagtgcatatgagacaaaccccctgacccagaggagactggatgtcgcgcaacatccgtggaggtcaggaagatgggcagaacttcatgtggttccttctggcgtagggcatggctgtgggtgtgggttgcacattgcagtgaagacgagtttacttaggtattttggactgaggggttccaggacatgggaaatggagggcagctgggtcccaggagaggagagtgcagctggacaaagggacttctgagactcactggaataaatggaaagaagggagggaaagttgggggcatatgcccagcttttgagttgttgtttatcacaaatttatagtgtgggacgtctcatgtcgggcctggcacgctgtttgtccagcctctggtaaggggagtcaatacacaggaggtggtgggcttctcaggaagaggggcaggcaagaggcctctcattagtttggctgcttccagaagtgggagactatcagaaacctccctcgtctgagtctccccaaggccctggcggaacaggagtgtggcaggaagggggagccctaggaacttgtcccatggtctgggcagaggtctcccaggccacagaggagaagagggaggaggtgtgtcctgtgtgactctggcaggaaggatcagggagccctcctgagacagcgcttctgaaattgggctggctggaactttctgtcagaaaataggaatgactgaaaaaactcccctactgtgatagaggctagagggtggtaaagaggaaggtgagttggggtagcaggaatcctaggttccacaggcatggtttgcaggtacaatacattgttggtaacatgatggctcggggacaaagaagcctgtctccaaaccgtgcaggtgcattgagaggatgtagaaattctggattcatgtcaggcccgtctgcgtttctgccctcctccacccagcattgaggggagggcagggtagaactaaagcgaatgttcttttcaatccctgaataggggcttgcgtacctcagaggaagacagaacacgcacatttctctgcgtttctctttgtctcatctttagtctctaggccattagcccctgttgccatgggaactgaagctgagtgtctgatgcattcattgggctgtgggagaaaagcagagttggtccttgaaataaaggcccctgggagaggggattctagcaaggcagtcacattgaaagaattcacaattcccacagatatattgatccttgtgattattagtacacacacacacacacacacacacgcacacatcccacacacccccaccccatacacacacacacacacacacacacacacacacacacaggcttcatcctgaacagatacgatgtacagagcatcgcactggctggcccatagggttcttgtgggagaggccaggcctctgtgaccatgaaaggggttgcaactgatacagtcagggagggatcccaggaaggggagtgattcccttaaatttgcttgttgaaacccgtatctggcaggggaaaggaggatccggtgcagagcttggattcagcagaggtggctgttgatgtgaccagtccccctgtttgggtgggaaggccctgaatgacacatgcagcaaggcaagagtggtcccgtgcaccctttgctctttcttggcttatccagctcctccctctgagatagtcccatggggagccccaggttgacctgggatggggatcccctctttccaggggcagggtagagttctcaaagctggcagttttctcctcctttccctttctccctcgctgccccttcttcttgccccctgctcatcaatcaccctttggtaaaggacctctccccttgttcctttctctttactccctcatccatttcctctacactcctttcctctttcctctctcttcctacctcacttcagcctctgtcatcacctctcatctcccctctctgctctctctcctccatgccttgtctttccctttgtcctccctccgagttcccatatccctcactgccctttctctccctctttcctttctcatgttgtcctcccctggttttcccctcattttgctttttccttctctctatgccgttccctcccctcaccctccccgccctcccctcccctgatactcacccagtgactaatccgcagttccttaagtggtactgggcgtaacgtgggctctatgtgtttagctttcagcctcggagggcagtacatcctaaagtgaatcaccaacttaattattcctctgcaaattaccatcagtgatacgagattcaacgacaaggagctgtgagagcgcacaggaagggagctcatttctggggtgggctcagtgaagaaaatgtcattgatgatagtccttgttctgccatccaccatcctctgcttgcctctttctgtcactgccttcccttttatgttgggggcaactctcctcttctatcttttgcagcagggtgggactcctctcatggtgtcctgccctccacaccccaaggtgtgagttctcatgaagtccaaccggatgcccatttcctgcaacctgagcacccaacagaccaaagagcatgaggggtagtttcaactcgcccggggacccttgttcctgctcccagcttccccagggcacctttggtcatgtacttcactcaccccttctctttctcacgttcacttctcacctctcttccccctccctctttcctggctgcatccttttctcctaaggctttaccccataaagacaaagaaactggctgaggagacaagagaaagaaagtagcagaagatgggaaggaaacaggtgagtgacactgacttagctgattaagagagcttgatcttttttgagggtgtggggggttctcgctctgtcgcccaggctggagttcagtggtatgatcatagctccctgtagcctcgaactgctgagctcaagggatcctccagccacagcctccagagtagctgggagtacatgttaattttttttttatgttttgtttttttacagacggagtctcacttgtgttgccaagagagcttgagcatcaactggcagtgaggatggcaggaaagcaactgacttatcccctctcaccagaccttccaactgtctgcaacactggcattgccacgtatcccggcacgttgttggtaatggtgggggctgtaaattgcacgattgctctagaaagtgtatttacaaatcacttagacgcccagatcccctctcagctcctcgtagcatgacaaatcgctctccccccactctgggagatggcggacaaatgtactctctgcagagcatgaaccagcagatttatgggctttggaacttcaggctcacttcaaggcatacatcccaacccggcgtagggatttcagttgctgtctacagcaatcttcagtccctcacctccgctggagtttggcgtccagattgctggcatcttgccccttctcagagatgcaggagagtcttcctgtgtaatctaaacttccccagagaggagacttagtaatattggcaggcaaagacctctggagtttgcttcattagtaagctcaaaatattttcttatttcaacgttagtttttcttagagccatgggttacttaggaggatgtttcttaatttaccaacatatacgggggtttgtaatgatcttttgttattaatttctagatcccattgtggcattgtggtcagagaatatacaaatcgctgaagaatccattgtttatggacattcctgggatagtattcatttaaatatctctatgtacactgtaatggaatataatacaaaaatggagttgcacgcaaaatgagggtaccactcagtaaatggttccacagggacgtctgatcccctacgatctgggttaagaaatggtgtagtgtattgccggcagctcaaaagcactctcatgccagtcactcttgtcttccacctcagcaaatctaaccactcttgtgacttttaacacttgacgataatcctgcctgtttgtgaacgcattacacatgagtagactcagtacagtacgtattttataatccgggtttctcttggcaacattaggtttttctccttgctattcacttttgtcgtgctgtgtagctgaatttcgtttctttgcattcctgcgcagtgttttgaattgtatgacgatgccacaatttattcatgccttttatttctaatgggctcttcagtagtttccagcgctggagtgttagtgttattattgtggtgcacgttcacaaggatgtcctttggttaacatgcgtatgcatttaaggctgtgcttgcaggactgctttgattactttttcttccttcatggcactgtaagtggtgacagtggatgtatctggtttttttttccccctgatctcagagggaaagctgtcaacatgtcacccgtaagtatcgttgtttttgtaggcttttaaaatatattccaacggaatcaagagacttcccttttgttcgtagttggctaagaggttttatcataagtgcatggtcatttaaaaaaaatcaaacccatgaaatacccttcctgcgtctgtagggaatatcatattttttctccttcatacattacttctgagagatagatttttcaagcgctgaaccgcttcatttctagaatactcttgacttgtttgtgatacgttttcctttttggagatttaactgatttgttttgctaatgctttattcaagatttcttcttctgtgcttatgtaaaagataggcctgtgcatttcatttcttaccatgccctttaaggtttttccctcataaaacgggatgggaagcatttcccgttttttatgttacttggcaagaaggtaagattgatattccttccttcacaaacgttttgtagaattaatcggtggcagcatcagagtccgtaggttcttgtggctgttgctgttgtttccttcagattccgcccgtttagaatttgtaggacaattcagatgtttagtctgttttctgtcattttgttgtattttcttgaaatgtgtaaattatatccaaagtttcacgtttgtgggcataaagttgctcatggttttgaataatgatctctttaatgccttcattgcccatagtgatgtctccttagccactccagacacgggttgcttcatgatttctctcctttttgttcaggcctacacaaggcatgtcttaatcacatcatcttttcaaaaaaccacctctggctgtgttgttttatctttaactgatttgtacttttatcgttatttcatttcttctgctttcttcaggtttaatctgttgttcaacatggttaagaaagatgcaaatgttgtgcctttctttttcatgcaatctagacaattaaaatatatcccataagatttcatcaggttcaaaatactttgcgatttcattggtgatgttttccttgagctatgggttatttagaaaataggaaataaaaaggatgccttttctaaaaataaaatgaagtgaaataaaaaggatgcccttttatttcattttcttgcttaattgccctctgaacttccgggactatgttgagaagaagtagcaaaagcgggcatctctgtcttgctcctgatcttagaggaaaagctttcactctttcgccatcgtgtacagtgttcacaatgagtattttatataggacttttgtgacgttgaggttgtttccttctgtttcaaggagtttgagtgtttttatcacgaagggggttgacttttgtcagatgcttttagtgcatcaattgagccgatcatgtggttttgtccttcattttgttgatgccgtacactaaattagttgattttcattgatcgaaacttccttgcattccacgaataaatcccacgtggtcatgggcctttcatgtgttgttgaactcggtgtgctagacttttgttgaatatgtatgcacaaacattcttttgggaagtgtgtgtgtgtgtgtgtgtgtgtgtgcgcgcgcgtttctggtcctagttcttctctaactgtttagtagaattctccactgaagccatctagtcctgcggttttctctgttgggaggttgatgaatactggttaagtctccttatgagttgtcgagatctgctgagattttttatttcttcaggagtcagtcttggcagcgtgtacgtttctcagaatttatccatttcttctaaagtatcaaatttgttggggtatagttgttcctggtcttctccttataatcttttttatttctgtagtaacaattgtaatgcccctctgtcattctgattttagttatttgacccttctctgtttttttcttaatctgcttaacctatgttgaccttttcagagacaccagctcttagtttcattgttttttttttcctattatttgtctattctccatttcctttatttgtgctctaatctttattacttccttccttctgctaacttcgggtttacgttgttcttcctttgctagttctcgaaacacaaagataggctgttgatttgagatctttcttctttttcactgtaaggatttaccacaataaacttccctcttaacactgctttccctgcatctccttagttgtggtatgtggtgttttcattgtcatgtgtctcaagatactttctaatttccttgtggtctgttctttgacccactggttgttgaagagagtgttgtaatttccacctgtttgtgactttttcaattctccttccggtattgctttctagtttcattccattgtggtcagaaaagataattggtatgatttcaaacttctgaagtttgtgaagatcctaaatgtcaacaaaaaagctaaagcataagacctctggaagagaattcaggataaagccttgaaaaacttgctgtaggcgaaggactcttatagctatgacacagaaagcaatagccatgcaaaaacaccttaagtgaatttcatcaaatttagaaatctggcttttcatcattagcgaaatgaaaaagcaaaccattcattgcggcaatgtttgcaatatatactacccgacaatggaaaagtttgcacgcaaaaaagcactcttataattcagtattaagacgacaaatgataatcaatgtgcaaaccatgtgaatggttcttcacatgcaacacggaacgatatgcaactggtcaagagaagaggctgggccaaggtcactagtggaggcagcggcaaagctgggtcagagatctcaggcaagtcacctcccttctctgagtctgtttcctcaagtgcacagtagtagctcagacgatctttgagggtgtcacgaggtagtgggcaaaacgcccttggcccagggcctgatgacgacaaaaacaaggaggagcagcaggatggatgcccaggaaggaaagcacccaacctgatgtctcaggaggctgggagggcggtggcaggcctcagaaacctagggtggaacctgtcgttcagggaagccgtgaggggtagcgaatcatgcacgatgaagggagatggggagcggtatgtgcacgtgggtgcgagggtgggtgtcaggagagagtgcccagcaggtgggtgtatcacccccaggacactgcaagaccctggatggcaggggaggccgacagcagggcccagtgcacgcaccctggcctcagagggtcccaggttcaagtctgtgctctgccacttcctggctgtgtgacttggggagagcatcttccctctcggagcctcagttggctgagaccatgaaatggccttactgcccccacctctcgggcttggccgagaaacagaaacataggcccagatgagaaattgtacatgaatattcagaacaactttatgcataatgtcaataactggaaacaagtgaatgcacgaatgctcgtccatcgccaggcctggggcaggggtgatcagagggagcaggccaagctgggagaaggctgtgagtgctgtccactgacacagcagggcctcagaaaacacttgctgacatggactgtgggcctttgcagtgcggggtctgcagaaggccccaggccgggggcaggggggaaacctgcctaggtctcctgtttgccatgtgagtgaggtggtggccgtctccagggtggccggtctgacccttctgcaggacgcgcagtccagtccgcccccatttcccaccagggtgctctcacctccctgctctcctcctctcttcccaggtgctctcagcgctgcccctacagggtagggggagtgggtccctggtgaggccccaccgcagcaaggtgatgtgaaagggagagtgtccagcaagcctggaggcctgaggaggccgtgacctggccagcaccccacctctgagggctgcttcctgttcctttccggtggaacttccgtatctcaagtgccctctgcacacagtgttcaaactcactcctgtggcttatggtgactacccccaccctgatccaaggacaggcatgtgcccgctatgtgcacaagggtgtccggggaggttccagccaaatagcattaaatttatgacgccaggggtggtggagtcccaggcatccctcatctcttccacagcccagaccacaaaccaggagacataaagggaaggggactccattgtgtgtgtgtgtgtgtgtgtgttccagtaaaactttggaactggatttctgtcagagtcccagaatgtcagtgtggccaagcatggacccaagcaccagagaagcagaaatcacagcggcagccaacacggagacccacccaaagcctttctgacggacagcttctggggtgtgcaaccaatgcagtctgatgctcaccagggctccccatgtggctccatgctctgctgttgttgttttgaaatccttcatagtttttgacaaggagactcgtgttttcattttccactgggcctcccaaattaggtagcccggtctgggtcaggatctggccgtggcggagatggcagcccctcctggggaaacagaggctggggctgggtgagggggtgggaagcagggagccttccactgctatgttttccctccttatctagggctctgtcctcccaagccctggacattaccggggaactccagaagccctggacactgtccctgcctgccactgagcccttcccaggagaccaaactgtctctgccctcactgtcttgtacctgaagcatgtgcagccctacctcagacccctccagacatcacccagcccttgaacacaccaggacctaggtaggcctggtgttgtcctcactgggagagccctgctgctgggggagaagggctgcgaagctccaaacaggccgccgttccgtcacaggcaaggggctgtgtacgcgtgcaccgtgcgttgtttttattacatcctgctccctcagcaatcacggcccctccttctacccactggagggctgcgaacatcactgcggggcccacctcattgtccgtcagactctgtaccgaggacggggtcctgaactgtgtggatgatgagccaagggttccggaacatcatctccaaggagggggtgtgggaggtgggtcctggtgagagccttggaccctgtccctcggcgggaggggcagtggcaccaagctgcaattttccaccccgcccctgctgtggccccgactcttgccatgtccctggggctgctgagcaaggtttgtagaaaatcacataacgatgagcactggggcctctccaaactcctgctcacgcactcaggcgtaaccaacctccgcacctcccagcatcccacctgtccctgtgggcctttttggcagaggtggggcccacctaccccagagagcctgaagaagtttccttgctacaagcccaagcgtggccaggtatagcaatgggtgtgcaggtaaaggaagaaacatccaaattaattttgcaactttaatgtaacactgatacccaaaacatgaaaacacaaggaaaagcacaaaatgaaagcaggaagagcaaagagagcttcatcttgcatgccacctccgactgacaggaagaagccgcctagggtgctgtgtcgagaaggaatctgagaggaggcgctctggcttggccagtaagatcgctgcagttcgtcaacggtgcctataaaagcacaagaaaccaaagtgacaacatccgtggacacacgcgaaccagggaggggtgtacgtaacaaaataagtgtccgtccatgctgttgccgttgcccccagcgcccccaccctggccctccctctgacatctcacccccctccgcagccctcctgcagagtctcatttctctaccgaaactcttactggatccaggagaagaagctggcgccagctctggcagcatttctggtccggatggtggagctggtgctggggccatctaggacgctggtgctggcccctccattggtgccactgctgacgccagctctccacgtggccctcctgttggcacggttgctattcagaatgtactgatggtatctggcccagaaagcaaaggggatcctggcccaggcatcgccaaaatctccgtcctcatcccaggtcaggagctcgacttgtatgtcatcccagctccaccgtccaatcagcgcttcatccccgatattcatctgggccctcatctgggccctggcatgttcctcggccatatccacatccattgtcttgaaagcatcatccacagcctccaagaaatgagccttccattcccgggggtctcggttctgattctgaggaggaaaagggcaggcatagacacagagctaccccacactggctgagcacccgcggcccgcctcaccccctcccgtgtgctttgtgcaatgatggcaaaaatcaggaccacagggattgggggctcctactctcctgtgccagacctgggattttgccccatctgtgaccttgtgtagggtgctcaggtgcctctgtgagtgtttggtaccctcactggaatacggggtaatgggaaggaggcctcgaccaagaaacaagcaaggtgtggagagcaccacccccggtgccgggcacccaacagaggcgctcccttacctgggcgatgaatctcaggaccctcatcttgctggtctcatggcgggctcgcaggccccagaggaattcatactcaggtgggttgctgttggggatcttcttgtattccaggtaccttggcatgagaggaaagtaaactttgctgctagccaagcagacctgttgctgaacggatgggttccagggggcccctcctcaacccgatgccgcagctcagctcctggaagaggactgtcctgcccctccagcccttcactcattcccaaacccactcccaggacttctgcctgcaaaagtgaggccttcaaagccttttgccattggtcctccccggaagccatgcggaggtgcagggggtccacatgtagggcatttgtctgtagggaggccacaagtttgtgcccctcatcacgatgaccccagcttcctgttgggtgtgttgtaaacagaggagccattcttcaggccccctgctctgagcacaccccacctcgagggtcttggccacaccccggcggagccctggagaggcccaccagaggaaacgactggagaggaagaaacagtcagccaggagaagcgtgctccaggcatcctcctcaagtcctgaccctttgttggtgtgcatgcgcgcctgtgcgttggcaagtcctccagggacggggagagggtggcccctggcctgaaaatcaggagagttgggctgaggcccttaccagctgggagccatgctcagaggcgtctcctctctgagctccgggttccttaggtgtaaaccagggggaactcttgtgtcagtctacagggcaggtgctcaaggtgatggcggccgttttcacaccccacaccgtgttctcaggtgacgtgagctcccttttcccaagaccgccctggccttcggctccccacacactcgcataccccccactgccactcactcccaggtcagaggcacccatccctccagttgaagatttgggatagggaactgctttctcagccagaccagcacacaaaggatgctcgagtgagagccgcagttagctcaggtgatacttacttctgcttcacaaagtcatctgtgatgagcttcctcagatcgccgaggaatgggtgcctcaccctgagggcaaggaaaggaatccatgagcagagacggtggcaggggccctccctagcatgactatgacttcccagcccccggggagtcgctgtggaggcctgggcatgcagcagaggccagaggactgttggtcagggacgccccaggtagggatttgatggaatccctgactctgactgtctctcttagatgtcatctggggccacagagcagagagagggctgagcagcgtccagcaccgcttccccatccgccctggtgagatcctttgctctctaccgagcccagggcaccccacgcccttgcgccagaccaccaggctattgcaatcccaggacctctttggccagaggatagcaccgaggggaggagctggagaggccaatcatacccagggcgcagtcccatcttgcgtagtgcctcccagaggacagctgcgaggggagaggaggtacgagagtttggcacccagaagatgagactatgggcagccccccagttgcaggtccagccactcaccctcgctggcacggttgccattcatgaagatgacgcccagaatcaccaagaggagactcagcctgggagtgtccttggttctaaaggtgtggaaagagaaatcctgtttagcagctatttgcctgagagacaccaccaggctctcccaactagcctctctcaggtttcccagcttgaggggaactcttcccaggacaggcacagttcactagctgctgacagaccattcgcacctccgcctgagacttaatcgcctcctctataaaacatgggtactaacacttccctgacagggttctgcagaggacagggcgaggcagggagccgaagctctgcaaatggcaaacgtgtgcccagagatggctccagacctttcctgccccttccacatcagcacctacactgaagaggcagctctcccctaggccagctctgccaggcccaggccaggcaggcaggaggaagaggcactttcctccgaagctttggggataaagcccggcagcagcttggggagaactgatggcagcaaggcctcaccccaggctatcattcctttcatccagcagtcaccaggcagccctcgctgtgtgtgggagcggtgcgccgcactcaagccccgtcttcctgcttcactgaaggggtgtgggcagggaagggacaccaccgaggaaggccacgacccgctttccctttcttactttccaaggaggcgagctgaggagtcccgtgtgcagacaagaatatacaggtgttcttccttgtcgatctccttcaggtggatcccaaacttctacgtgggggagaaaacagagtgtgagatccaaaccccatgctgggcatcctgccggcagacagtgattccgggttagaactgctcctcagcaaggaatccaaactcgtgagcgagggcagaagaagacagcacacggaagaccttcgctgtgggagctgacgctggcagaggcgatgagacccacctggccagacggcgagacactcagagagcatgagagagagaagccgagggcaggaagcacgagtcaaactgccagtgcagtggaagctcagagtcggagaggtgagagatggctccagagactgggccttgaggggctgcagggtcaccgcacccccatgcccgctcttcccccacagagctgctcccatcctgcacccaccttttccagggtgtacgttgctcgttcaatgatctcagggaaatgttcatcatattctctgatgacatccttcagcatgtctgcaggagggggaagagttggagaaagcacctgggctgagcaggggtcatagagctgtagccccttggtcagctctgccgagggtgacgcagccaggaccccgtcctgtggctatggagggaccagccgtggcacgcaagcaaagggatgcccacagactaggggatggtgaagggggcacaggctgcctacctgcgcgcttgatggggatcttcttgtagtccttaatcatcaggtatttcaccaacttatttgcctggagaaggaggaacatgcggggaggtcaaggcatgggtgacagcagagacgtggcccacaagggaggagaggaaggagatgggggagggtgggcttcttaccctctcctgcagaagggtcacgttgcgggggggcaggcacagtacgtgccttgagggtatctgggacctcggggccatcgggggccgaggggccaactgagcccgcaccgtcaatgagggctgtgatgctctccaggtgggtgggaccgcgggagtctctctctcctcctcgctgctctcatactcatcatccaggtgcttggactgtatcatttgagagaggagagacccagggctaccaggctccccgtgccaaagcacccggcacgcacctcacccgtagcaggctcttggaaatgagagcagtaccagcagcggctggcatgtgctgcgtgcttactaagtgccaggcactgagccagcctcttctcccaccagtcctgagggtagggactacgtggagtgaaaacatgctcagcaaacttgtgttggagaaacatggactagctgagaggagaggaggggaggagaggggaggtgaggagagaaggaggggaaagaggagaagagaggaagaagggggagaggagagggaggagaggagcaggaaagggaggagaaggaaaggacaggagcaagggggtgtggaggtggcagggggcagggggatctcaccttcttggtcctcttgcctcccatcctggcccagggctcagcactgtgctgagcagtggcagcagctgcaccctccggctcagggatgctcgtggccatcttggccttggcagcagctgctgccacaacattctgaggctccacccaccgagtcttggccagcgccttccccgacttggtggtcttgggccgggtggctgccacctccctgccaggtcccgtctggggcacaccagaggcagcactggggccctctgtggcagcctcttgggctggggcaggtctcttggggcgcgggaaggccatgccactgacacctgccggctgagtgaaatcgaagacatcattctggcccaggaaggctgtgctgggccggttggcgtccacctccctggcacacggagcctgagagaaagcacaggcgctactagggccctcagtagcagcctcctgggccggggagcctgtctgggactgtgcggaggttgccggagcctcgggggcagccatcttactggtgactaacatctgggaggtctgcggagaagcaaggggtggctcaggggtgggcccctgagcctcggcggcgtaggtcgtgggctgggtatcctctcctgagacctgcggcgtggccacccggtggctagcgaccacctgactgaaggcggtacgggcagcggcggcagcggcccgagccgcacggttggaggcggcggcgcgggctacgttggcagcacgggcggccgtctcattggcaagtgtttccggatccagctgcaatgcctccaccagggtctgggccagcacagggttttccagttcccagggctcattctgcaaggccagagagaggggttggggaaggcaggccactcgacgacatacttgtgttagcttccctgtgctggccagcctcttcccagcagtcagccctgaacaccccaagaccttcccaaatcttcttcttccgagcaggggagggaaggcttgggaagctgggcagtcctttcccacacaaccctcctggctcccccctcctccctcccccattcacaggggaaaggcccaggccagcaggtgtccaggaaggggcctcaccgataagatgcgaaggcctggacccaagcttccgaaggctctgaggatatggatgtcaaagctggtgagggtgccatagccaccaaacgcaccgaattcttcatagtcgttgccttcaaccatctcttcctccccgacttcgtcgctaccctcatccatgtcttcaacactgtagctttccgattgcacgctgaagcttccctcagccatgctgcgggtcccagggagatgagagctcagcctgagagggagggtgaagcagctgcagggggagggggcgggatccaatgggaggcgggatctcccgggaggtgaggggcgacaatcatcaggttactaggcaatattaggcagtagggggcggggggggggaggaggagcgggggggagacggtttggctttctgatggggtagacctggtcagggacagagcccaaggaaagggacagaggaggtcgcaggaggcgccgcactgaaagcggagtttaggatgggcaggctcgccatcccagcggctagatttgacgagggggtgttctggagggctggggtccgaagagtcccaaagggaatgcattggggaagagagaaacaaagggtttggatttacgggccagagaaggggaccgggatgaagggggagcagatgggagagctcagacaacagggacagtggcaagccgcaagctctgcgaaacagaaccccagggacctttggctaggtccgggcggggggcctaggtggggctcagactcgagcactagaggcggatggagtgggggcctcagacctaggtgaggctccaatcggagcgctgcagatctcaaacgcgaggactgggcactccaggaagggggcaagcggtcagctcggttcgagtaatctaggagtggttggggtgggggtggggcctcaggtccaagggagctcagctcggagcacacgggtctgctaaaggggtgaggatcctgggctccggtttcagtagggctcagatcggggcgcctgggtctgatggtgatgggggctcctatctagaccttgggtctaatggggttccggttctgagtgcttgggctttgttcagatccggaggcggagggagggcgcagcgtgtcgggttccactcgccctctcccggtcctgtctggggctggatccttaccttctcgggaactccaatggcgtccgtcctcagcaccaggaaccccgcagccgcgccctcgcctactgctgccagcacagcagcccggaccaccccgccccttttctccgtgcaccccccgcggctgggtagcctgcgcatgcgcggacccctccagcccgcccgctttcccaacaaaagccctttcctccaggtctccagtgcgcatgcgattccgcgggtgggtgggcggtggggtcgaaggtagggtgcggggggctcttcccgccagatccacttcacctctcctcctcctcctcctcctaccgcgggcgcgcacactcataccctgcagtgcagctcgacccacccaatcatctcttctcagtccccccacttttgcacaatgcttctctgtcctgccctgccctttcacccaaactcctccagcctggtctgggatacactatgccccgtttccccggcaagaccccttaggtcacaattagtgaggtctcacaattaataagctgggtctctaactgcaacaagtggaaatcctcaacctgcggggctacgaaatggacatggccagaggatggcacttcgctttgtgtgcttctccactagccaactctctggcccccagacatactgggaacatctgcttcctcagctaccctttatgcagcttgtatgtcacagagggatctgtgctggggcttttcttcctctcacagcagcgctgggaagtggatgtcagcatccccatttggcgtgtcaggaagctgaggcacagacacattgcatgaactagaccacagagccaggaaacagaaaatgcaaaatttgaacctgggtcttccggactccaaagtccacctcctgctcctgctggcctggggacagaggcaccgcctcctccgtctgagtgacaggcctcccccaccccaacatctgtcccaaagaagcaaggtttgtgctgtagaaggcctaagttcatgctccgcattcaggacacagggagacagagcctccccccgcctcgcccccagcctctgcggctctatgtgggtccatccaggtatgagaattgctccaccgggtccactctctactcagattgtcaggcctcttccttatcagcgatacaatcacgctgccgctgagaccctcctggtgtccgccaggacaattagacacctgtgtgtctgagctaattactccacaatctacaagcccagttcaaacttcacttttgaggtccaagtgcatagtacattcacctgcctacgtgacatctccacttggatgtcttttgaggcagaaaatgctgtggtctcatctgcagtcgaacctggactgtttgtaaaattcgtagtagatttttatatttgtttttatgtcagcctcaccaggacccctgtgtatgaatggaaggtattgctaggacagcagcttttactctccgctgaccagtatccattctgcctggctctgtggttttctccagctgttatatatcaatctctcctgtcagctgcttgtgcctctttagcccttcccctgtaacatatcctctgcgggagaggaacacaccctacaaacgaaagccttcagaaagtgctacgtgctaatcactccaaaaaatctacaaccccagtctgaacttcacttttgaggtccaagtacatacattcacccacctacgtggcatctccacttggaagtctcaagggctcttcatggtttgcctgtccaaaactggtcacttggtatactcactcctcccatacactcacacatccccatcgctcctgttccccccccccccaacccatcttcacagtctcagtaaatggcgccattatccacacaaccactcactccagaaactgggagtcatcgatcaccactccccgtttctgatacgctgcatccagaagggcaagctctgaagggtctccagagctgcctctctgtgcagctgtcttctctccattactcccggcaaattctggtcctatggacctcttgagctctcaactctgtctccttcactcagacggtccaccgggctctgttgtgttcagctcccctgtgctgcagcctgcaaactctatccgggcaagaagttggtggaattgggcgatcagagggctcacctggtcaggttccctttctctcagggatcactgtcccgtatgcaggtggtgccatgacgttaagccttataatttttttggtttataggtatttaggcgagacggtaagtccggttcctgttaatccatcatggctggaaatacaagtatccaccggatttcttaattttcttttcactgagccctgtgctttcaggaggcctccacgttgccacgcataatctaaagtatgtccaaggtgctatgcacagagaatccatggtgtgcattcctgacattttacctatctgctcgcccagagatttaccctttctcctaagtaactagaaaatcagaagaaaaccataagaaacatttagatgtccaaagagaagaatgacagcacatttctcattagcaatatgcaagtcagaagtcatgtggcacaccatctttaaaatcgtgaaataaaaataaatgtcaactcttaagtctatactcaatgaatatcttttcaaatgaagttaaaatagtaggtgtttagacatacagaagttgaaagaattgatcatcaatagacttgcactgtaatattttttaaaacttttatgtttgggggtacatgtgaaggtttgttacatagataaacacgtgtcacgggggttcgttgcacacatgactacatcacccaggtattgaactcactatccaagagttatctcttttctgctcctctccgtcatcccaccctcccccttaaggagaccccagtgtctgttgtttccttctttgtgttcataagttcttatcatttagctcccaattctaagtgagaacatgtgggatttgcttttctgttcctgcgttagtttgctgagcttatagcctccagctccatgcctgttcccacaaaagacacggccttgttcttctttatggctgcataatattccatggtgtatatgcaccacattttccgtatccagtctgtcattgatgggcatttatgttgattccacgtttttgctcttgtgaacagtgctgcagtgaatagtccaggtgcatgtgtctttatggtagaatgctttatattcctctggctctatacccagtaatgggattgctgggtcaaatggtagttctgcttttagctctttgaggaattgcgatactgctttccacaatggttgagctaatgtacactcccgccaaccgtgtatatgggtttccttttcttggcaacctcgccagcatctgctattttttgtttttagtaacagccattctgactgttatgggatggtatctcattgtggttttgatttgcatttctctaatgatcagtgatattgagctgtttttcatatacttcttggctacatgtatgtcttcttttgagaagtgtctgttcatgtcatttgcccccttattaatggggttgtttgtttttctcttgtgcatttgtttaggctttttatagatgctggatatcagacctctgttagatgaatagtgttgcaaaaattttctcccactttgtaggttgtctgtttactctgttgatagtttcttttgctgtgcagaagctctaagtttaattagatcccatgtgtcaatttttactcttgctgtgattgcttttggtgcctctgtcgtgagatctttgcctgctcctatgtccaggatggtattgcctaggttgtcttccagggtttttatggtgttgggttttacattaaagcctttaatccatctcatgtggatttttgtagatagtgtaaggaaggggtccagcttcaatcctctgcatacggctagccagttatcacagcaccattgatagaatatggagtctttttcccaccgcttgtttttgtcagctttgtcaaaaaaaaaaaaaaagaaaaaagctggttgtagatgtgcgacattatttatggcctctctattctgttccattggtctatgtgcctgtttttgtgccagtaccagtaccatgctgttttggtcattgtagccttgcagtatagttcttttagcttacgattgccttggctatccgggctccttttctggttccatgtacatttttaaataattgtttctagctctgtgaagaatgtccttggtagttcgatgggaatagcattgaatctataaattgctttaggcagtgtagccactttaatgatattggttcttcctatccatgagcatgggatgtttttccatatgttcatgtctgctctgatttctttgagcagtgttttgtaattctcattgtggagatctttcaccttcctggttagctgtattcctaggtgttttatttttgtgtgtgtggcaattgggaatgggattgcctttctgatttggctctcagtttggttggtggtggtgtataggaatgctagtgatctttgtacattgattgtgtatcctacaacttcgctcaagtcgtttatcagctgaaggagctttttggccaagactatggggttttctagatatagaatcatgtcatctgcaaacagaggtggtttggcttcctttcttcctatttggatacactttatttatttctcttgcctggtcgccctgaccaggtcttccagtacaatgttgagtaggagtaatgagagagggcaaccttgtcttgtgccggtttacaaggagaatgcgtccagcttttgcccattcagtatgatattggcgtgggtttgtcacagatggattttcattattttgaggtatgttccttcaatattgagtttatcgagagtttttaccatgaagagatgttaacttttatcaaaagccttttctgcatctattgagatcaccatacgttttttgtctttagatctgtgtatatgatgaatcacatttattgatttccgtatgttgaaccaaacttgcatcccggggatggagcctacttgatcgtggtggattagctttttgatgtgcagctaggttcggattgccagtattttgttgaggattttcgcatcgatgttcatcaaggatattggcctgaagttttcttttgttgtgtgtgtgtctctgccagattttggtatcaaaatgatgctggcctcatagaatgagttggggagaagtccctcctcctcagtttttgtttttttttttttttttggaatagtttctgtaggaatagcaccagctcttctttgtacatctggtagaattagctgtgaattcctcgggtccttttttcttgttgttgttgtagttgttttgttgttgttcttgttgttaggctatttattactgaatcaatttcagagctcattattggtgtgttcaggaaccaatttcttcctggctccatcttgggagggtgtatttgattgatttgggaggaatttattgatttcttgtaggttttctagtttgtgtctatacaggtgttcataacagtctctggggtttttcggtacttctctggggttggtggtaatgtccactgtgtcatttctgagtgtgtttattaggatcttctctcttttttttaaaaattagtctagataggggtttatcagtcttattttttctttcaaataaccaacacctggtttcattgatcttttgtatggttttttgcaacttaaattcattcagttaagttctgatttttgttacttcttgttttctgctagctttggggttggcttgctcttgtttttctggttcctctaggtatgatgttagattattaatttgagatctttctaagtttttgacatgggcattttgcactaaaaactttcctcttaacactgctttagcagtgtcccagagattctggtatgtggtagctttgttttcattaatctcaaagaatttcttgatttctgccttaatttcattgtttacccaaaagtcactcaggagcagtttgtttaatatccttgttattgtatggttttaaatgatcttcttagtattgatttctgtttttattgtattgtggtctgagagggtggttggtaatttttcggtttgtttttattttgctgaaaattgatttatggccaattgtgtgctcagttttacagtatgtttcatgtgcagatgagaagaatgtagatactgttgttttggggtgtagagtcctgtagaatagtctgttcagtctatgtggtcaagcatactgttcagatcccggataactttgttagttttctgcctgatgatctgtctaatactgtcagtggggtgttgaagtctcccaccattattttgtggttatctaagaccctctgtcagtctctaagaacttgttttatgaatctgaatgatcctgttgttaggtgccagtgctcctattgttgggtgcatatatatttaggattgctaagccttcttgttgaattgaaccctttacccttatgtaatgccctctttgaggaaattacaactttcttcatctttttggttttggcaaagattttcaaaatgagacacccaaaccacaaactataaaagaagaaaaattaatacatttgattccaccacaattaaagtttttggcctttaaaaggcattcttttgaaattgaaagagaaatccacactctgtgataaaatatttagaattcatatatctatatccaacacaggacacttctagactataaagaagtcttataactcaattataagaaggcaaatactcaactataaatatggagaaaagacttcaacagactacctcaccaaagaagatacacagatggctaacaaccacacaaaaagataccatcatttatcattcaggaaatgcagattaaaatcaaatttaaatactgtcgtagatacatgagcatgattgaaattaaaataactgattatacccagtgctagcaatgatgtggaacttctgaatgatggaaacacttcggaaattggtttggtagtcgcttacccagttaaatattcacctcccataaaccagccattccactccaagacatacacaggagaaaagaaaatatattttcatatgattacttgtttatgaatattcatagcaaatttatttgtaatagccaaaagcctgaagacaacccaagtgtccatcaacagggagatgaattatgaaattgtgctatgtccatacaacggaatactacagcgcattaaaaagaaatgaattgttgatacttatgacaacataaacgcatctgaaaatatgctctctgaaagaagctaaaccaaaaaaaaagggtgcagggagtaagattacgtttattaaaattctggaatttcaaaggagcccgaggatatatttttgtttgtaatacaggtgttcattatcattactataatgattgtttcacaggtgtgataccaaaacttattagatcatatatgttaaatatgctcagtctaacatatgtcgattataattaataaagatgtaaagaagccgggcgtggtggctcacgcctgttatcccagcactttgtgggggcgaggcaggaagatcgcttgaggccaggagttgaagatcaacctcaccaacatagtgagccccagtcactataaaaaatttaaaaattagccaggtgtgatggggcatgcctccagtcccagccacttgggagactgaggcaggagtatcacttgagccaaggagttccgggctgcagtaagctaagaagatgccactgcactgcagctggggtgacagagtgagaccctatctcgaaaaaaataaaaaatagacacagtatgggatatccctatctatctatatatcatattatataatatgcataatgatatatctaaaaataatcttacgtaaaacaagaacacatgtcacactttacgtgtttttatcacataagaaaaatgataaataataaacatattagaatggtacatttagatgagcagtgcacagtgggagtagagagtgcaaacaaaaaggatcaaataaatgaatggcaacaagaacggggccttgcctaaaagaatggcaagaacagtgatatgagttggaaatgattttctcaacactctgaccctaacgtatccccaccctccccttgcctgaattattctgaccttctcttagtcccctgttgaagccatgcttgttggtcttagcgactgactttacagttttgctcccaatacgcctgaactggtaaccctctttgctgttcacctgtctacctcatgcttatatccaagtcctcagcttaaatgtcacttcttcatgatagcattttctggccacaaaacacttcaccctcaatttaaattattttttctcttttactttctcttagtcctctggaaacttcctctataccatttatcccagtatatgtcataatgatacacagttttagagggattctttttgaaacatctctctccccattgcagtgaaagccccagggtgaaagttatcattgtctgttttcttctccactgtatatcctaagggcctgcctagtccagtgactgttatatattagaatctcaaatatgtttgttggaggcatgaatgagtgaatgaatgaatgagttgaaaaaccaaatggaaaagatggatggcttgacagagagactggtgaatacatgtaagtactgatgatctttccacatgttggcttccctggtagtggggaaacagccagagatgtgtgtgggagagcaaagtgatgaaagagtcccaaacctggaatatagaaggagaaagcatgaataggagaaggatggaatgaaaagccagttggaggactgaaatgatgcaggaaggagggggagagagagagaaagaaagggagatagatagatagatgatagatagatagatagatagatagatagatagatagatagatgatagatagatagatagatagatagatagcagcaaacagagagggcagaggcaggggagatgagggagcgatggaggagagagacaggaggttgtactacaaggtgacaagcagaaagccaggagcaggaagaaagcacaggaacatgtcttcctgacagctgtgcagtgatcaaaatatgaaacaccacaagttccccttttcttttccttaccacaagctcttaactttagctatgagaaattaaagctgtttgtaaaacctaaaggtaccactttaggcattgcttttggtgaaaagctagttgctgacatctcagcagtaataaagctgcagggaaagggacaaggacaagaaggcactcctctttcagaagcaagctgcattcatgtgtctgtgtgggaaacacatattgcaagggtagtagactgatatagggtttctcctttaatttttgttaaggagaaaaataatgaaatatcaactcttttgtataatatgccatggagaattccccactatggggcgcaagggatgaaactgaatcattttctcagggacaaaacaaggaattcagaatggaatttgccccgctgctggcattggaaattcattatatcaaacttctaaaatgaaatagagaatttaatttcagaagccataaaaatattgtaaccatcatcattagataccaagaatgtttttgcaggtattgtaagagtaaggagactcagagaaaacagtcattttctttaaatgttgatttttccaaagctccacggtgttttaattcaccataagcgtgaattgttacttgaccctgatagagtattatgcgcaatatcttgcatagtttaatgagctctaatggagaaatgcttcccatactgaaatctctgtaatactgtgattttagctttcacataagctcttcctttcctctctcctgaaatatgggttaggttacattttacaatgattcaagtctgactaccttttaatggtgcctgtggcatgggtatggctttacaatggtatttatttgggaaggacagaggaaaaaaccattatgacaacttgtaagagtccagcattggttatccattggtaactagcagccttagaacagttaatacagacttaaccaagtggctgatcaaccagcatacttgtaaggctcgttgttaagaaaaaaaattataatcaaataatccctttttatcttaagatccttttgtggagagtgtgggtggtgactggtgagaagccaaaaagtattgtgccaaatattttcaaaatattacttagtaatagctataatagatttctcaagagaccagtagtgatatatattgtctatttcaaggcaattataaaatgtgagatccatttttaaaattgcgtgcaaagaaagacgattatttagatataggggagtacttactgaagaggacctaaatgatcagttctaactgagaaatagcagaagccagtgacttggccatgggatgtgttttcaacttgcaccatctaaatgtcaaattcaaagttcttagagatcaaatgaggcctaaataaggatcacttgctttctatgagactagtgtaaggtctcacagaaacatccacaagaaacaacagcagacagggaactatgacctccccaaatggacaaaccgagaaacaactgactgaccctaatgagatgatcatatgtgagccctctgaccaataattcaaaatagtagttttaaggaaatgcggtcatctccaagataacacagaaaatcaattgtggaatttatgagagaaataaatttatgtatgtatgtatgtatttatttatttttagtttttgtagagacggggtctctctatattgcccaggctagtctcaaactcctggcctcaagtgatctgcctgcttcagcctccccaaatgctggtattacaggcatgagccaccatgcccagcctatgagagaaatttaacacagagattgaaataataaaacaaatcaaacagaaatcttggaacagaaatatttattttctaatgaactgaaaaattcattagaggccctcatctgcagactggatcaaacaaaaaagaatcagtgggctcaaagataggctacttgaaaacacatagtcaaaggagaaaaaagaatgatagggaatgaagatcatctgcgagatacagaaaattacctcaaaataacaaatctaagaattattggtgttcaagaggaatttgagcaagatcaaggggtagaaagtttattcaaagaaatgctgacagaaaactttccaaaacttgagaaagaaagaaatatatcaggtacaggaaggttagataacaccaaacagataaaactcaagtaaaactacccaagggcatataataatcaagctatcaaaggtcaagagcaaagagagaatcttaaaagcagcaaagaaaagaagcaagtaacatataaaggagttccaattcatctggcaacaaacttctcaatggaaaccatacagattgggagtgggagagagttttattacattttcaaaatgctgaaaaaaatactgtcatttaataatactgtatccagccaagctactcatcaaaaatgaagaacagataaatactttcccaggcaaacagaagctgagagaattttccaccatcaaatccatcttacgagaaattctaaagggagttattcaatctgaaaaaaaaagccactaaatattcaacaataaaccatttgaaagtataaaacccactggtaaaattaagtacacagacaaacccagaatactctaatactgtaattgtggtgagcagtctactcatatctctagtatgaagcccaaaagccaaatctatcaaaacaataatagctacaacaacctgttaagagatatgcaataagaaagtatgtaacttgagacaacaaaaagtcaaaatatagagggatggagttaaagtgtacagggttgtttttatttgtttctattatttttgtcatctcattaaaataacttgttatatctataagatattttttgcaagcctcatggtaaccacaatgcaaaaaactataatagatacacaaaaagtaaaaaagcaatgaattaaaatatagtgccagagaaaatcatttaaccacaaaggaagtcagtaagaaaggaagaaagaagcagaaaaattgtgaaacaaccagaaaacaagcaacaaaatggcagtagtaagtccttaccaataatagcactgaatgcaaatgaaccaaattctcgaattaaaaacataaaactctattttccagaatggataaaaacaaaacccaactgtatgttgcctacaagaaacccatctcacatataaagacaaacacagactaaaagtgaaggaacagaaaaagatattctgcccaagtggaaactaaaaaagagcaggctcaactatacttacattagataaaatacactacaaatcaaaggctataaaaagatacaaagaaggtcactataaaatgataaaggaatcaattcagcaagtagctataaccattataaatatctacacaggcaacaccagagcttccaagtatataaatcaaacattagcaggtctgaatggagagatagactgaaatgcaatagtaatagaggacttcaacaccccactttcagtaatggacagatcatctagacagaaaattgacaaagaaacatttcagctaaactacactctagatcaaatggacctaactaatgttacagagtatttcatccaaatgctgcataatacacattcttttcatcagcacatggaacattctccagaataaaccataccttgggccacaaaataattctcatcaaattaaaaaaaaagtgggaatcatatcaaggatcttttctttctttcatgattttaacttttattttagattcagggggtacacgtgcaggtttgttacatgggtatattgtgtgatgctgaagtttgggatatgaatgatcctatcacccaggtagtgagcataggacccaaaagttagtttctcatttctccccagtccctcactccatcttctagtagtccccagtgttaattattgccatctttatgtccacaagtacccaatgattagctcccacttataagtgagaacatgcagtatttggttttctgcagttatgttaatccataggatagtggcctccagctgcatccacgttgctgcaaaggaaatgatttagttattttttatggcaatgtgatattccatagtgtatcatgtaccacattttctttatccaatctaccattgatgggcacctaggttgattccatgtctttgctatttgaatagtgttgtgatgcccatacaagtgcatgtgtctttttggtagaatagtttactttcttttggatatatattcagtaatggaattgctgggttgaatggtagttctgttttaagttatttgagaaatctccaaactgctttccatagttgctggactaatttacattcccaccaacagtgtataagcatttccttttctttgcagcctcaccagaatctgttgttttttgacgttttgttaatagccattctgcctggcatgagatggtatctcattgtggtttcgcttcgcatttctctgatgagtaatgatgtggagcatttttttcgtatgtttgttggccacatgtcttcttttgagaagtatctgttcatgtcttttgaccactttttaatggggttatttattttttgcttgtgaaattgtttatattccatataaattctggatattagactttttccaggtacatagtttgcaaatattttctcccattctgtaggttgtcttttcactctgttgatagtttcttttgctgtgcagaagctctttaggttacttaggttctacttgtcaatttttctttttggcaattgcttttgaggacttagtcataaattctttcacaaggtcaatgtctagaatggtgttccctgggtttgctcctatgattcttttagttttaggtcttatgtttaagtatttaatccattttgagttgatttctctatatggtgaaaggtaagggtccagtttcattcttctgcatatggctagctagttatcccagcatcatttattgaataggcagtcctttttccattgcttattttgtagttattttttcccgatcctctccctcctcccaccctctgccctccagtaggccccagtgtgtgttgttcctttgtatgtgtccatatgttcttatcatttagctcacacttataagtgagaacatgaggtatttggttttctgttcctgtgttagtttgctaaggataatggcctccagctccatccatgttgctgccaagaacatgatctcattcttttatggcttcatagtattccatggtgtatatgtactacattttctttatccagcctatcactgatggacatttaggttgattccatgtctttgctattgtgaatagtgctgcaattaacatttgcatgcatgtgtctttataatagaatgatttatattcctttgagtatatacccagtaatgggattgctgagtcaaatggtatttctttctctagatctttgaggaatcaccacaccgtcttctacaatggatgaactaatttacactcccaccaacagtttaaaagcattcctttttctccacaacctcgccagcatgttattttttgactttttaataatagccattctgactggtgtgagatggtatctcattgtggttttgatttgcatttctctaatgattagttatgtggagctttttaaatatgattgttggccacatgcacgtcttcttttaagaagtggctgttcatgtccgttgctcactttttaatggggttgtttgtttttttcttgtaaatttaagtttcttatagataatgggtattagacctttgtaagatgcatagtttacaaaaattttctcccattctgtaggttgtctgtttactctgttcacaatttcttttgcagtgcagaagctctttagtttaattagatctcgtttgtcaatttttgtatttattgcaatttcttttggttgtctttatcatgaaatctttgcttgtgcctgtgtcctgaatgagattgactaggttttcttctattttttatagttttgggttttacatttaagtatttaatccaactggagttgatttttgtatatggtataaggaaggggtccagtgtcagttttccacatatggctagcctgttctcccagcatcatttattaaatatggaattctctccccattgcttttttttggtcaggtttgttgaaaataaggtgtaggtgtgtggtctcctttccgggttccctattctgttccattggtctatgtgtctgttcttgtaccagtaccatgctggtttggttactactgccttgtagtatagtttgaagtcgggtagcgtgttatctccagctttgttctttttgcttaagattgccttggctcttcagactcttttttggttccatatgaattttaaaatagttttttctagttctgtgaagaatatcaatagtagtttaatgggaatagcattgaatctataaattgctttgggcagtatggccattttcacaatattgattctttctatccatgcccatggaatgatttccaatttgttagtgtcatctctgatttctttgagcagtggtttgtagttctacatgtagaggtccttcatttcccttgttagctgtatttctaggtattttattcttttttatggcaattgtgaatgggagttcatttgtgatttagctcttggcttgcttgtcggtggtgtatagaattgctagagatttttgcacactggttttgtatcctgagactttgttgaagttgcttatcagcttaagaagcttttgggctgagattatggggttttctagatataggatcatgtcatctgcaaacagggatagtttgacttctcttcctatttgaatagactttatttctttctcttgcctgattgccctggccagaacttctaatactatgttgaataggagttgtgagagagggcaactttgtcttgtgccagtttacaaggggaatgcttccagcatttgctcattcagtatgatgctgcctgtgggtttgtcatagttggctcttattattttgaggtacgttccttcaatacctagtttattgagagtttttaacatgaaaggatgtttaatgttatcaaaagtcttttctgtacctattgaggtaatcatgtagcttttgtctttagttctgtttatgtgattattaattttcatatgttgaatcaaccttgcatcccaaggatgaagcctacttgatcatggtggataagctttttaatgtgctgctggattcaatttgcaagtattttgttgagaatttctgcatctatgtttatcaagaatattggcctgaagttttctttttttgttgtgtctctgccaggttttagtatcagaatgatgctggcctcatggaatgagttagagaggagtccttccttttccattttttggaatagtttcagtaggaatgataccagctcttccttgtgtatctggtagagtttagttgtgaattcacctggtcctgggattttttttttttttggttggtagactatccattactgtctcaatttcagaacttgttattggtctgttcagggattcaatttctttctggttcagtcttgggagggtgtatgtgtccaggaatttatagatttcttctagatgttctagtttatgtgcatagacatgttcatattattctcttatggttgtctttatttctgtggtaatatcccccttgcagtttctgattatatctatttaaatcttctctctttttttctttattagtatagctagcagtctatctatttcattaatttttcaagaaaacagctccagtattcattgattttttgaatggtttattgtgtgtctatctcctttagttcagctctgattttggttatttattttcttctcctagctttgggacttgtttgctgttggttctctagtacttttagttgtaatgttaggttgttacttgagatcttcctattttttatgtcagcatttagtgctataaatttctctcttaacactgccttagctgtgtcccagaaattctggtacattgtatctttgttctcatcagttacaaagaactttttgatttctgctttaatttcattatttacccaaaagtcattcaggaacaggttattcaacttccacgtaattgaatagttttgagtgaatttcttagtcttaattttaaatttgatcctgctgtggtccaagagactttttattattatttcagttcttttgcagttgctgaggagtgttttacttccaattattgactaattttcaagtaagtgccatgtggcaattagaaaaatgtatattcctttgtgcttgggtggagagttctgtagatatcttatcaggtttatttgatcaagagctgagttcaggttctgaatatttttattaattttctgtcttagtgatctatctaatattgtcagtgtggcattaaactctctgcctattattgtgtgggagtctaagtctctttgaaggtccctaagaacttgctttatgaatctaggtgctcctgtgttgggtgcacatatattaaggatagctaggtcttcttgttgaattgaaccctttaccattatgtaatgcccttctttgtcttttaaaatctttgttgatttaaagtctgttttgtcagaaactagaattgcaacccctgcttttcctgtttttcatttgcttggtagattttcctccacccctttattttgagcctaggggtgtcattgcatgtgagatgggtctattgaagacagcataccaatgagtcttggttctttacccagcttgccactctgtgtcttttaattggggaatttagcctatttacatataaggttagtattgatatgtgtggatttggtccttgcatcatgatgttagctggttattttgcaaacttgtttatgtggtttctttataatgtcactggtctgtgtacttcagtgtgtttttgtcatggctggtaagggtcttttctgtccatatttaatgcttccctcaggggctcttgtaaggcagatctagtggtaacaagtacctttagcatttgcttgtctgaaaaggatcctttttctccttcacttatgaagctttgtttgggtagatatgaaattctgggttggaatttcttctctttaaaaatgttgaatattggccctcaatctcttctggcctataggatttcagctgagaggtctgctgttagcctgatgggcttccctttgtgggtgacctagcctttctttctagctgtttttaacattttttctttcatttcaaccttggagaatctgatgattatgtgtcttggggatgatcttcttgtggtgtatcttgctggggttctgtgcatttcctgaatttgaatgttcgcctctctagcaaggttggggaagttctcatagatgatatcgtgaaatgtgttttccaagttggttccattctccctgtctctttcaggtatgccagtcacagattcagttgctttatataatcttatatttcttagaggttttgttcatttcttttcattctttcttctctattcttgtctgcctgtcttgtttcagaaagccagtcttcaagctctgagactctttcctctgcttggtctattctgctattaatacttgtgatgggattatggaattcttgcagtgtgttttacagctctatcaggttggttacctacttctctatactgactagtttatctgtcagctcctgcaatgttttatcatgatttttagcttccttccattgggttacaacatactcttttagctcagtgaactttatttctgtccgtattctgaattctacttttgtcattttggccatctcagcctcagccttggtctgaacccttgatggagaggtgatgtggtcatttggaataaagagggcactctggatttttgagtttccagcgttcttgcactgattctttctcatctttgtgggcttctccatcttcaattcttgagattgctgaactctggacctttttttttcttttaatagtctggccacttttctgtagggctgctgcagtatactggggttccactcacccctagtcacctcagattttccagtaactgaaagtatcaccagtctgtgaaacaacaaagatgaaagcctgccccttcctctgggagctccatcccagggaagtacagacctgttgctagcctgaacacacctgtaggaggtggctggagaccccagatgggaagtctgacccagtcagaaagaatgggattgggacctgctttaaaaagtagcctgacaaagttttcacacagcaattgtgctatgctgggggtccacttcagcccctggttgcctcagacactgtgaagcccaaaggctggaatggctaagttgcacaaacagcaaagatggaggcctgccactcctcccgggagctgtgtcccaaggaggcctgaaacctctgtcagctggagaacgctggtgggggtagctggagaccctggttgggaggctctacctggtgatgaagaacagggttaaggacatgcttaaaaaagcactctggccatgtttttgtggggctgttgtgctgtgctggggtactgtgtccactcctgttcagtttaggccctccaaagcccaaaggctggaactgctaagttgtccaaacagcaaatatggtggcctacccctccctctgggagttccatcccatggagctttcaaatcactttcagctgtagaacactggcagtgttggttggaggccctggttgggagtttctgcccagtgagaaggaatggaatcagtggccacttaaagaagcagtctggccattctttggtagagcagttgtgctgtgctgggggatcccttctgtcccagttggtttggactctccaaagcccacaagctggaatggcttgcccaaagatggcagccttcccctccccttggaagctctgtcccagggaagcacaacactgctaccagtgactggctgaaattcccagccagtgggccttgtcctgtgaggcattgtggaagtggggaccgcagactgtcactgcttggcttcctggattcaggctctttcctagaagtatgtagggggatctaacttcccagtttgccagagttgcagttactttttctgggaagcccagagccagacagagtatctaaagctcctgggtctccatgaatgcctgagtggctgctctgccaaggctctgatacaggaggggggcagggatgtgctgggtagagaagggcagggtccctggcaagggctgcaccatcaggctcgttcccatgaacctaagtgagaactggcactcctgttttcatacccaaatgttgcattttccaagaccactctggcctgccatgcctctcatcctgtgcccataaaaacctgagaccatagcagacacacacacaagcacctgggtgtcaagaggagcagaacagcacaccgacagacaccagcagacaccggcaggccatcggatggccagatggtgtggaattcggtcaggggtggttggaagagtctggccactgggtggcccaactccaggggaagaccgtcttcccactccattccccttttggctccccatccatctcactgagaactacttccgccactcaataaaacctttcactctttctccaagcccatgtgtgatccaatttttccagtacactagggcaagaacccaggatacagaaagtgaccctacccaaatctcatgtcgaatcataatccccaatgttggaggaggagccttgtgagaggtgattggatcatgggggcggactttccccttgctgttctcgtggtagtgagttctcatgagatctggttgttcaaaagtgtgtagcacctcccccttcgctaccttcctctttctctggccatctaagatgtacttgctttcccttcaccttccaccatgatggtaagtttcctgaggcctccccagccatgcttcctgtacagcctgtggaactgaatcaaattaaacctcttttatttataaattacccagtctcaggtagttctttatagcaacgcaagaacagaataatacacacatgtaccctgaaaatatgtacagctattaggtatcaaaaaagaaaagaccactacaagccaatatctctcatgaccacagttgaaaaattattaacacaatttcagcaaatattaataaaatccaacaatctaaaggaatgaaatatacattctgaccaagatgtgtgtatcccagaaatacaaatgtggttttacatttgaaaagcaatttaattttctttaatattctaaaaatgtataatgatctcatagatgaagaaaacaattgacaaaacccaacatccattactgataaaatgtctctcagaaaaatgtgaatagacaatacctctcccaagctggtaaagggcaatttcctacaagtaagataacattaaatgagaggccaaatgctttccacacaatattaggaaaaaagggaagaataatcactcttcaccacttctgtttaaagtgcaataagcaataaagtaagaaaatgaaataaaattaacattatcagaaaggaagaagtaaaaatgtctttatcaggagatgatatgtagaaaatcctaaggaatctacaaaaggctactagaattaatgataagttgggaagttttcaggatataacattgatctatagtaataaactatatttctatactctagcaatgaattctatatactggttaaattaatgaaccagcaatgtagtagaaattgagataatgcattaataaattgataaaatattttcaagacctgcacattactatagcacactaagtgactacattacttagggtaattaaagaaaatgtaaataaatggagaaattagctgtattcttagatttgtagacttaatgttgttaaggtatcaattttctccaaattgttttatacatttaattcaatcacagttaaaaccccagaaggctttttccatagaaattgacaaggttattataaaatttatctgatagtgcaaatgccttacaatataagaaacaattttgacaagagcaaattaaagaacttacactatatgacttcaagagttattacaaagtagtagtaattaaaaccatgaaatattgaggtataaatgaacagaagtaaagttaataaagatacacatagaagttcaatcaatttttgacaaagttgacaattcaataaataaaaaatattttcaataaatactatgaatacaattggattactattaacaacatagtaaatttcaatcactacttcatacaatatacaaaaagtaactgaaaaggattataaacctaaatttaaaaactaaaactataaattattagaagaaaatgtaagacatagagaaaagatcttattgacattgtgtttagcaatgatttcttaagtcagacacaaaaagagcaaactatataagaacaatatcaataaattgaacttaatcaaaattaaaatcatttggctttcaaaatacactattaagaaagtaaaaatgctgccgggcgccgtggctcacgcctgtaatcccagcactttgggaggcccaggcaggcggatcacgaggtcaggagatggagaccatcctggctaacacggtgaaaccccatatctactagaaatacaaaaagaatttagccaggcgtggtggcgggcgcctgtagtcccagctactcggtaggctgaggcaggagaatggcatgaacctgggagacagagcttgcagtaagccgagattgcaccactgaactccagcctgggcgacagagagagactctgtctcaaaaaaaaaaaaagtaagtaaaaatgcaatttaaagagtattaaaaatacttgtagacatacatatgatacttgtatctagaatgtgtagaaaccttcacaattcaaacataagaatacaaaacatgcaataaaaatagggaaaatatttgaagagacacttcacaatgcagataaactgaaggcaaatcagatatgaaaatatgctcaacatctttagttattaggaaaatacaaattacaaaaaaataagatgcccctacacaacaactaagatggctaaatttaaaacatagattgtccatattaagtgttgtcaagtgtgatgaccagttgaaacttgcgtacactttgtggtaatgtaaaataataccaccactttggaaaatggtttgctggtttcttaaaagcttaaacactcacctaccatatcatctagccataacactcatgcatttacccaagtgaaaagaaagaatgtgatgtgatggttaattttatctgtcaatttgacgaagaatgctcttatagatagctcttattattttgagatacgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttccatcccagggatgaagcccacttgatcacggtggataagctctttgatgtgctgctgaaatcggtttgccagtattttattgaggatttctgcatcagtgttcatcaaggatattggtctaaaattctcttttttggctgtgactctgcccggctttgctatcaggatgatgctggcctcataaaatgagttagggaggattccctctttttctattgattggaatagtttcagaaggaatggtaccagttcctccttgtacctctggtagaattcggctgtgaatccatctggtcctgaactttttttggttggtaagctattaattattgcctcaatttcagctcctgttattggtctattcagagattcaacttcttcctcgtttagtcttgggagaatgtatgtgtcgaggaatttctccatttcttctagattttccagtttatttgcgtagagatgtttgtactattctctgatggtagtttgtatttctgtgggatcagtggtgatatcccctttatcatttttattgcatctatttgattcttctctctttttttctttattagtcttctagcggtctatcaattttgttgatcctttcaaaaaaccagctcctggattcattaattttttgaagagttttttgtgtctctatttccttcagttctgctctgattgtagttatttattgccttctgctagcttttgaatgtgtttgctgttgcttttctagttcttttaattgtaatgttagggtgtcaattttggatctttcctgctttctcttgtgggcatttagtgctataaatttccctccacacactgctttgaatgcatcccagagattctggtatgcacagccaatatcataccgaatgggcaaaaactggaagcattccctttgaaaactggcacgagacacggatgccctctctcaccactcctattcaacacagtgttggaagttctgcccagggcaattaggcaggagaaggaaataaagggtattcaattaggaaaagaggaagtcaaattgtccctgtttgcagatgacatgattgtatatctagaaaaccccattatctcagcccaaaatctccttaagctgataagcaactgaagcaaagtctcaggatacaaaatcaatatgcaaaaatcacaagcattcttatacaccaacaacagacaaacagagagccaaatgatgagtgaactcccattcacaatggcttcaaagagaatgaaatacctaggaatccaacttacaaaggacgtgaaggacctctttaaggagaactacaaaccactgctcaaggaaataaaagaggatacaaacaaatggaagaacattccatgctcatgggtaggaagaatcaatatcgtaaaaatggccatactgcccaaggtaatttacagattcaatgccatccccatcaagctaccaatgactttcttcacagaattggaaaaaactactttaaagttcataaggaaccgaaaaagagcccgcatcaccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctatgactatctgatctttgacaaacctaacaaaaacaagcaatgaggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaaggaaatgtaggcattaccattcaggacataggcttgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttctcaacctactcatctgacaaagggctaatatccagaatctacaatgaactcaagcaaatttacaagaaaaaaaacaaacaaccccatcaaaaagtgggcaaaggacatgaacagacacttctcaaaagaagacatttatgcagccaaaaaacacatgaaaaaatgctcagaatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactggaaactagttcaacccttgtggaagtcagtgtggtgattcctcagggatctagaactagaaataccatttgacccagccatcccattactgggtatatacccaaagtactataaatcatgctgctataaagacacatgcacaagtatgtttattgcagcattattcacaatagcaaagacttggaaccaacccaaatgtccaacaatgatagactggattaagaaaatgtggcacatatacaccatggaatactatgcagccataaaaaatgatgagttcatgtcatttgtagggacatggatgaaattggaaatcatcattctcagtaaactatcacaagaacaaaaaaccaaacaccgcatattctcactcatagatgggaattgaacaatgagaacacatggacacaggaaggggaacattacactctgggactgttgtggggttgggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaataaaatttaaaaaaagaaaatgtggcacatatacaccatggaatactatgcagccataaaaaatgatgagtttgtgtcctttgtagggacatggatgaagctggaaaccatcattctcagcaaactattgcaaggacaaaaaaccaaacactgtgtgttctcactcatatgtggtaattgaacaatgagaacacatggacacaggaaggggaacatcacacattggcgcctgttgtggggtgagggggcggctgatagcattagaaggtatacctaatgtaaatgatgagttaatgggtgcagcacaccaacatggcacatgtatacatatgtaacaaacctgcacgttgtgcacatgtaccctagaacttaaagtataataaataaataaataaataaataaataaataaagaagaatgctctcaccaatgtaagtgggcatcacccaatctgatgagggcctgaatagaaaaaaaagtccactgatggtagttttggcataggcattgcacatagggaatgcaaatctgtatccagagtatctatttcgctaagtacaaagcactgtcccttccataagggaagctatccagtgtaatcaactgtccaccaggttgatcaccctggagactggtgccataacctggactgaatgttggtctctgctgctggcaggttggacactcaccagtagccatagccaggtcagctttggtgagtagaagttcatgttattgagcccatgcagaaccatcatccctgctaccatggccactgttcataacctcactggacaatgataagagtaaccaggaatagaagcttactggtaaccacaaaattgatcaatcctttccacttaagtattaaaatactcctctgctgaggtcaccctttggtgaacatttacatggaacacaaatatcttcacatttattgcccattaaaagaggtctggctggacaaggtggctcacgcctgtaatctgagcactttaggaggccaaggcgggtggatcacctgagttcaggagttccagaccagcctggccaacatggcaaaaccccatctctactaaaaataagaaaattagctgggcatggtggcaggtgcctgtaatcccagctccttgggaggctgaggcaggagaatcacttgagccttggaggcggagtttgcagtgagccaagatcaagcccttgcactccagcctgggtggcagagcaagatctgtatcaaaaaaagaaaaaaaaagtctacccacatgtctcttccctagaaatatttgtcaccaattttccaattatgctctttccaagtccctgactgtgtttataatttgtatttccctagtaagccaaatcatttgctacagctcacgaatcagtacataatagtgtgtctggctatttctccttccaagcaaagtgtgcaaccaggtacactgcccaaagttcttcccattggaaagatttcccttcataagtctcaattaagaatatcccagagtgggctatagtgctgcatctgtccaattttgagtggtatccacatacgcagagctgtctgtaaactggccccaagtcttctcctcttctgacaacttattgtaaggtactctgcatgagaccataggtatgagctggaagagagaagatggtgtagaaggactgaggaccatgagcatttcaatcactcttttatgtaacttaattgtgcattcagagcctgcttaggcctgatctgtatagaccatttccatttgatgatggtgtgtagctagcttaatcagataacacccactcatgaatggcaactcaggttacatggtaacttagtagcccatggtctagcattcagtttctactaaagcccagtagcagaccaagagctgtttctcaaaaggagaataattatctgaggataatggcagggacttgtttcaaagtcctgaaacattgcactgtgattcacctataggggactgccaaaggttccaaacagcatctttatctcccactgtcacttcaagcaccactggatctgatgcatcatatggcccaagtggcaaagcagcttgcacagcagcctagacctcttgcaggtcttctcctgttctgggcaccactcaaaactagcagcttttcaggtcactcagtgaatgtgtcagagtaacacatccatataagtaatatgttgcctccaagacccaaacaggcccacaacacattgtgtatcttttttggttgtaggagaatctggatgaaacaacgtattcttcactttagaaggaatacattgacatggcccacatcactggacctaaagaaatttcactgaattttagtcagatttatttcccaccctctgacacagaagtaagtctagagtcgttgctacttcttgctcactagctccaatcaccacaatgtcattaatgtaatggaccagtatgatatcagtatgaagggaaagatgatcaaggtccatgcaaagtaaattatggcatagagctagagaattgatgtaactctgaggtatgtagtgaaggtgtgttgctggccttgccaactgaaaacaaacagctctggagggccgaccttgtggaaaagtatgaagaaaaaggcatataccagattaatggctacataccaggtaccagggaatatgttaatttgctcaagcaacgaaacaacatctagcacagcagtgcaattgaagtcaccatttggttaagcttacaagatttcatcatcattctccaaggtccatttattttctgcagagttcaaagagaagaattgaatggagttgtagtgggaatcactacacctgcatctttgaaattgttgataatggcactgatttctaccgttcctccagggatatggtgttgcttttgatttactattttcttaggtagaggcagttctagtgggttccatttggcctttcccaccacagtagccctcatggcacagggcagggaaccaatgtaggaattctgcaagctgctaagtatgtctattccaattatgcattctgaaactagggaaataactacaggatgtatttggggacctactgtgagacagacctgaggtaaaacttcaatgatcacctgacctccatgagctcctactctgactggaggaccacagtgacatttgggatttcctagagtcagtgtcagttcagagctggtgttgagtagttcccaaaaggcctttttctttcttttctccaatgcacagttactcaggtaaaaggccataggcccctttggagaaggctggcagaaatattagcagcataaaattttgttagtgtattggggtctgtcctcaaggaaaaccagcatcccgttcattcaaggagttctgggtctgtaaactggctcaagcctggtaattggttgaggggccatgactctctttttaatgattcaagttagatatttgttcacttgacctagaaattttctgtttatacatatcgagtaaagtttgatcttataagatcaagcataaataacttgccaatgccatgagtcaggctattctgattgctgccttgactctgctgtccatcatggtaaccattcccatgttgcctttggatgatgagtgacatctcttggccttgccacccgaggattcagttactcccagtgcacttaggttttccaattgggaggctatggtttccactgtaaagtctagtctatagagaagagtaatcaaggagctctttaaggatactggggctccactcacaattttatttcttaaagtattgatgaaaggtatgtctctagagcctcctttgtgaatgagtagatcttaaatgacaaatccactgtaacattccaatctccctaagcttttgaatcccttcctctacattaaatcaagggaagttgggcatttccaattcactcaccgtgggccatattttagtccacatttcagcacaccaaccaaactgttagagccatttctaattccccaagttgcaacattaaatgcagaatctctgctaagtcaactgttatcaatatatagttggcctgatcaaattttttccttctgcaattagaatgaataaaaactagatgcctatttcttgccatatacaaaagtagaatgaaactagatacctatcttttgccatatacaaaaatcaaatcaaaatggattgaagacataaatctaagaccataaacaatgaaattattatgagaaaacattggtgaaaatctccaggactttggtctgggcaaaaatttcttgagcaatatgcaacaagcacaggcaaccaaagcaaaaatggacaaatggaatcacatcagattaaaaagcttctgcacagcaaagaaaactatcaacaaagtgaagaggcaacccacagaatgggagaaaatacttgcaagctacctacctttttattttttgtgggtacctagtaggcatatatatttgtagagtgcatgagatattgtgatacagccatacaatgtataataataacatcatggaaattgggtatccatcatctcaattatttatcctttctttatggtacaaacaaaccaattatactcttttagttatttattttattttattattattatactttaagttttagggtacatgtacacaatgtgcaggtttgttacatatgtatagatgtgccatgttggtgtgctgcacccattaactcgtcatttagcattagatatatctccaaatgctatccctccccccaccccccaccccacaacagttcccggagtgtgatattccccttcctgtgtccatgtgttcacattgttcagttcccacctatgagtgagaacatacagtgtttgcttttttgtccttgtgatagtttgctgagaatgatggtttccagtttcatccatgtccctacaaaggacatgaactcatcactttttatggctgcatagtattccatagtatatatgtgccacattttcgtaatccagtctatcattgttggacatttggcttggttccaagtctttgctattgtgaatactgccgcaataaacacacgtgtgcatgtgcctttatagcagaatgatttataatcctttgggtatatacccagtaatggaatggctgggtcaaatggtatttctagttctagatccctgaggaatcgccacactgacgttcaaaaaggttgaactagtttacagtcccaccaacagtgtaaaagtgttcctatttctccacatcctctccagtatctgttgtttcctgactttttcatgatcgccattctaactggtgtgagatggtatctcattgtagttttgatttgcatttctctgatggccagtgatgatgagcattttttcatgtgtcttttggctgcataaacgtcttcttttgagaagtgtctgttcatatcctttgcccactttttcatggggttgtttgtttttttcttgtaaatatgtttgagttcattgtagattctggataatagccgtttgtcagatgagtaggttgtgaaaatttcctcccattctgtacgttgcctgttcactctgatggtggtttcttttgctgtgaagaagctctttagttgaattagatcccatttgtcaattttggcttttgttgccattgcttttggtgttttagacatgaagtccttgcccatgcctatgtcttgaatggtattgcctaggttttcttctagggtttttatggttttaggtctaacatataagtctttcatccatcttgaattaatttttgtgtaaggtgtaaggaagggatccagtttcagctttctacatatggctagccagttttcccagcaccatttaataaatacggaatcctttccccattgctttttttttttcagatttgtcaaagatcagatggttgtagatatgcagcattatttctgaggactctattctgttccattgatctatagatctgttttggtaccagtaccatgctgttttggttactatagccttgtagtatagtttgaagtcaggtagtgtgatgcctctggctgtgttcttttggcttaggattgacttggcgatgggggctttttttggttccatatgaactttaaagtagttttttccaattctgtgaagaaagtccttggtagcttgatggggatggcattgaatctataaattaccttgggcagtatggccattttcacagtattgattcttcctacccatgagcatggaatgtttttccatttgtttgtatcctcttttatttccttgagcagtggtttgtagttctctttgaagaggtccttcacatcccttgtaagttggactcctaggtattttattctctttgaagcaattgtgaatgggagttcactcatgatttggctctctgtttgtctgttattggtgtataagaatgcttgtgatttttgcacattgattttgtatcctgagaccttgctgaatttgcttatcagcttaaggagatttttggctgagacaatgggattttctagatatacaatcatgtcatctgcaaacagggacaatttgacttcctctttttctatttgaataccttttatttccttctcctgcttaattgccctggccagcacttccaacactatgctgaatagatgtggtgagagagggcattcctgtcttgggccagttttcaaagggaatgcttccagtctttgcccattcagtatgatattggctgtgagtttgtcattgacagctcttattattttgaaatacgtcccatcaatacctaatttattgagagtttttagcatgaagggctgttgaattttgtgaaaggccttttctgcatctattgagataatcatgtggtttttgttgttggttctgtttatatgctggattacatttattgatttgcgtaagttgaaacagccttgcctcccagggatgaagcccacttgatcatggtggataagctttttgatgtgctgctgtattaagtttgccagtattttgttgaggatttttccatcaatgttcatcaaggatgtgggtctaaaattatcttttttggttgtgtctctgccaggctttggtatcaggatgatgctggcctcataaaatgagttagggaggattccctctttttctattgataggaatagtttcagaaggaatggtaccagctcctccttgtacctctggtagaattcggctgtgaatccatctggtcctggactttttttggttggtaagctattgattattgccacaatttcagagcctgttattggtctatttggagattcaatttcttccttgtttagtcttcagagggcgtatgtgtccaggaatttatccatttcttctagattttctagtttatttgggtagagatgtttgtagtattctctgatggtagtttgtatttctgcgggatcggtggtgatatcccctttatcattttttattgcgtgtatttgattcttctctcttttcttctttattagtcttgcttgcggtctatcaattttgttgatcctttcagaaaaccagctcctggactcattaattttttgaagggttttttgtgtctttatgtccttcagttctgctctgatcgtagttatttcttgccttctactagcttttgaatgtgtttgctcttgcttttctagttcttctaattgtgatgttagggtgtcaattttggatctttcctgctttctcttgtgggcatttagtgctataaatttccctctacaaactgctttgaaagtgtcccagagattctggtatattatgtctttgttctcattggtttcaaagaacatctttatttgtgccttcatttcgttatgcatccagtagtcattcaggagcaggttcttctgtttccatgtagttgagtggttttgagtgagtttcttaatcctgagttctagtttgacttcactgtggtctgagagacagtttgttataatttctattcttttacatttgctgaggagtgctttacttccaactatgtggtcaattttgtaataggtgtgatgtagtgctgaaaaaaatgtatatactgttgatttggggtggagagttctgtagatgtctattaggtacacttggtgcagagctgagttcaattcctggatatccttgttaactttctgtctcgttgatctgtctaatgttgacagtggggtgttaaagtctcccattattaatgtgtgggagtctaagtctctttgtaggtctctaagaacttgctttatgaatctgggtgctcttgtattgggtgcatatatatttaggatagttagctcttcttgttgaattgatccgtttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcctgactctttatccaatttgccagtctgtgtcttttaattggagcgtttagtccattgacttttaaagttaatattgtcatgtgtgcatttggtcctgtcattatgatgttagctggttattttgctcgttagttgatgcagtttcttcctagccttgatagtctttacaatttggcatgtttttgcagtggctggtaccggttgttcctttccatgtttagtgcttccttcaggagctcttgtagggcaggcctggtggtgataaaatctctcagcatttgcttgtctgtaaaggattttatttctccttcacttatgaagcttagtttggctgaatatgaaattctgggttgaaaattcttttctttaagaatcttgaatattggccccactctcttctggcttgtagagtttctgctgagagatccgctgttagtctgatgggcttccctttgtgggtaacccgacctttctctctggctgcccttaacatttttttccttcatttcaactttggtgaatctgacaattatgtgtctttgagttgctcttctcgaggagtatctttgtggcgttctctgtatttcctgaatctgaatgttggcctgcctttctagattggggaagttctcctggataatatcctgcagagtgttttccaacttggttccattctccctgtcactttcaggtacaccaatcagacgtagatttggtcttttcacataatcccatatttcttggaggctttgttcatttctttttattctgttttctctgaacttcccttcacacttcatttcattcatttcgtcttccatcactgataccctttcttccaggtgatcgcatcggctcctgaggcttgtgagttcttcacataattctggagccttggctttcagctccatcagctcctttaaggacttctctgcataggttattctaagtatccattcgtctaatttttttttcaaagtttttaacttctatgccattggtttgaatttcctcctttagctcggagtagcttgattatctgaagtcttcttctctcaactcgtcaaagtcattccccatccagcttttttccattgctggtgaggagctgagttcctttggaggaggagaggtgctctgctttttagagtttccagtttttctgctctgttttttccccatttttgtggttttatctacttttggtctttggtgatggtgacatacaggtgggtttttggtgcggatgtcctttgtgtttgttagttttccttctaacagacagaaccctcagctgcaggtctgttggagtttgctggaggtccactccagaccctgtttgcctgggtatcagcagtggtggctgcagaacagcggtggctgtacaacagtggatattggtgaactgcaaatgctgctgcctgattgttcctctggaagttttttctcagaggagtacccagccgtgtgaggtgtcagtttgcccctactggtgggtgcctcccagttaggctgcttgggggtcaggggtcagggacccacttgaggaggcagtctgcctgttctcagatctccagctgcatgctgggcaaaccattcctctcttcaaagctgtcagacagggacatttaagtttgcagaggttactgctgtctttttgtttatctatgccctgcccccagaggtggagcctacagaggcaggaaggcctcctggagctgtggtgggctccacccagtttgagcttccaggctgctttgtttacctaatcaagcctgggcaatggcaggcgcccatcctccagcctcactgccaccttggagtttgatctcagaacactgtgctagcaatcagcgagactccgtgggcataggaccctccgagccatgtgcgggatataatctcctggtgtgcccttttataagcctgttggaaaagcgcagtattagggtggaagtgacccgattttccaggtgctgtctgtcacccctttctttgagtaggaaagggacctccctgaccccttgtgcttcacgagtgaggcaatgcctcgccctgcttcggctcacgcatggtgtgctgcacccactgtcctgctcccactgtctggcactccctagtgagatgaacccggtacctcagatggaaatgcagaaatcacccgtcttatgtgtcgctcatgctgggagctgtagaccggagcttttcctattcggccatcttggctccacccaaccaatacaatcttctcttttagttatttttaactgcacattacttttatttattctcactctgtcacccagactgagtgcagtggcatgatcatggcttactgcagccttgacctcccaggcttaagtgatcctcccacctcagcctcccatgtatctgagactacgggtgcatgccactacatgcagttaatttttattttattttattttattttttgtagagacaagttctctctatgttgcccaggctggtcttgaacttccagactcaagctgtcctcctgccttggccttccaatgtgctgggattacagacaagagccgtgacacctggcatgtataataaactttcgttgactgtagttatcctgttgtgatatcaaataccagatcttatctactctattttttggtacccattaaccattcacactccccctacccccactacccttcccagactgtggtaaacattgttctactctctatctccatgagttcaagtgttttaatttttagctcccataaatatgtgaagctgcctttctgtttcaggcttatttcacataatataatgtccttcagtttcatccatgttgttgcaaatgacaggatctcattcttttttatgactgaatagtactccactgtgtatatgtactacattttctttacccatccatctattgatggatacataggttgcatccaaatcttggctattgtaagtagggctgcaataaacatggggatgcagatatgtcttcaatatgctgatgtcctttctttggggcatatacccagcagtgggattgctgggttgtatggtagctctatttttagttgtctgaggaacctccaaactgttctccatagtggttgtactaatgtaccttaccaccaacagtgtattaaggttctggtgctttattcagttcatttggtgaattaatgttttcttggatgttcttgatgcttgtggatgttcctcagtgtctgagcattgaagagttaggtatttattgtagtcttcacagtctgggcttggtacccatccttcctgggtaggctttccaggtattcaaagggatttaggtgttgttctaaacctttggtcactgcagctttgtctctattaggggacaccctaagtctagtaatgttatggctcttgtagactctgaggtactgccttggtggtcttgggtaagatcatggaggaattacctggattacctcacagaggttcttgttttctttccttactttaccccaaaccaattgagtctctgtgctgagctgcctggagctgggtgtgggatgacacaagtacctctatggtactcaccactgggactgtgctgggtcagacccaaagtcagcatgccacttggtcttgcccaataccacagtgaccactgcctggctactgcctatgttcacttaaagccaaaatgctctacagtcaataggtggtgaagccagtcagtcttgtgttcttcccttaagggcagcaagttctcccttgccctgggtgggtcaaaagttgctcttctggacctaggacctggagttcagaaccttaggaatctacctggtgctctgttaaactgtggctgagccggcaagaagctgcaagacaaagtccttctcacacttgcctcccctatcctcaagtagaggagtttctccccatagccaccaccaccccaggcccacagcaagcactggctggttaccactgatgattatgcagagcccaagagcttttttgttagcaggtgatagatcctgccaggagttggtccttcccttcaaggtagcatgttcccttctagtccacagtgtgttaagaaatgtcatctgtgagctggggcttgtaatgggagccttgggactattcctgttgccttatcctactgtggctgggctggtacccaattgcaagacacagtcctcttcactccccactctcctctcgtctcttcaaggtgaaggtaggagtctctcctggagctgcaagttgtgatgcctgggtttgagggaagggtgacatgagcactccctaggctgccctagctggtgcatcactacattgtctacactccaagtctacctggctttgagcccagcatagtaccaggactcacgtaggaattggagtccttgtggctgagactgtctttcaagtttatttagggccccatagcactttagcctgcagtggcagggcttgctggaactcaggtgtcgactgctgggatggacaattcatctctgactatggctggtctaaatgctccctccgtgggtgctggttgagttctgccctgtgttgcttttgactatggtagggcagcactgagtttgaatgtgtagtcccaaaatttcagcactttcctttccctaagtacagagattctctctgttccatgtagccactgctgggggatacgagtggggtggtgtaggctatttaagaaagactgtgtttcctaccctcttcattgcctttttccttaatatggtgttaaagcaagtactgtgaccactcccttgatatttggttcttttgaaggtgctttatttatgttcaatatggtgttcctgtgtggtagggggaaacttgctgtagccttctatttagtcatcttgccctgcctccctgtcctagtattcgttgttttgagaagcctacattgatacttgttatcacttggcattttgatcatattcatactaacagatgtgaagtgatatctcactgtggttttaatttgcattcccctgatgattaattatgttaagcaccttttcatctacctgggagaccctaagtagccaaagacataataagaaaagacaacagatctggaggcatcacactgcctaatttccaagtatattataaagatatagtaatcaatagagaattgtactggcataaaaacagatacatcaaccaactgaacaaaatagatagttcacaaatatatccacacgtatatggtcaactaatcttcaaaaaaagcaataagaatacacaatacagaaaggatattccctccaaatctcatgttgaaatgtgattttgaatgttggaggttgggcctagtgggaggtattggaccatgggggcagatttctcatgaatggcttagtgccatccccttggtgatgagtagattctagctctatttatggaagatctgtttttttaaaaacagtatggaatcacccccttgtctctcttggtccttctcttgccatgtgatatgcttgcccctgctttgccttctgctgtgagtaaaagttctctgaggcctcaccagaagggaaggagatgctggtgtcacacttttgtacagtctgcagaactgtgagccaattaaaaaacctcttttctttataaattacccagcctcaggtatttctttataacaatgcaaaaatgggctaacacagggtgtctctattttattccattggtctatatttttgtctttatgccagtatcatactgttttggttcttgtagctttatagtaagttttgaaactaggaagtgtgattctgctaacttttcctctttttcaaaattgttttggctttttggggttcctttaccatctatataaattttaggatgaagttgtctatttctgccataaacattactggaattttgataggaattgcattcaatttgaaagaattgcattgggtagtatggacatcttaaaaatatgaagtcctaaaatccattaacacaggatgtctttccatttatttgtgtaattatctaatttctttcagcaatattgtataatttttagtatataggtttttcatttctttgtttaaatttatgcctaagtattttttatttgatgctattataaatagaattgtttttcttaattccttttacaaattgatgattctcagtgtgtagaaacacgactgatttttgcatgttgcttttgtaccttgcaatttggttgaattcatttacttagttctaagtgtgtgtgtgtgggggcatgtgtgtgtttatttgttaggcatttctacatataaaattatgtaatttttgagtaattttacttatttctttctgctttggatgagttttatttctttttcttccctaattgctctgggtagaacttccaacagcatattgaatagaagtaggaaaagtgggaacccataccttgtttctgattttagaggaaaagtttgcagtttttcaccactggctatgatgttagctgtgtgcttttcacatatggcttttattatcttgaaataatttccttctagcctcagtttgttgaaggatttttaaatataaaacagtattaaggggggtggagccaagatggccgaataggaacagctcaagtctacagctcccagtgtgagcgacacagaagacaggtgatttctgcatttccaactgaggtaccaggtttatctcactggggagtgtcagaaagtgggtgcaggagagtgggtgcagtgcaccgagtgtgaaccaaagcagggcaaggcatcacctcacctgggaagtgcaaggggtcagggaattcccttttctagtcaaagaaaggggtaaaagacggcacctggaaaatcgagtcactcccaccctaaaactgcacttttccaatgggcttaaaaaacggcaaaccaggagattatatcccacacctggctcagagggtcctacacccacggagtctcactgattgctagcacagcagtctgagatcaaactgcaaggcggcagcgaggccggggggaaggatgcccaccattgccctgaggcttgagtaggtaaacaaagcggctgggaagctcaaactgggtggagcccaccacagctcaaggaggactgcctgcctctataggctccacctctgggggtagggcatagccaaaaaaaaggcagcagaatcctctgcagacttaaatgtccctgtctgacagctttgaagagagtagtggttctcccagcatgcagcttgagatctgagaatggacagactgcctcctcaagtgggtccctgacccccgagtagcctaactggcaggcacccgccagtaggggcagactgacacttcacacggctgggtactcttctgagaccaaacctccagaggaacgatcaggcagcaacacttgctgctcaccaatatccgctgttctgcagcctctgctgctgatgcccaggcaaacagggtctgcagtggacctccagaaaacaccaacagacatgcagctgagggtccttactgttagaaggaaaactaacaaacagaaaggacatccacaccaaaaacccatctgtacgtcaccatcaccaaagaccaaaggtagataaaaccacaaagatggggaaaagacagaacagaaaaactggaaactctaaaaatcagagtgcctatcctcctccaaaggaacgcagctcctcaccagcaatggaacaaagctggatggagaatgactttgatgagttgagagaagaaggcttcagatgatcaaactactccgagctaaaggaggaagtttgaacccatggcaaagaagttaaaaaacttgaaaaaaaattagacgaatggctagctagaataaccaacgcagacaagtccttaaggacttgatggagctgaaaactaaggcacaagaactacgtgacgaatgcacaagcctcagtagccaatgcgatcaactggaataaagggtatcagtgatggaaggtcaaaggaatgaaatgaagcaagaagagaagtttagagaaaaaagaataaaaagaaatgaagaaagcctccaagaaatatgggactatgtgaaaagactaaatctacatctgattgctgtacctgaaagtgacagggataatgaaatcaagttggaaaacactctgcaggatattatccaggagaatttccccaatctagcaaggcacgccaacattcaaattcaggaaatacagagaacaccacaaagatactcctcaagaagagcaaccccaagacacataattgtcagattcgctaaagttgaaatggaggaaaaaatgttaagggcagccagagaaaaagatcgggttacccacaaagggaagcccatcagactaacagctgatctctcggcagatattctacaagccagaagacagtggggaccaatattcaacattcttaaagaaaagaattttaaagccagaatttcatattcagccaaactaagcttcataagtgaaggagaaataaaatcctttacagacaagaaaatgttgagagattttgtcaccaccaggcctatgctaaaagagctcctgacggaagcactaaacacggaaacggaaaaccagtaccagccactgcaaaatcatgccaaattgtaaagaccatcgaggctaggaagaaactatatcaactaatgagcaaaataaccagctaacatcataatgacaggatcaaattcacacatgacaatattaaccttaaatgtcaatgggctaaatgctccaattaaaggacacagactggcaaattggatagaggcaagaccaatcagtgtgctgtattcaggagacccatctcacatgcagagacacacataggctcaaaataaagggatggaggaagatctaccaagcaaatggaaaacaaaaaaaaaaggcagggattgcaatcctagactcggataaaacacattttaaaccaacaaagatcaaaagagacaaagaaggccattgcataatggtaaagggatcaattcaacaagaagagctaactatcctaaatatatatgtacccaatacaggagcacccagattcataaagcaagtccttagagacctacaaagagacttagacaccccacacaataataatgggagactttaacatcccactgtcaacattagacagatcaacgagacagaaagttaacaaggatatccacgaattgaactcagctctgcaccaagtggacctaatagacatctacagaactctccaccccaaatcaaaacaatatacatttttttcagcaccacaagacacctattccaaaaatgaccacatagttggaagtaaagcactcctcagcaaatgtaaaagaacagaaattatagcaaactgtctctcagaccacagtgcaatcaaactagaactcaggattaagaaactcactcaaaaccgctcaactacatggaaactgaactacctgcttctgaatgcctactgggtacataatgaaatgaagacagaaataaagatgttctttgaaaccaacgagaacaaagacacaacttaccagaatctctgggacacattcaaagcagtgtgtagagggaaacttatagcagtaaatgcccacaagagaaagcaggaaagatccaagattgacactctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggatcttgttttttgaaaagatcaacaaaattgatagaccgctagcaagactaataaagaaaaaaagagagaagaatcaaatagatgcaataaaaaatgctacaggggatatcaccaccgatcccacagaaacacaaactactatcacagaatactataaacacctctacacaaataaactagaaaatctagaagagatggataaattcctggacacatacaccctcccaagactaaaccaggaagaagttgaatctccatatagaccaataacaggctctgaaattgaggcaataactattagcttaccagcaaaaaaaagtccaggaccagacggattcacagccgaattctaccagaggtacaaggaggagctggtaccattccttctgaacctattccaatcaatagaaaaagagggaatcctccctaactcattttatgaggccagcatcattctgataccaaaacctggcaaagacacaacaaaaaaagaaaatttcaggccaatatccctgatgaacattgatgcgaaattcctcaataaaatactggcaaaccgaatccagcagcacatccaaaagcttatccaccacaatcaagtcggcttcaccccggggatgcaaggctgtttcaatgtacacaaatcaataaacgtaatccatcagataaacagaaccaatgacaaaaaccacatgattatctcaatagatgcagaaaaggccttcgacaaaatgcaacagcgcttcatgtgaaaaactttcaataaactggatatcgatggaatgtatttcaaaataataagagcaatttatgacaaatccacagccaatatcatatggaatgggcaaaaactggatgcattccatttgaaaactggcacaagacaaggatgccctctctcgccacaattattcagcatagtattggaagttctggccagggcaatcaggcaaaagaaagaaataaagagtattcaattaggataagaggaagtcaaatcgtccctgtttgcagatgacatgattgtgtatttagaaaaccccatcatctcagcccaaaatctccttaagctgataagcaacttcagcaaagtctcaggatacaaaatcaatgtgccaaaatcacaagcattcctatatatcaataacagaaaaacagagagccaaatcatgagtgaactcccattcacaattgctacaaagagaataaaatacaactcacaagggatgtgatggaccttttcaaggagaactacaaaccaccactcaaggaaataagagaggacataaacaaatggaagaaccttccatgctcatggataggaataaccaatatcttgaaaatggccatactgcccaaagtagtttatagattcaatgctatgctcatcaagctaccattgactttcttcacagagttggaaaaaactactttaaagttcatatggaaccaaaaaagagcccacatagccaagacaatcctaagcaaaaagaacaaagctggaggcatcacgctacctgacttcaagcaatactacaagactacagtaacaaaagcagcatggcactggtgccaaaacagatatatagaccaatgaaacagaacagaggcctcagaaataatgccacacatccacaaccatctgatctttgacaagcctgacaaaaacaagaaatggggaaaggattccctatttaataaatggtgttggacaaacgggctagccacatggagaaaactgaaactgggtcccttccttacaccttatacaaaaattaactcaagatgggttaaagacttaaacataaaacctaaaaccataaaaaccctagaggaaaacctaggcaataccattcaggacataggcatgggcaaagacttcatgactaaaacaccaaaagcaatggcaacaaaagacaaaattgacaaatgggatctaattaaactaaagagcttctgcacagcaaaagaaactaccatcagagtgaacaggcaacctacagaatgggagaaaatttttgcaatctctctatctgacgaaggactaatatccagaatctacaaagaacttaaacaaatttacaagaaaaaaacaaacaaccccatcaaaaagtgggcaaaggatacgaacagacacttctcaaaagaagacatttatgcagccaaaacacatatgaaaaaatgcgcatcatcactggtcattagagaaatgcaaatcaaaaccacaatgagataccatctcacaccagttagaatggcgaccatgaaaaagtcaggaaacaataggtgctggagaggatgtggagaaataggaacacttttacacagttggtgggactgtaaactagttcaacccttgtggaagacagtgtggcgattcctcaaagatctagaactagaaatactatttgatccagcaatcccactactgggtatataccaaaaggattataaatcattctactgtaaagacacatgcacatgtatgtttattgtggcactgttcacaatagcaaagacttggaaccaacccaaatgcccatcaatgatagactggataaagaaaatgtggcatgtatacaccatggaatactaagcagccataaaaaaggatgagttcacgtccttgttagggtcatggatgaagctggaaaccatcattctcagcacactaacacaagaacagaaatccaaacaccgcatattctcactcataagtgggagttgaacaatgagaacacatggacgcagggaggggaacaacacacaccggggcctactggggggtggaggtctaggggagggatagcattaggagaaatacctaatgtagatgacgggatcatgggtgcagcaaaccaccacaggacgcgcatacctatgtagcaaacctgcactttctgcacatgtagcccagaacttaaagtataataaaaaagaagtggggtttatcctatggaaaaatgggaagtcgttactaaagagtatttagtcaggcgagtattgttatcatatttgtgcttcataaagaccactttgattacagggtggatgatgaattggaaggatgtcaatgagaatgctgctatagtggtccaggggagactgaaataaggcagtagcaatagggtttccaagaaaagaatggactccagacacacagtgaaggttagctgaaatggtcttgatgaggaagtgtgtggaaaattctatgattcccatattggttcatggcttgagtgggtggtgctggtgccatttactaaattagcaaacaggagagcagcagctttaagagaaggaatgtatgtgaaaagtgaggaaatatccaaatgaatatgtgtggattataagaataattgaagtcactagtgatgtctgaatgaatttgtgacagtaggtgggcaatggtaacaccagaatggatgtgtgcatcatctgaaagaaactataacaaatgcccattatcagatgctcatattttctcattcagttgtctcaaaatctcatttaggcattagataaacacagttgtctcatattcattcagatgtcaaaataacacattgtctgttacacccaaattcagatatagaatggcttattcattcacttctgcttttagctcagagatgtagcaggctggaaagagcattgtttccataatttcagcaagaaaaaccatacagactgcaagttaaccaatcttgaactcattagaaaacagagcaaaaagctaactcaaaatttggagagagataaaagcctatagaaagaaccagtaccacagtatctgcttacctaatgcacatgtcatcacgttatcatataagatggtagggagaattaactggaaagtttaatgaactgctaaaggcccagtatggacaagattgagaatgtgagacccctggaggcatagaaagcccacacttttagtggacttttcttcaaggaatctgacctagctcttagaagaaagattagcaagtaaccagaaaaaactccctccttgctgccgtctcggggaagggaacaagagtcactgccaaatccacccagacacacctcctttaactccattagagaagaaaaaagttaatctgcaggggaagagccatcaatagtggtatgctgagggcactgatgcaatctcattgcaactgaggagggaaacataagtcaccatcaaaactgcttagactcatctctccagttctcctaaataacaaaagctttaatatgtgagaaaggggggacatcatgacaataatttgagaactcttgtggaagctcgctgcagacagggtaagaaaatgggggaagaacaaggctctattccttggagaggtaaaggaatacttattaagccaaccattacatctaaaggagagacaggaacaattttgaaggccacatccttgagacccaggtattcagtgcctgcctagcactggggttaaatcaaaagctcaaacacactcatcttgtccacgccaaacaccaagctagcaagtatagagtaacaataatagtggaatacagctggcagtactgcaaaatgcagattcattatgaggagcagcacaagagctgagaaagaaaggatattactagaggaatattaaggccctggtaccaatagcaacaacaaaaaaattaaactgtggtaaccaaagcaacaataatatttaactctggtaaacatcacaacaacaaacttaaactgtagtccaactcttgactacattaacacaaacttacacagtaaaggcctagaagagggaaagcctggccataactgagcataaaaatatttacttcaggggaggttccaagatggccgaataggaacagctccagtctacagctcccagtgtgagtgacacagaagatgggtgatttctgcatttccaactgagtaccgggttcatctcactggggcttgtcagacagtgggtgcaggacagtgagtgtagcccgccaagcatgagccgaagcagggcgaggcattgcctcacctgggaagcacaaggggtcaagaaattccctttcctagccaagggaatctgtgacagatggcacctggaaaattgggtcactcccagcctaatactgtccttttccaatggtcttagcaaacagaacaccaggggattatatcccatgcctggctcagagggtcccacacccatggagccttgctcactgctagcgcagcagtctgagattgaacttcaaggtggcagcgaggcagggcaaggggcgtctgccattgttgaggcttgagtaggtaaacaaagcggcccggaagctcgaactgggtggagcccacaacagctcaaggaggcctgcctgcctctgtagactccacatctgggggcagggcatagctgaaaaaaaggcagcagaaacttctgcagacttaaacgtccctgtctgatagctttgaagagagtagtggttctcccagcacggagtttgagatctgagaatggacagactgcctccccaagtgggtccctgatccccaagtagcctaactgggaggcatctcccagtacaggctgactgataccccatatggccgggtacccctctgagatgaagcttccagatgaatgatcagacagcaatatttgccattccgcaatatttgctcttttgcagcctccactggtgatacccaggcaaacaggttctggagtggacctccagcaaactccaacagacctgcagctgagggtcctgactgttagaaggaaaactaacaaacagaaaggacatccgcaccaaaaccccatctgtacgtcaccatcatcaaagaccaaaggtagataaaaccacaaagatggggagaaaccagagcagaaaagctgaaaattctaaaaatcagagcacctctcccccttcaaaggaatgcagctcctcgccagcaacagaacaacgctggacggacaatgactttgatgagttgagagaagaaactttcagacgatcggtaataacaaacttctccaagctaaaggaggatgttggaacccatagcaaagaagctaaaaaccttgaaaaaagattagacaaacggctaactagaataaacagcatagagaagactttaaatgacctgttggagctgaaaaacatggcacgagaactatgtgatgaatgcacaagcttcagtagacgattcaatcaactggaaggaagggtatcagtgattgaagatcaaatgaatgaaattaagtgagaagagaagtttagagaaaaaaaaaagtaaaaagaaacaaacaaagcctccaagaaatatgggactatgttaaaagaccaaatctatgtctgactggtgtacctgaaactgacggggagaatggaaccaagttggaaaacactctgcaggatattatccaggagaacttctccaatctagcaaggcaggccaacattcaaattcaggaaatacagagaacgccacaaagatactccccgagaagagcaactcgaagacacgtaattgtcagattcaccaaacttggaatgaaggaaaaaatgtcaagggcagccagagaaaaaggacgggttacccacaaagggaagcccatcagactaacacctgatctctcagcagaaactctacaagccaaaagagagtagaggccaatattcaacattcttaaagaaaagaattttcaacccagaatttcatatccagccaaactaagcttcacaagtgaaggagaaataaaatcctttacagacaagcaaatgctgagagatattgtcaacacaggcctgccttacaagagctgctgaaggaagcactaaacatggaaaggaccaaccagtaccagccactgcaaaaacatgccaaattgtaaagaccgtcgaggctaggaagaaactgcatcaactaaagagaaaaataatcagctaacatcataatgacaggatcaaattcacacataacaatattaactttaaatgtaaatggactaaatgctccaattaaaagacacagactggcaaattggataaagagtcaagacccatcagtgtgctgtattcaggagacccatctcacgtgcagagacacacataggctcaaaataaagggatggaggaagatctaccaagcaaatggaaaacaaaaaaaggcaggggttgcaatcctagtctctgataaaacagactttaaaccaacaaaggtcaaaagagacaaagaaggccattacataatggtaaacagatcaattcaacaagaagagctaactatcctaaatatatgcactctatacaggagcacccagattcataaagcaaataaagcaagtacttagagacctacaaagagacttagactcccacacattaataatgggagactaataccccaccatcaacattagacagatcaatgagacagaaagttaacaagatatccaggaattgaaatcagctctgcaccaagcagacctaatagacatctacagaactctccaccccaaatcaccagattatatattcttctcagcaccacactgcacttattcgaaaattgaccacatagttggaagtaaagcactcctcagcaaatgtaaaggaacagaaattataacaaactatctctcagaccacagtgcagtcaaactagaactcaggattaagaaacccactcaaaaccactcaactacatggaaactgaacaacctgctcctgaatgattactgggtacataatgaaatgaacacagaaatagagatgttctttcaaaccagtgagaacaaaaacacaacaaaccagaatctctgggacacatttaaaggagtgtgtagaggggaatttatagcactaaatgaccacaagagaaagcaggaaagatctaaagttgacaccctaacatcagagataaaaaaaccagagaagcaagagcaaacacattcaaaagctaccagaaggcaagaaataactaagatcagagaagaattgaaggagatagaaaaacaaaaaacccttcaaaaaatcaatgaaaccaggagctggttttttgaaaaggtcaacaaaattgatagactgctagaaagaataataaagaagaaaagagagaagaatcaaatagatgcaataaaaaatgatgcaggggatatcaccactgatcccacagaaatacaaactgccatcagagaatactataaacatctctacacacataaactagaaaatctagaaaacatggataaattcctggacacatacaccctcccaagactaaaccaggaagaagttgaatccctgaatacatcaataacaggctctgaaattgaggcaataattaatagcttaccagccaaaaaaagtcgaggaccagacagattcacagctgaattctaccagagttacaaagaggagctgctaccattccttctgaaagtattccaatcaatagaagaagagggaatcctccctaactcattttatgaggccagcatcatcctgataccaaagcctggcagagacacaaccaaaagagagaattttagaccaatatccctgacgaacattgatgcgaaaatcctcaataaaatactggcaaactgaacccagcagcacatcaaaaagtttatccaccacgatcaagttgccttcatccctgggatgcaaggctgcttcaacatccacaaatcaataaatgtaatccatcatataaacagaaccaaagacaaaaaccacaaggttatctcaatagatgcagaaaaggcctttgacatatttcaacagcccttcatgctaaaaactctcaataaactaggtagtcatggtatgtatctcaaaataataagagctatttatgacaaacccacagccaatatcatactgaatggacaaaaactggaagcattccctttcaaaacgggcagaagacagggatgccctctctcaccacccctattcaacattgtgttggaagttccagccagggcaatcaggcaggagaaagaaataaagggtattcaattagggaaagaggaagtcaaattgtccctatttgcagatgacatgattgtatatctagaaaaccccatcgtctcagccccaaatctccctgagctgatatgcaaattcagcaaagtctcaggatacaaaatcaatgtgcaaaaatcacaagcattcttatacaccaataacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccctgctcatggataggaaggatcaatatcatgaaaatggccatactactcaaggtaatttatagattcaatgtcatccccatcaagctaccaatgacttttttcacagaattggaaaaaactactttaaagttcacatggaaccaaaaaagagcccgcattgccaagacaatcctgagccaaaagaacaaagctggaggcatcacgctacctgacttcaaactataccacaaggctacagtaaccaaaacagcatggtactggtaccaaacagagatatagaccaatgaaacagaacagagccctcagaaataataccacacatctacaaccatctgatctttgacaaacctgagaaaaacaagaaatggggaaaggattccctatttaataaatggtgctgggagaactggctagccatatgtagaaagctgaaactggatcccttccttacaccttatacaaaaattaattcaagatggatgaaagacttaaatgttagacctaaagccataaaaaccctggaagaaaacctaggcaataccattcaagacataggcacgggcaaggacttcatgtctaaaacaccaaaagcaatgggaacgaaagccaaaattgacaaatgggatctaattaaactaaagagcttctgtacagcaaaagaaactaccaaaagagtgaacaggcaacctacagaatgggagaaaacttttgcaatctacccatctgacaaatggctaatatccagaatctacaatgaacttaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggactggatgtggagaaataggaacacttttacactgttggtgggactggaaactagttcaaccattgtggaagacagtgtggcgattcccgaaggatctagaactggaaataccatttgacccagccatctcattactgggtatatacccaaaggattataaatcatgctgctataaagacacatgcacacatatgtttattgtggcactgttcacaatagcaaagacttggaaccaacccaaaagtccatcaatgatagactggattaagaaaatgtggcacatatacaccatggaatactatgcagccataaaaaagaatgagttcatgtcctttgcagggacatggatgaagctggaaaccatcattctgagccaactatcacaaggacagaaaacgaaacaccgcatgttctcactcataggtgggaattgaacaatgagaacacttggatacaggatggggaacatcacacaccagagcctgttgtggggtgggggaaggggggagggatagcattaggagatatacctaatgtaaatgatgagataatgggtgcagcacaccaacatggcacatgtatacatatgtaacaaacgtgcacattgtgcacatgtaccctagaacttaaagtataataataaaaaaaaataaggctgtctcttaaaaaaataaataaaatttaaaaatagattaaaaaatatatttatttcagtatctactaacctatacaacacgtgcagattgcaacaaatattataaggcataaagtgaggcaacagaaattaagcctgaagagagacaaagcaatcctaaaagcaagttcagatgtgatttagacgttggaaatatcaggcagggaattcaaaacaactacaattagtgtgttaaagtttccattggaaaaggtacgcaacatgaaagatcagataggcaattaagcagacagaggcaaattataaaaaataataaagagatattacaaataaaacatacagtaacagaaatgaagaatgccttcaacaggatcagcagtaaactcaaaacagctatgaaagaaccagtgaacttcaatataggtcaaaaaattatctactttcaaataccaaaaaaaaaaaagtgaagaaaacagaatagggcatccaagagctataggacaatatcaaacaatttaatatatgtgcacttccataaatagaagaaatagagagtggatcagaatacatatttgaagaaataatggccaagagttatctgaaattagtgacagacaccaagccacagatccaagaaggcagagagcatcaagcagtataaataccaacacagacacacacacacacacacacacacacacacacacacacacatgcatgcacacaactaggcatatagtattcaaaattctgaaaaccaaaggaaaagagaacatcttgaagatagtcataggaaaaaaaagacatattacccacaaaggagaaatgataagatttacagcagaattatcattggaaaaaatgcaaacaagaaggcaattgactgacatcttccatgagttggaaaaaaaattgccaatcaagtatgctttacccagcaaaactatgcttcaaaaatgaaggctgggtggtagagccaagacggttgactagacacagccaggaagagcttcccccactgagagattagaccatcaaaaagacaagcacactccaagcagatcttctgaagtaaggcattgatggtggatagagggaggatgcagaccctggggtaaagggagaggaaactgggaactctgcatgaggttgccaaacactaggactcattcctggcctcaagtggctcctggggaagaggtgagtaggcatggggtggcctactttcaccataaactttatgaatactagctgcaggagatctcatgacctccacggacatttgagctgtcagggagagctgcttggagagctagccaggatgggactccagcctgcatggagcccagagggtttagcataggaatggctgcagtggagcatagccagtgatgtccatttaccaaggcttaccatcctcctctgggtggctttggcctttgttgactgtcaagtatggacagaacagggctatcttgcctgtgaaatggatccagtcagatttgagcaggccactctttgctggcctctctcagagtaccttcctggccatgcccacttgaagcacagtctcagatgttcaactggggagcatcctggtggctaataccataactccttcattggcagatcccacctaaccattgcagagcttctgcagatgatcccctataagcatgcacccacccacaggcttcccccactgccttgccagcatgtacttggccacaccctctgcctaccactttgctggcaggtataagcatgtgaactttgctgcctagccactgccagcacaagtgcatatacatggttcctgcttctgcaccacatgtgctggtgcacgcacatgtggacgccactgccttacgcccaccctgccagcactgttatgcatatgccagcatgggccttgccacctctataaaatgattttgcctgcatcccccatcagagtgttgttgccagtggatcagaaacatcttggctcctccaatgcaacagatgcttaattttgaggggccagataacaaagccatgggcctgggcccagtcctctagtgttacagcatgcagcccaggagtgccgagctgagtcttggccctctgaaatcatccagaaatgaagctagtggactgaatccaacttatactaaagtcaagcccttaaggacatcaaagaatataaaagcaaaaagccccatgcaaaagacagcaacttcaaagactaaaagaacatcagatgagaaagagctgacataagaatctggcatctcaaaaaaccagagtgtcttcttacctccaaatgaccacactagctctggagtcatggttcttatccaggctgaaatggcagaaatgaaaagcatagaattcagaatctggatggcaatgaagatcatcgacattcaaaagaaacttgaaacccaatccaaggaatccaaggaacccagtaaaatgatacaagaactgaaaggtgaaagaagcattttaagaaagaagcaaactgatctgatagagatgaaaagtttactacaagaattttgtaatacaatcagaagtattaacaacaaaataaaccaaactgaagaatctcagagctcaaagaccagttcttcaaattgacttagacaaaaatacagcaaaaagaataaaaaagaatgagcaaaagagaccaaacctatgacttatttgtgtccatgaaagaaagggaaagagaacaagcaacttggaaaacttagctgaggatattatccatgaaaatttccccaacctcactagagaggtcaacattcaaattcaggaaatgtagagaaaccctgcaagatactatacaagacaaccatccccaagacacgtaatcatcagattctccaagataaacatgaaagaaaaaatcttaaaggcagctagaaagaaggggcaggtcatctacaaagggagccctgtcagactaacagcagaactttcagcagaaactccacaagccaggagagcttgggggcctatattcatcattcttaaagaaacaaaattccagtcaagaattttatatccagctaaactaagcttcataagtgtaggagaaataaaataaaatccttttcagacaagcaaatgcaaagggaattcattaccaccagacctgcctcacaaaaggtcctttaagggagtgctaaatatggaaatgaaagactcttaccagccaaaacagaaacatgctttagtatataaatcattgacactaataaaacaatgacacaatcaagttgtaaaccaaaaataaaattcgaagccccccgccccactcccccacacccctgcctcctgcaaccatctgaatggactcccttattagctagggcactctaaaatttaatctgaaagactggttcaggtcatgatggaaagtgggtattggacgtgcctattatacccctccagcattaacatcaacacagaccttaagtctgatcagaaatacttacaatctattttctctgaagcctgctgcctgaagcttcatctgcatgataaaaccttggtctccacaaccccttatcttaacccagatatttctttctactgataataactcttaaccaattaccaatcagaatatgtttaaatctacttttgacctggaatactgctcccctcccacccacacccctgcttcgagttgtctcacccttctagattgaaccaatgtaagtcttatatatagagattgatgtattatgtccccctaaaatgtatacaagcaagctgtgccccaatcaacttggcacatgtcatcaggacctcctgaggctgtgtcataattgcattcttaaccttggcaaaataaactttctatattgactgagacctgtctcagatactttgggttcacaaagtttacagaacattcagctaacagcacaattaacaggatgaaatcagcacatatcaatattaaccttgaaagtaaatgggttaaacactccacttaaaaggcacagagtagcaaattgtatgaagatgcaagatcaaactctatggtacctttaagagacccatttcacatgcaatgatacccacaggctcaaagtaaagggatagggaaagatctattaagaaaatggaaaagaaaaaaagcaagggttgcctttcttatttcagacaaaacagactttaagccaacaattatttaaaaaaaaataaacaaggacattacataatgaaagatggtttcattcaacaagaagatttaagtatcctaaatatacatgcacacaacactggagcactcagattcataaaacaagttattagagagttatgaagaaactagaataaccacacagtaatataatagtgggagacttcaacaccccactgacagtattatagagatcattgaggcagaaaactaacaaagatatttgggacctaaattcaacacttgatcaaatgtacctaacatatatctacagactctatccaacaacattcttcttatctgcacatggcacacactctaaaattgaccacacacttggccataaagtaattctcaaaaaattcaaataaactgaaatttcagcaaccacatgctcggatcatggcacaatacaaatagaaatcaatgctaagaaaatctctcaaaaccatataacaacatgaaaattaaacaatctgctcctgaatgacttttgataaacaatgaaattaaggcagaaatcaagaaattctttgaaattaatgaaaacaaagctacaacataccagaaactctgggacacagctaaagcagtattaagagggaacttcttagtgctaaatgcccacgtcaataatttggaacgatctcaaattaacaatctcatatcacacctacaggaactagaaaaacaagagcaagccaaccccaaagctagcggaaaataagaaataaccgaaatctgatcttaactgaataaaatggggacaggaaaaaaccacataaaagatcaataaaagcaaaagtttgttctttgaaaaaaataagactgatagaccactagctagactaataaagaaaaaaggagagaagatccaaataaacacacccagaaatgactcagtggacattaccactaaccccagagaaatacaaaaaaccctcagagactattatgaatatttctatgcacacaaactagaaagccgacaagaaatagataaattctaggaaatatacaaccctccaaggttgaatgaggaagtaattgaaaccctgaacaggccaataatcagttctgaaatttagtcagtaataaaaggcctaccaacccgaaaaagccctgggacagatggattcacagctgagttctatcagacctatgaagaagagatggtaccaatctttctgaaactactcccaaaaatcgagtaggagagactcctccataactcattctatgagcccagcatcattctgataccaaaatctggcagagacacaacaaaaaaagaaaacttcaggccaatatttcttatgaacatagatgcaactctcaacaaaatactagcaaaccaaatctggcagcacattaaaaagctaatccaccaaaatcaactagattttattcctgggatccaaggttggttcaatatacacaaatcaataaatgtgattcatcacataaacaaaaaccacatgcatgataatctcgatggatgcagaaaggcttttttttttttttttttttttttgagatggagtcttgctctgtcacccaggctggagtgcagtggcgcaatctcggctcactgcaagctccgcctccgggttcacgccattctcctgtctcagcctcccgagtagctgggactacaggcgcctgccaccacgcccagctaattttttgtattttttttagtagagacggcgtttcaccatgttagccaggatggtctcgatctcctgacctcgtgatccgcccgcctcggcctcccaaagtgctgggattacaggcgtgagccaccgtgcccagccagaaaggcttttaataaaattctgcatcccttcatgttaattatcctcaataaactaggcatcaaataaacatatctcaaaactatgacaaacccacgaccaacaagatactgaatgggcaaaaactggaagcattcctcttaagaaccagaacaagacaaggatatccattctcaccacttctagccaacatagtactagaagtcctagccagagcaatcagacaagagaaagaaataaaaggcatccaaataggtagagaggaagtcaaactgtccctgtttacagatgatataattctctacctagaaaacccaatagtctctgcccagaagctcctagatctgatgaacaatgtcagaaaagtttcaagatacaaaatcaatgtacaaaaatctgcaacatttttatactccaacaacatccaagctgagaaccaaatcaagaacacaaccccattcacaatagccataaaaacaacaaaatgcatagaaatacagctagccatggagatgaaagatctccacaatgagaattacaaaacactgaagaaagaaatcagagatgacacaaatggagaaatattccatgcttatggattagaagattcaatattgttaaatttgccatattgccccaagcaatttgcaggttcagtgctattgctatcaaactgccaatgacattttgcacttaattaggaaaaaatgattctaaaattcatatggaaccaaaaaagagccaattagtcctaagcaaaaagagcaatgttacaggcatcacaccacccaacctcaaactatactacgaggctacagtaaccaaaacagcatgtttctggtccaaaacagacacatagatcaatggaataggtcagagaacgaaaaaatacacctgcatacctacaaccatctgatctttgacaaagctgacaaaaatgaacaatggggaaaagactccctattcaacaaatggtgctgggataactggccagccacatgcagatgattgaaactaaactccaacctttcaccatatacaaaaatcaagtcaacatggattaaagacttccatgtaaaaccgaaaattataataaccctggaaaaaaaacctaggaaataccattctgaacataggctctggcaaagatttcataatgaagactccaaaaacaatgctatataaacaaaaaattgacaagtgggacctaattaaagagctttcacacagcaaaggaaactatcaacagagttaacagacaacctacagaatggtagaaaatatatgcaatctatgcatctgactataatgttcaatatacagaatctatatgtaacttaaaaaaattagcaagtaaaaacaaccccattataaaataggcaaaggacatgaacagatacttctcaaaagaagacaaacacacggccaaaaaacatatgaaaaaatgctccacagcactaataattagagaaatgcaaatcgaaatcacaatgagatactatctcataccaggcacaatggttactatttaaaagtccaaaaactactgatgctggccaagcttcagaaaaaaaggaatgcttatacactgttggtgggtatgtaaattagcttagccactgaggaaagcagtttggagatttctcaaataacttagaactaccattcaacccagcaattccattactggctatatatccaaaagaatataaattgttctaccataaagacacatgcatgtgtatgttcattgcagcactattcacagtagcaaagatatggaagcaacgtaaagcccatcaaaggtggactggataaacaaaatgtggtacatgtatatgatggaatgctacacagtcataaaaaagtgaaatcatgtcctttgtagcagcatggatgcagctggaggccattatcctaggtgaattaatgcaagaacagggaataaaatatcatacattctcactcataagtgggagctaaacattgagtacacacggaaacaaagaaggaaacaatacatgctggggcctacttgagggtgaatggtgggaggaggttgaggatcaaaaaactacctattgggtactatgctaaaaaaaaagttggctgtgaaatcctccacaaataaaagtataccccatgcgtacacacacaaatgaagactggacttcaattttcagctcaaacatggaaggagatagaaagaggtaagacttatactcacaataaaaaaacagctggacagacagtatattaattttgttatctgattccaacatggatctgggttcacaaaaataacagccttcctgaaattttgagacagacacacaatgccttgagcatcttattacctagggaagaaggtgttgaatttcatgtaagctggtatgaagattaaaatagaaattttagtaaagtgttggagaccaaatatagcctacaaatatagctagaaagtgtgaattcctggaggccacactcatagagggggacaccactcttatgcaggcttttaaaggaactccaccaggctctcaaagtgagaataaagaagaacctagaaaaattacctccctctcccatagtgatgactggggcaacggaacatcaagccactgggatatcttctcagacgcttttaccttatagaaaaaaattcctaattagcagggtgcagaatatcactgggggcactagtgaaataccactgcagctggagaaatgctcagatcccatccacaacctcacctacgtcaaaaaataacaaaaaagtcttaatctgcagaaggaaggtcctcaagttgaagacacagaatattggctgatatccacggcagctcagggaattgagtgaggatggtgaaagctctagccatccaggagtgatagaaaagcctgtaagggccacaccctgagagacaggcccgctgtgtactccaaagactaagacataataagaacattatgtctctatctccacagtaaaaaaagaaagaaagaaaagtcatatccttcgcccactttttgatggggttgtttgtttttttcttgtaaatttgatggagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagatgtaaggaagggatccagtttcagctttctacatatggctagccagttctcccagcaccatttattaaatagggaatcctttccccattgcttgtttttctcaggtttgtcaagatcagatagttgtagttatgcagcgttattaaatgtggcacatatacaccatggaatactatgcagccataaaaaatgatgagttcatgccctttgtagggacgtggatgaaattggaaatcatcattctcagtaaactgtcgcaagaacaaaaaaccaaacactgcatattctcactcataggtgggaattgaacaatgagatcacatggacacaggaaggggaacatcacactctggggactgttgtggggtggggggaggggggagggatagcactgggcgatatacctaatgctagatgacgagttagtgggtgcagcgcaacagcatggcacatgtatacatatgtaactaacctgcacaatgtgcacatgtaccctaaaacttaaagtataataataaaataaaaaaagaaaaaaaaagaaaaaaaagaaaaataaaaaaacagaaaaaaaaaacacagtctgatgagacaaacaagtaatcagaaccaaactcagcaatgatacatatgttggaactatcatacggggaatttaaaataactatgattaatatgttaaaacctctaatagaaaaggtagaccacatgcaagagtagtagataggtgatttcagtaaagaaattgaaaccataaatgtgaaaccaagaaaaatagtagaaataagaaatatgataacaaatatgaaaaatgtcttttagaggatcatcactgatttacagagcaaagggataaattagtgaacttgaaaatagaactatggaagttacacaaagagtgtaaaaagcagaacagaaaatctaagagatgtggggtaatagcaaatgatgtaacacataagtaattggaatcacagaaataaaaataagacagagaaaatatttgaaaaaacagtgggtgtttttttccagtattagtgatagacatgaaaccaaagatccaagaagctcagagaacaccagacagagtaaaataaaaataaaataaaaccaaataaataaaaaccaaataaaaacacacactcacacaccactaggcatatcaaaatataactcctgaaaaacaaagacaaagggaaaatcttgaaggcaaccagagaaaatgaacaacttacctataaagaaacaagattaagagttcgagtaaattctcgtcacaaaatgtgttatggattgaactgtgtccctccaaaagatatctgatgttcttacccctagtacctatggatagatgtgaccttatttgcaaatagagtctttgtggatgcaatcatgttaatatgaggtcatactcaattaaagtgggctccaattcaatttgactgttgcctttaaaagaagagaaaatgtgtagcactgaaggtatacattggaaaagaaaaaatatacctaaaatctgtttattaagatcccaccctagtacagaaagaagagaaaatttaacttaaacagaagggataaaataataaaaaatagagcagaaatcaatgaaattgcaaatgggaaaacaaagaaaatcaatgaaagcaaaagttggttagtgaaaagattaataaagttgataaacctctagccaaagagaatgagagagagaaaacacttattaccaatatcaggaataaaagtaagggaatgattactgatcacacagctgttaaacagatgataaggaaaaacaatgaacaagtttgtgccattcaattttaaaattttggcaaattaaaccaattcctcagggaaaaaaaaacacttactaccaaaacgtactaaagaagagaaagagataatctgaacatccctggacctattaaattgaatttatagtaaaagcaaacaaacaaaattaaaaatcttccaaaaaaacctatttcaggcccagatggtttcactggtgagttttaccaaaacttgaaaaaagaaacaacatcaattctccacattttctcccagaaaacagaaaaggagagaacacctctcaacatattttatgaggccagcattagcctaatattaaagccatacaaaaacattataagtaaactgtagatcaatatctctcataaatacagtcataaaaatccttaacaaaatattagcaaaaagaattcatcaatatataaaaaaggataaaatatcatcataagcaggtttgtcccagtaatccaagtggattaaatagtaaaaaaaatcaatgtaattcaccatactaatgactaaatttttaaaatcatataatcacatcagtagatgcggaagaaaatcttttgagaaaatttgatacccattcattataaaaattctttgtaaactagaaatggaagataacttcctcaatctgataaaggcaatctatgcaaaatctacaggtgatatattaatggtgagacacaacattttccttgtatgatttatagtaagacaaggatggcctcactaacaactcctgttcaactttgtgctggaattcctagctaatgatatgagtcatgaaaaagaaataaaagacaggcaatgtggaaataaataaaattatatttgttctctgataaactaatttttttaatgtgaaaataccaatgtctacaaaaagtgctgctgaaatttataagtttagcaaagatccaaaataccagattaacctacaaaagtcaattgtgatcctatatactatcaataaacaattggaatctgaaatttaaaatcaaccctatttacaatagcaccaaataatgaaggacttaaatataaatataataaaatatatgcaaaatctgtatgcagaaagtataaaacaatgatgagagaaataaaagaagatataaatgaatgagacatactatgttgactaatttgaagactcaccatttttaaaatgtaaattctccccaactttatctatagatgtaatgtaatctcaatcaaaattcaagaaagcaattttatagacattgaaaactttattctataatgtatatggaaaggaaaaaggaacataaggaactagcaaaaaatatctttgaaaaagattaacaaagttggaggactcacattacctgatcctaagactttttataaggctacagtaatcaagccagttttttactggcatagacacatagatcaaaggaacagaatagagagcccagaaatagaccctaatatataacattgactaatgttgacaagttttaaacaaatttaatgaaaaaacaaagataattttttcaacaaattgtactggaacaactggacaattgaacactcatacataacaaaaaataaaattaacaccttatgcaaaaattaactcataattgatcatagaactcattataagttataaaactataaaaattttagaagaaaatataacagtagatatgcttaacttagacattagcaatgaaatttcagatatgatactaatatcaaggtccatgaaataaaaaaagaatagattgaactttgttgaaaattttaaaacctgatgtgtaaaagacactttaagagaatgaaaagataaggcacacattgggaagaaatatttacaagtgatatatccaataaattacttatatcaaaaatatataaagaacatcaaaaactcaataataagaaatcaaacaacccaattaaaaaatagggaaaacaggagatggacatcagcaagatggcagaataggactcaacaatgcttgacccctttcagaaacatcaatttgaacaactatccatgcatgaaaataccttcataagagctaaggaaacaaggtgagagattatagcacctggatatagcgctgaaataagaaaagatgcattgaagagggtaggaaaaataattttacattaccccttccccaactgcagacagcacagcatggagaaacaaccttcatgtgggggaaagagaaggaactgagtacacagttttgtctgaatcccaaaactgggcctgctacagtaaaacccaatgtcaagcaggtccccacagacccagacttcaagctggtactctcagactgaggcttcaggccctttctgacacagggctatatcccatggccccaggttcttagcctacccagtagactcagtctccaggacagcccaccaccaggccaacctcagcagccccaggctccagacttccctcagcaccagaccagccccagtggcctcaggtccctggctgccctacctccaggctgaaccaagtggccccaggttctggatcacctccagtacccagatgaccctcacagccacaggctttaggcctgccctagcactaggccaaccccacagcactagtcatcaggcaggtaccatggactgaacctgcaagcccttcccattgccaggcaggaacttgtagccacaggcttcaggccttcctggcagaagtggtttctggactgaactcagtgccaggccaactccagctattccatgctctagactagtcccagcaacaggtaggccctaggctttgggcccagccaagcaccaggggtttcaagcccactctagcacaggccagcacccatggacccagaaccttggctggctcttgcagatacaggatccaggtccgcacagcaccaagccagcccccgacttcaggcctaccatggcaacatgttggcaactctggcctcaaccaccaggcaggtacctgcagacacaggcttcaggtcagcctagtaccagactggctcctgtagccccaccctttagaccagcttatgtgggttcacattccagcagatccagtgtccaggccaggaccagaagatgcaaggtctaggtctgtcccagtagatcctagcactgtatgggtctccatggactcaggctctaggaatgcccttatgtatccaggtcctaggccagcctccaaggacccatgacctatgccagtctttacagaaaacttctaagccagcaccaacagacacaggctacaggccagtctctatggcctcaggctccaggtcagtccccatggctccaggcaacagacagtgcctacaatcccaggccccagagcagcccttgtggacctaggttccatctcagacccagcaccaggcaggtctcaggcttaaggccagactccatagcctctggctccagagcactcaggttccaggtatgccccacaagactcaggggccaggcccaccctggcagaccctggtaccaggccagatgccatgaactgaggctcaatgaccacccttacagacccaggcttcagaccagaccctgtggactcaaaatccagacctacctccttgaactcaagctccaggtctgctccagtgctatgcaagctcccaaggactcaggctccaggcctgtctcagagttcccaggtaccagggccactccagtgtcagcagatcccctgtggacccagacaccaggtcagcctacctgctgatccaggcaccaggccaacctgcccaaggactcctgcagcaagcataccctcactcgacacaagatggcctgcccataatctctggatgtgaagagctttcccagacaaagccagttctgcaaagactaaaataaatccctatttcttcaaatgtgcagacatcaaggtaaggcaataagaaataagaacaactaaaggacaaaacaccaccaaaagaacacagtaagcacccagtagctgaccctaaagaaatcaggatatgcaaactcccagatgaataattcaaaataattgtactaaggaagctcatctaacttcaagaaaatacagataaataaagcatttaagtcaggaaaacaatgaatgaacaaaatgagaaattctagagacagattgaaattattttaaaaatcaatcagaaattctagagctgaaaaatataatgaattaaattaaaactgatcaagcagaaaaaagaatctgaacttgaagacaagttatttgataacatatagtcagagaagaaaaaagaaaaaagaataaaaaggaatcaagaaagccaacagaatttatgaaatggaagaaaaagacaggagtagaaagcttagttaaagaaataatagcagaaaatttttcaaaattggaaaaggatataaatatccaggtacaagaatgtcaaaagtctccaatcagattcagttcaaacaagactacaccatgacatattataatcaagttgttaaaaatcaaggacaaagaaaggatcctgaaagcaccaaaagaagcaaatcacacataagtgagtttcaataaggctagcagtggatctctttatgaagaccttacaggccaagagacagtgagatgatacattcaatatattgaaggaaaaaaacggccaataaagaatattgtacccaagaaacctatcctccagaaatgaaggagagccatgacttccccagacaaacaaaagctaagggaattcatcaccaccagacctgtcttacaagaaatgctaaagggagtttttcaagctgaaagaaaaaaaaatgttaattcttaacacaaagaatctgaaggcataaaattcactggtaatagtaagcacacagtaaaattcaaaatacactaatactaaaagagttgtgtttaaatcacttatatctttagtatgaagattaaaagacaaaactactaaaaataatagtagcaaagatttgaataggcactgcactaaaaaagatacatgaatcgtaaataagcaagtacaaaaaatgttcaacatcattttccatgattgaaaggaaatttaaaactattaaataccactgcacatgtattaggatggctaaaacaaaaacctgacaaatatacataaacattgtactctagttgttaatttatcacaggggtacagattagcatttctgaaactacattaccacttatacccaggtctttcaatgtttcaaagaagttataaataagcaaaaacaaaaggtcggaataaaactctgtgatattagagtgagaggtatcaatatgaactgagggggtgtacatagatcagtacacatacatatattacttagctctttccactgagagaacagagaagcaggagtgccatggtaataatgtgcacactccatgccccgatcttgacttctaaataccattatccaataacatgaaccagaactaatgtttacaatggctgattccagaagacaaaagagaaatgatgaataattgcaatgtggtatcccagattggatacttgaatagtaaaagaacattagtagaaaaaaactagtgaaatctgaataaaatctgccatttagttaatagtaatgtgccaacgttaatgtttttagttttgacaaatgtgccatagttatataagatgttaatgttaatcagaaatagggtacaaaaaactctgtacttcaagttaaaaaaatcttaaaccattcaaaaaatgaaatatttatcttaaaaactcactaattctattgaattaaagacattttccctgtggctacaattattccttaagacatcacattcagatgtcacatgaactcattcaaagctgaccttgtctctcttgcccattgctgtactcccagcatctttactttgcttgtcacacaataggtatgcaataaatatttttaaaggagtcaaataaatgtttttcacatattcagttagaatatacactcagatgttacactcacttattcttttgtggcactcatttataacccatttcctaattcagatgtcaaacacacactcaggtattttacatatatttttttcagatgtagcacacagtcctccacatatcatacatagtatcttagctgtcataggtatacaactgttacttacactcttttggacattactcacatattataacacataccctaattcaggtgtttaatacaaagtttagatgaatagcttgcttacatggatgccacaaacacccattcaatgtttaattgaatgttttaattgggatattaaaaaattcagatattacacatgcagatgtcaactttgacaatcacacattcatcatgatatcaaatatactcaacaaaatgcaatacacactctcttagatgccaaacactcattgagaagttataatgttttttgtcattacagtcattcagttgtgaacccctcattgagtagtcttatacgttcatgcagaggacacaattagttttaatctacacattcaaatattatccacacatttaaaaggtcacattcagataatacatatgcaaactatttgacatgttgctcacacaatgaaatggaatatacccattctaaggttaaacccttcattggatgtcataaccacttctcagatcaaaatacacttaataggatgcaaaccacatattcagctagtccacattctaaggtataatccatgttcagtctatatgtcacacacatttaattggatgttatcttagtccatttgtgttactataaaggaatacctgaggctgggtaattgataaaacagatttacttggctcacagttcctcaggctgtacaagaagcatggcaccaacatctgcttctactgaaggtagaaggtgaaggggagcaggcatcacatggcaaaagaggaaggaagagagaggggagagaggtgccaagctcttttcaacaatcagctcttgcgaaaaataagagtgagaactcattactgcaagaatgacacaaagtttttcatgagggatccaccactatgatccaaacaccccgcattaggccacaactccaacattgagaattacatttctgcctgagattttgaggggacaaatatctaaactatatcagatataaaatgcttacaatgagatattcaaaacatttatttatctcacacttctttgtgtgatgtgcacatttatcctgatgttaccctcacaatcaggttaggtattttacttacatgtccttgaatcattgctggtttcccaataattacataattttggactctcagttttcttgtccatgaccttttccatgtgggcaggttttgatctctcttaggtagaatgggaaatgtataaaaagagcagatgggagaaaaggatggtctatcacaactctctctctcttacgtgcccacagacacacacacacacacacacacacacacacacacacacacacacacacacacacacctgaccaggtcctaggtaacctaaataatatgcaactcttcattggtttcccctaaaggggcaggaccagtcttcccaaggactttaacaacctgtttgagtttttatgcttttccccctccccagctgtattaagttataattgataaataaaacttgtatatatttaagctatacaacatgataatttgatatatgtacacattgtgaaatgattaacacaatcagattaatcaacacaaccatcacctcacatagttaccagtttttttaaaaaaattagtttcagtggtacatgtgcaagtttgttaaacagatatattatgtaatgctggggtttggacttctgttgaacccgtcccccaaatagtgaacatagtacttaatagttagttttacaacccttgtcccttccctccctccccacttttggagactccagtgtctattgtttccatctttatgtctgtgtaccactttttaaatttttattttttagagagggtcttgctatgttgcccaggctgttcacagactctgaacttaagtaacccccacaacctcagcctcctaagtagccaggactacaggtgtatgcctctgtgcacagctgttaccactttttgcgtgtagtgcgagcatttaggatctactctcttattagatttcaatgatacaatacagtattattaattatagttaccatgctgtatattattaatagatttccaggacttattcaccttataacagaaatattgtgccctttgctaacatctcccaatttcctctaccccccagtacctggcaaccaccattctactcttagcttccatgagttcaacttctttagattccacatataaggggatatcatatatatttgcttttttgtctctgacttacttcacttaacataatgtcctccaggttgattcatgttattacaattggcagaatttccttctttttttggtggaataatattccaatgtgtgtgtgcacgtgtgtgtgtgtgtgtgtgtgtgtgtgtattacctccattgtctttattcattcaactgtcaatggacatttaggttgtttctacatcttggctgttgagaataatgctgcaataaatgtgggaatgcagatatctttatgacatactgattctatttcattcggatatatactcagagtgtaactgccggatcttacggtagttttatgttttttttaatggtaattctatttttaattttctgagggatcgctatgctattttccatagcagctgcacgattttgcattccttttttttttattatactttaagttttaggatacatgtgcacaacgtgcaggtttgttacatatgtatgtatacatgtgtcatgttggtgtgctgcacccattaactcgtcatttagcattaggtatatctcctaatgctatccctgtcccctccccccacccacaacagtccctggtgtgtgatgttccccttcctgtgtccatgtgttctcattattcaattcccacctatgagtgagaacatgcagtgtttgttattttgtccttgcgatagtttgctgagaatgatggtttccagcttcatccatgttcctacaaaggacatgaactcatcattttttatggctgcatagtattccatagtgtatatgtgccacattttcttaatccagtctatcattgttggacatttgggttgttccaagtctttgctattgtgaatagcaccacaataaacatacatgtgcatgtgtctgtatagcagcatgatttataatcctttgggtatatacccagtaatgggatggctgggtcaaatggtatttctagttctagatccctgaggaatagccacactgacttccacaatggttgaaccagtttaccgtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttctcatgtgttttttggctgcataaatgtcttcttttaagaagtgtgtgttcatatccttcacccactttttgatggggttgtctgtttttttcttgtaaatttgcttgagttcattgtagattctggatattagccctttgtcagatgagtaggttgcaaaaattttctcccattttgtaggttgcctgttcactccgatagtagtttcttttgctgtgcagaagctctttagtttaattagatcccatttgtcaattttggcttttcttgccattgcttttggtgttttagacatgaagtctttgcccatgcctatgtcctgaatggtattgcctaggatttcttccagagtttttatgattttaggtctaacatgtaagtctttaatccaacttgaattgatttttgtataaggtgtaaggaagggatccagtttcagctttctacatatggctagccagttctcccagcaccatttattaaatagggaatcctttccccattgcttgtttttgttaggtttgtcaaagatcagagagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggctcaggattgtcttggcaatgcgggctcttttttggttccatgtgaactttaaagtagttttttccaattctgtgaagaaagtcattggtagcttcataaggatggcattgaatctataaattaccttgggcagtatggccattttcatgatattgattcttcctatgaattagcatggaatgttcttccatttgtttgtgtcctcttttattttgttgagcagtggtctgtagttctccttgacgaggtccttcacatcccttataagttggattcctaggtattttattctctttgaagcaattgtgaatgggagttcactcatgatttggctctctgtttgtctgttattgatgtataagattgcttgtgatttttgcacattgattttgtatcctgacactttactgaagttgcttatcagcttaaggagattttgggctgagacgatggggttttctagatatacaattatgtcatctgcaaacagggacaatttgacttcctcttttcctcattgaatgccttttatttctttctcctgcttgattgccctggccagaacttccaacactatgttgaataggaatggtgagagagggcatccctgtcttgtgccagttttcaaagggaatgcttccagtttttgcccattcagtaagatattggctgtgggcttgtcatagatagctcttattattttgagataagtcccatcaatacctaatttattgagagtttttagcatgaaacgttgttgagttttgtcaaaggccttttctgcatctattgagataatcatgtggtttttatctttggttttgtttacatgctggattatgcttattgattttcatatgttgaaccagccttgcatcccagggatgaagcccacttgatcatggtggataagctttttgatgtgctgctggattcggtttgccagtattttactgaggatttttgcatcaatgttgatcaaggatattggtctaaaattctcattttttgttgtgtctctgccaggctttggtatcaggatgatgctggcctcataaaatgagttagggaggattccctctttttctattgattggaatagtttcagaaggaaaggtactaggtcctccttgtacctctggtagaattcggctgtgagtccgtctggtcctgaactttttttggttggtaagctattaattattgcctcaatttcagctcctgttattggtctattcagagattcaacttcttcctcgtttagtcttgggagaatgtatgtgtcgaggaatttctccatttcttctagattttccagtttatttgtgtagaggtgtttatagtattctctgatggtagttgcatttctgtgggattggtggtgatatcccctttgtcattttttattgtgcctatttgattcttgtctcttttcttctttatcagtcttgatagcggtctaacaattttgttgatcttttcaaaaaaccagctcctggattcattgattttttgaagggttttttgtgtctctatttccttcgtttctgctctgatcttagttatttcttgccttctcctagcttttgaatgtgtttgctcttgcttttctagttctaccctgtagtcattcaggagcaggatgttcagtttccatgtagttgagtggttttgagtgagcttcgagtttcattgccctgtggtctgagagacagtttgttataatttctgttcttttacatttgctgaggagtgctttacttccaactgtgtggtcagttttggaataggtgtggtgtggtgctgaaaaaaatgtatattctgttgatttggggtggagatttctgtacatgtctattaggtctgcttggtgcagagctgagttcaattcctggatatccttgttaactttctgtctcggtgatctgtctaatgttgacagtggggtgttaaagtctcccattattattgtgtgggaacctaagtcactttgtaggtcactaaggacttgctttatgaatctgggtgctcctgtattgggtgcatatatatttaggatggttagttcttcttgttgaactgatccctttcccattatgtaatggccttctttgtctcttttgatctttgttggttgaaagtctgttttatgagagacttggattgcaacccctgcctttttttgttttccatttgcttggtagatcttcctgcatccctttattttgagcctatgtgtgtctctgcacgtgagatgggtttcctgaatacagcacactgatgggtcttgactctatccaatttgccagcctgtgccttttaattggagcatttagcccatttacatttaaggttagtattgttatgtgtgaatttgatgctgtcattacgatgttagctggctattttgctcgttagttgatgcagtttcttcctagccttgatggtctttacaatttggcatgtttttgcagtagctggtaccagttgttcctttccatgtttagtgcttccttcaggagctcttttagggcgggcctggtggtgacaaaatctctcagcatttgtttctctgtaaagggttttctttctccttcacttatgaagcttagtttggctggatatgaaattctggattgaaaattctttgctttaagaatcttgaatattggcccccactctattctggcttgtagagtttctgctgagagatcagctgttagtctgatggtcttccctttgtgggtaacctgacctttctctctggctgcccttaacattttttccttcatttcaactttagtgaatctgacaattatgtgtcttggagttgctcttcttggggagtatctttgtggcattctctgtatttcctgaatttgaatgttggcctgcgttgctagattggggaagttctcctggataatatcctgcagagtgtttccaacttggttccattctccccgtcactttcaggtacactaattagatgtacatttggtcttttcacatagtcccatatttctttgaggctttgttcatttctttgtattctttttgctctaaactacccttcatgcttcatttcattcatttcatcttccattgctgataccctttcttccagttgatcgcatcgcttactgaggcttgtgcatttgtcacatagttctcgtgccgtggttttcagctccatcaggtcctttaaggacttctctgcattggttattctagttatccattcgtctaatttttttttcaaagtttttaacttcttcgccattggttcgaacttcctcctttaactcagagtagtttgatcttctgaagccttcctctctcaactcgtcaaagtcattctccgtccagctttgttccattgctggtggggagctgagttcctttggaggaggagaggtattctgaattttagagtttccggtttttctgctctgttttttccccatctttgtggttttatctacctttggtctttggtgatggtgacgtacagatgggtttttggggtggatgtcctttctgtttgttagttttccttctagcagacagaaccctcagctgcaggtctgttggagtttactggaggtccactccagaccctgtttgcctgggtatcagcagcagtggctgcagaacagcggatattggtgaaccacaaatgctgctgcctgattgttcctctgaaagttttgtctcagaggagtacccggccgtgtgaggtgtcagtccactcctactggggggtgcctcccagttactctactcgggggtcagggacccacttgaggaggcagtctgcccgttctcagatctcaagctgcatgctgggagaaccactactctcttcaaaactgtcagacagggacatttaagactgcagaggttattgctgtcttttgtttgtctgtgccctgcccccagaggtagagcctacagaggcaggcaggcctccttgagctgtggtgggctccacccagtttgagcttcctggctgctttgtttacctactcaagcctgggcaatggcggacgcccatcccccggcctcgctgccaccttgcagtttgatctcagactgctgttctagcaatgagcgagcctccgtgggtgtaggaccctctgagccaggtgcaggatataatctcctggtgttccatttgataagcccgttggaaaagcgcagtgttagggtgggagtgacccgattttccaggtgccgtctgtcacccctttctttgactaggaaagggaattccctgaccccttgcactttctgggttaggcaatgccttgccctgctttggctcatgcatggtgcactgcacctactgtcctgcacccactgtccagcactccccagtgggatgaacccggtacctcagttggaaatgcagaaatcacccgtcttctgtgtcactcatgctgggaggtgtagactggaggtgttcctatttggccatcttggctccacccatgaactcatcattttttatttctgcatagtattccacggtgtatatgtgccacattttcttaatccagtctatcattgttggacatttggcttggttccaagtctttgctattgtgaattgtgccgcaataaacatgcgtgtgcatgtgtctttatagcagcatgatttctaatcctttgggtatatacccagtaatgggatggctgtgtcaaatggtatttctagttctagatgcctgaggaatcgccacaccaacttccacaatggtggaaccagtttaccgtcccaccaacagtgtaaaagtgttcctatttctccacatcctctccagcacctgttatttcctgactttttaatgatcgcctttctaactggtgtgagatggtatctcattgtggttttgatttgcatttctctgatggtcagtgatgatgagcattttctcatgtgttttttggctgcataaatgtcttcttttgagaagtgtgtgttcatatccttcacccactttttgatggggttgtttgtttttttcttgtaaatttgtttgagttcattgtagattcttgatattaaccctttgtcagatgagtaggttgcaaaaattttctccaagcaatggcaacaaaagccacaattgtcaaatgggatctaattaaactaaagagcttctgcacagcaaaagaaaccaccatcagagtgaacagccaccctacagaatgactttttttttttttaaagaaaaagccaaacctctttctaaaatgatccacccatcatttgcaggcattaaattcttcagctttaaatcattcactttttttttttttgctttaaggtgtcatacaatcacttcactttttctcaaatctctttcttagagctgtccttcacccacatatgagctgaattttcagtacaagataaaaaggtattttgccaaaaatgcaagattttagtgcctgctggcatacctgcagtgacaacttcacaaatttccttttctttttttacactgttccttatgctggattaatttatcttgaaatggcagacaaccacagcttcagactcaatctatggttcatatcaggcaattcaactttttcttggaatgtcatgactcttctctacatcttgggagcacttccagaatcactagtagcacttcgtgtacatttcatggtgttattcaaggtttaggatattgcactaaacatgatgaaaaacatacaggaaacatgagagattactttttctgtgatgcatactttaccagaggaagaaattgctcaagtgaagatcattaccatcacatggagttttaagctgatattttaaaaacttgagctcaccacaatagcatcataaggtggataagaagttattgcagtagtacttcttatagtactacttcttatagtagtagaaaagtagtgctacagtatgtagctacagttaattttatgcagtcatgattcaatactgcatctttacatttttttacatttcttttgactgcgagtggtacaatgtatggtctgtttttgtgtgtgcatgttttgataacttttaattttttataatatgtttatatatattttattatagtaaatgataaaatagactagttatctatatacattttatgcatttgttacatacttaactttttttccccatatttccaggctatgcagttgacctttgagttttctcaaattgtcacaaatctccagaaaattttccaatatatttatttttaaaaatccacatagaagtggacttaaaaagttcaaacccatgtttttcaaaggtcaattttattataaaataacattctatgtaaagaaagatgatgatgatgatttagatatgggagaatacttaagataaactaaggtggccaattccaactgagaaatggcagaagccagtgagtcagccatgagatgtgtttgcagtttggactgtctaaatgtcaagttcaaagttcagagagctaaaatgaggcccaaatgaggaaaatctgtttttttttttttgagatcagtttaagaagcagaacactgtctttctgctactgaggctggtgcatgaacccctgagggaaaagacaggtgtaggggaaccactgggtttcaggaggccttgacctcttcccaccaacagacatttaccttatcttttcacggatggaatctaccagccatgcctgaaaacaccaagtactgacctctggatgggaacctggcaaagactgagggcatacttatcttaatgggtacaatgtaacgtttcaatgtcactgagatacatctgaatatgtggggtcactggtgaaaatccaacagaatggggctagtatttgtttggagtagacaagaatgctttactttatgtcttacactgctgctttgctctgtcacaaggctttctataatggagacatacacacagatacctacaatatcccttactggaccagtttctataacccctcaatgaagagccttctggtggagttgaataaaagaacaaatttaagctcaagaaagaagcaggatcttttccactctctaactgcaacttatcaccagctgacccctagtgtgcagacaacagagccccaaatctccagtaagaagaaaggaatagggagtaatgtggcagagcccagccttcatagcaggcactggctcaggttatcactttggtattgtgagagggaagagcatggccatgtcctacatgcatgggtgtcacgttggacggtggtactgctgatagtgctcctgaatctgacatatcacgtcagtcttcctttgtccaagggaggagtgacaaaagggcttgggagaaaagcgttttctgtaagattaggaatactgaaaagagaatcctgcccccacctccaatgacctggaactatggatagaagctggtctgaacacagagaaaagtagactgtgtgtaaaaattcattttactgctaaaatcccaaatccaccagttctggaatctgttaaaatgagggtccatagacaaaaacggatgtaaatttttaaaagtgatttttcttgtttacagatctattgaagtataattgacaaataaaagtgtatatctttaagttatatcttgatgttttggtatacattgtgaaataatcaccacaatcaaattaattaatatatccatcaactcatataattttgggttttaccgctttttgtgttgagcaatttagatctgtctccttagcaaatttcaagtatataatgcagtgttgttaactatagccacattgctgtacattagatcttcagaatgtattcatcttgcataactgaaactttgtatcctttgatcatcatctcatttctccctcccccagccactggcaaccacccttttagtgtctgattctatgagtttgactattttacttacctcataagagtggaaacatgcagtatttgtccttttgtggctggcttatttcacgtaacataatgtcctcatgatggctgttgtcaagacaggaaaagacaacaagtgttggcgaggacgtggagaaattagaacacttgcatgctgttggtgggaatgcaacagtgaagctgctatggaaaacagcatggagattccttcaagaaactacaaatagaacagccatatgattcagcaattccacttttgggtatttatccaaaagaattgaaatcaggatgtcaaggaggtatctgcactccaatgtttatagtggcattattcacaatagccaagaagtggaaacaacctaaattccctcagtagatgagtggatttatgaaacaaacaaacaaaaaaacttgctaacagtttgtgaatatagcttcattgccttttggcttaaaacgctggtgtgaaaatctgagctcaaactatgtttcctccttgtatgtaatttgctttctctgcctggatatctgaataactacgtttttatctttgaacttaaataacttaaattggattcatctttgtcattatttctttacacatttttctgatatgtggtgtgatttttttgatccgcagctttattacatcttctatttcaaggaaaattttctatattatactgtttatattatattccattgtagcatcctctactttaaggaatccaactaaactaattttatattaactttttttctccatttttatgatttccctaatttctataattttgtgttcttgttcaaacacactgtaatgatcacaagacattttttcctgaagttattctttttaaaaataaaccttttattttagaatagtgttagatttacaaaaaaagtgaagatagtacaaatagcagagagactttcttctgttattaacatcttacattagtattgcagatttgtcacaattaataagtcaatacactataaagacacatgcacacgtatgtttattgtggtattattcacaacagcaaagacttcgaaccaacccaaatgtccaacaatgatagactggattaagaaaatgtggcacatatacaccatggaatactatgcagccataaaaaatgatgagttcatgtcctttgtagggacatggatgaaattggaaattatcattctcagtaaactatcgcaagaacaaaaaaccaaacaccgcatattctcactcataggtgggaattgaacaatgagaacacatggacacaggaaggggaacatcacactctgaggactgttgtggggtggggggaggggggagggatagcatcgggagatatacctaatgctagatgacgagttagtgggtgcagcgcaccagcatggcacatgtatacatatgtaactaacttgcacattgtgcacatgtaccctaaaacttaaagtataataataataaataaaaaaataagtcaatattagcatgtattaactaaagcctatacttagatttctgtgtttttacctaataactcttttctattctaggattccatccaggatatcacattacatttagtcatcatgtttccttaggtcctcctgctctaaaagtttctcagatttcccttgtttttgattaccttgatggtttttaggtgtactggtcaggaattttatagaatgtctcttacttgggatttgtctggtgtttttataatgattggagtgggattacaggatttgcggaagaagcctacagaggtaaaatgccattctcatcacattatatcaagtgtacataatatcaacatgatttttcactgctgagttttactttgatcacttggctgatggtgtttgtcaggcttgaacacggaaaagctactaattttttcacctttgcatactttactctttgaaataaagtcactatgagaaacccacattttctatctttttatttattttcattgtattttatgttattgaggtattcatgtgtcatggtggtttgctgcatctatcaacccatcatctaggttttaagccccgcatgcattagctatttgtcctaatgctctccattccctcgccccccacttcactactggccctggtgtgtgttgttcctctccctgtgtccattctattctcctccgtatattttcttcaataatgtatttatattaatatggaattgtggataattatttcatactctggattataatctaaacctactttattttgttgctcaacctatttcagctttgatcattggaactttttcagcggactcctgtgtccttttgacttactcttgtcatttattgtatttttgagcactttcttactttctggcattataggatacccctctaatcttttttctacctttattgtgggtataattgacaaataaaattgtataaatttaaggtatacaatgtgatgatttgatatatgtacacattgtaaaaatcacaatcaagttatttaacacatctttcaccacacctagttatcattttggtgcattgtggtgagaaatttaccatctactgttttagcaaatctcagatatacaatacattatttttaactatagttaccatgcgtacatcaaatcttattcatctcatcactgaaagttggtactctttgaccaacatttccccatttcccacacttctcagcccctcataaccatcattctactactgtctgtttctacgaatctggcatttttaggttccacatataggtggagtgcagtataagtgagatcactcagaatttatctttctgtagttgacttatttcatttagcataatgccttcaagattcatccgtgttgtcacaaatggcaagagttccttctttgctatggttgaatactattccattcatatatatatacacacagtataggtatatatgcataatacatatatacataatttttgtccgttcatctgttgacagacacttagattgcttccatgtctattggatattgtgaatattgctgcaatgaataatggctgttgtgaataatgctgcaatgaacatgggagtgcagagatctctaagacatactgatatcatctccttcagatatatacccaaggaatcatatggtagtatatttttaattttttgaggaaactccctactattttctataatggttgcatcaatttacaatcccaccagcagtgtacagggttttcttttctccatattcttgctaacgcttgttatctcttgtccttttgattatacctatcctaacaggtttaagaaaaaaagcatttgtcgaaatccaacatcctttcatgataaaaactctcaacaaattgagtatagaaagattgtgcctcaacatcataaaggccatatatgaaaaccccacagctaacatactcaacagtgaaaaactaaaaatttttcatctaagatgaagaataagataagggtgcctactctcaccatttctatttaacatactactagaagtcctagctagggctattaggcaagaaaaagaaacaaaagtatacatattagaaagggaaaagtaaaattgaccatgtttgcagatgacacgctcttacatatagaaaaccctaaaaaaaacaaaacccattagaattcataaattaattcagtaaagttatacaaagtaaacccacaaaaagtcagttgcatttatatacactaacagtgaactacctgaaaaagaaatgaagaaaacaatctcatttactaaactcgaaacaataaaatacttaggaacaaatttaaccaaggaagtgaaagatctgtaccctgaaaactataaggaaaaagttctgatgaaagaaattgaaaggacacaaataaattgaaagatatctcgtggtgtgcaagaattaatattgttataatgtccatactacccaaagtggacctatagattcaatgcaatccataccaaattccaggcatcacatttcctgatttcaaattatattacaaggatatatactcaaaacagtattatactggcttaaaaacagacatatagaccaagggaacaaaacagagagccctgaaataaactcaagcacataaggtcaacttacctttggcaggtgtgccaagaatacacaatggggatgggagagtctcttcaataaatgatgttggggaaactggacattcatatgcaaaacactgaaattgaactcctatcttacagcatacacaaaaacaaactcaaaatagtttaaaggcttaaatgtaagacttaaaaccagaaacctcctaggagaaaatataagggaaaaagtccttgacattgctcttggcaattattttttggctatgacaccaaaagcgaaaagcaaataaaacaaaaataaacaagtgagacttcggcaaactgagaagcttctgcacagtaaagaaacaaacaatagaattaacaggcagactatagaatgggagaagataattacaagccatgtaactgataagaaattatcatccaaaatatataaggaactcatacaattcaatagcaaagaaacaaataacccaatttaacaatggggaaaggacctaaatagacattttccaaaaaaaatcataaaaatgtccaggccaggcacagtggctcacacttgtaatcccagaactttgggaggccaaggcgggcagatcatgagttcaggagatcgagacgaccctggctaacatggtgaaaccccgtctctaataaaaatgcaaaaaaattagtcaggcgtggtggcaggcgcctgtagtaccagctactcgggaggatgaggcaggagaatggtgtgaacccagaaagcagagcttatagtgaggcgagatggtgccactgcactccggcctgggtgacagagtgagactccatttgaaaaaaaaaaaaaagtccaaaaggtatattaaaatgtgttcaacatcactaatcataaggaaaatgcaaatgaaaaccacaatgagatatcacctcacacctgttaggatggctattatcaagagaacaagaggtaacaagtgttggtgagagtgtaaagaaaagagaacccttgtatactgttggtaaggatgtaaactggtaaagcaattatggaaaacagtatggaggttcttaaaaaataaacatggagggtggagccaagatggccgaataggaacagctccagtctacaccacccagtgtgaacaacacagaagatgggtgatttctgcatttccaactgaggtaccgggttcatctcactggggagtgccagacagtgggtgcaggacagtgggtgcagctcactgtgcatgagcaaagcagggtgaggcattgcctcacccaggaagcacaaagggtcagggaattccccttcctagtcaaagaaaggggtgacagacggcacctggaaaatcggatcactcccaccctaacactgcacttttccaatgggcttatcaaatggaacaccaggagattatatcctgcacatggctcggagggtcctacacccacggagcctcgctcattgctagaacagcagtctgagatcaaactgcaaggtggcagcgaggctgggggaggggcacccgccattgcccaggcttgagtaggtaaacaaagcagccaggaagctcaaactgggtggagcccaccacagctcaaggaggcctgcctgcctctgtaggctccacctctgggggcagggcacagacaaacaaaagacagcaataacctctacagtcttaaacgtccctgtctgacagttttgaagagagtagtggttctcccagcatgcagcttgagatctgagaacgggcagactgcctcctcaagtgggtccctgacccccgagtagcataactgggaggcacccccaagtaggagtggactgacacctcacacggctgggtactcctctgagacaaaactttcagagggacaatcaggcagcagcatttgtggttcaccaatatccgctgttctgcagccactgctgctgatacccaggcaaacagggtctggagtggacctccagtaaactccaacagacctgcaggtgagggtcctgactgttagaaggaaaactaacaaacagaaaggacatccaccccaaaaacccatctgtacatcaccaacatccaagaccaaaggtagataaaaccacaaagatggggaaaaaacagagcagaaaaactggaaactctaaaaatcagagcacctctcctcctccaaaggaactcagctccccaccagcaatggaacaaagctggacggagaatgactttgacgagttgagagaggaaggcttcagaagatcaaactactccgagctaaaggaggaagctcaaccaatggcaaagaagttaaaaactttgaaaaaaaattagacgaatggataactagaataaccaatgcagagaagttcttaaaggacctgatagagctgaaaaccatggaacgagaactacgtgatgaatgcacaagccttagtaactgatacgatcaactggaagaaagggtatcaacgatggaagacaaaatgaatgaaatgaagcatgaaaggaagtttagagaaaaaagaatacaacgaaatgaacaaagcctcaaagaaatatgggactatgtgaaaagacaaaatctacgtctaattagtgtacctgaaagtgatggggagaatggaaccaagttggaaaacactctgcaggatattgtccaggagaacttccccaatctagcaatgcaggccaacatttaaattcaggaaatacagagaacgccacaaagatactcctcgaaaagagcaactccaagaaccataattgtcagattcaccaaagttgaaatgaaggaaaaaatgttaagggcagccagagagaaaggtcaggttacccacaaagggaagcccatcagactaacacctgatctcttgggagaaactctgcaagccagaagagagtggggaccaatattcaacattcttaaagcaaagaattttcaacccagaatttcatatccagccaaactaagcttcataagtgaaggagaaataaaatcctttacagacaagcaaatgccgagagattttgtcaccaccaggcctgccctaaaagagctcctgaaggaagcactaaacatagaaaggaacagctggtaccagccactgcaaaaacatgccaaattgtaaagaccatcaaggctaggaagaaactgcatcaactaacgagcaaaataaccagctaacatcataatgacaggatcaaattcacacataacaatgctaacctcaaatgtaaatgggctaaatgctccaattaaaaggcacagactggcaaattggatagagtcaagacccatcagtgtgctgtattcaggaaacccatctcacgtgcagagacacacatagactcaaaataaagggatgcaggaagatctaccaagcaaatggaaaacaaaaaaaggcaggggttgcaatcctagtcactgataaaacagactttaaaccaacaaagatcaaaagagaaaaagaaggccattaaatagtggtaaagggatcaattcaacaagaagaactaactatcctaaatatatatgcacccaatacaggagcacccagattcataaagcaagtccttagtgacctataaagtgacttagattcccatacaataataatgggagaggttaacacaccaccgtcaacattagacagatcaacgagacagaaacttgacaaggatatccaggaattgaactcagctctgcaccaagtggacctaatagacatgtacagaactctccaccccaaatcaacagaatatacatttttttcagcaccacaccacacctattccaaaactgaccacacagttggaagtaaagcactcctcagcaaatgtaaaagaaaagaaattataacaaactgtctctcagaccacagtgaaattaaactagaactcaggattaagaaactcactcaaaaccactcagctacatggaaactgagcaacctgctcctggatgactactgggtacatacgaaatgagggcagaaatgaagatgttctttgaaaccaatgagaacaaagacacaacataccagaatctctgggacacattcaaagcagtgtgtagagggaaacttatagcagtaaatgcccacaagagaaagcaggaaagatccaagattgacactcttacatcacaattaaaagaactagagaagcaagtgcaaacaccttcaaaagctagtagaaggcaagaaataactaagataagagcagagctgaaggaaatagagacacaaaaaacccttcaaaaaatcgatgaatccagggctggttttttgaaaagatcaacaaaattgatagaccgctagcaagactaataaagaagaaaagagagtagaatcaaatagatgcaataaaaaatgataaaggggatatcaccaccgatcccacagaaatacaaactaccatcagagaatactataaacacctctacgcaaataaactggaaaatctagaagaaatggagaaattcctcaacacatacaccctcctaagactaaaccaggaagaagttgaatctctgaatagaccaataacaggctctgaaattgaggcaataattaatagcttaaaaaccaagaaaagttcaggaccagacggactcacagccgaattctaccagaggtacaatgaggaactggtaccattccttctgaaactattccaatcaatagaaaaagagggaatcctccctaactcattttatgaggccagcatcatcctgataccaaagcctggcagagacacaacaaaaaatgagaattttagaccaatatccttgatgaacattgatgcaaaaatcctcaataaaatactggcaaaccgaatccagcaacacatcaaaaagcatatgcaccacgatcaagcgggcttcatccctgggatgcaaggctggttcaacatatgaaaatcagaaagcgtaatccagcacacaaacagaaccaaagataaaaaccacatgattatctcaatagatgcagaaaaggcttttgacaaaattcaacaaggcctcatgctaaaaactctcaataaattaggtattgataggacgtatctcaaaataattagagctatctatgacaaacccatagccaatatcatactgaatgggcaaaaactggaagcattccctttgaaaactggcacaagacagggatgccctctctcaccactcctattcaacatagtgttggaagttctggccagggcaatcagacaggagaaggaaataaaaggcattcaattaggaaaagaggaagtcaaattgtccctctttgcagatgacatgattttatatctagaaaaccccatcgtctcagcccaaaatctccttaagctgataagcaacatcagcaaattctcaggatacaaaatcaatgcacaaaagtcacaagcattcttatacaccaatagcagacaaacagagagccaaatcatgagtgaactcccattcacaattgcttcaaagagaataaaatacctaggagtccaacttacaagtgatgtgaaggacctcttcaaatagaactacaaaccacggctcagtgaaataaaagaggatacaaacaaatggaagaacattccatgctcatgggtaggaagaatcaatatcgtgaaaatggccatactgcccaaggtaattatagattcaatgccatccccatcaagctaccaatgactttcttcacagaattggaaaaaactactttaaagttcatatggaactaaagaagagcccacattgccaagtcaatcctaagccaaaagaacaaagctgggggcatcacactacctgacttcaaactatactacaaggatacagtaaccaaaacagcatggtactcttaccaaaacagagatatagaccaatggaacagaacagagccctcagaaataatgccacatatccacaactgtctggtctttgacaaacctgacaaaaacaagcaatgaggaaaggactccctatttaataaatggtgctgggaaaactggctagccatatgtagaaagctgaaactggatcccttccttacaccttgtacaaaaattaattcaagatggatgaaagacttacatgttagacctaaaaccataaaaaccctagaagaaaacttaggcaataccattcaggacatagggatgggcaaggacttcatgtctaaaacaccaaaagcaatggcaacagaagccaaaattgacaaatgggatctaattaaactgaagagattctgcacgcaaaagaaaccaccatcagagtgaataggccacctgcagaatgggagaaaatttttgcaacctactcatctgacaaagggctaatatccagtatctacgatggactcaaacaaatttacaagaaaaaaacaaacaaccccatcaaaattgggtgaaggatatgaacagacacttctcaaaagaagacatttatgcagccaaaacacacatgaaaatatgctcatcatcactggccatcagagaaatgcaaatcaaaaccacaatgagataccatctcacaccagttagaatggcaatcattaaaaagtcaggaaacaacaggtgctggagaggatgtgaagaaacaggaacacttttacacagttggtgggactataaactagttccaccattgtggcagttggtgtggcgattcctcagggatctagaactagaaataccatttgacccagccatcccattactgggtatatacccaaaggactataaatcatgctgctataaagacacatgcacatgtatgtttattgtggcactattcacaatagcaaagacttagaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaaaccaaacactgcatgttctcactcataggtgggaattgtacaatgagaacatatggacacaggaaggagaatatcacacagtggggactgttgtggggtgggggaaggggggagggatagcattaggagatatacctaatgctaaatgatgagttaatgggtgcagcacaccaacatggcacatgtatacatatgtaacaaatctgcacgttgtgcacatgtatcccaaaacttaaagtataataataaaaaaagaattatgagttcttgtcctttgtagggacatggatgaagctggaaaccatcattttcagcaaactattgcaaggacagaaaaccaaacaccacatcttctcactcatatgtgggaattgaacaatgagaacatgtggacacaggaaggggaacatcacacaccggggactgttgtggggtggggggatgggggagggatagcattaggtgatataactaatgctaaatgatgagttaatgagtgcagcacactaacatggcacgtgtatacatatgtaagaaacctgcacgttatgcacatgtatcctaaaacttaaagtataataataataataataataaataaaaataaataaataaaaagtcaaaataactggagaaatagcttctgccaaccaagaagcaagtgagttcctcgacactattaagaaaatcattgaggggaggccgggcacagaggctcactcctgtaatcacagcactttgggaggccaaggcaggcaggtcacctgaagtcaggagtttgagaccagcctgagcaacatgatgaaactccatctgtattaaaaatacaaaaaattagccaggcttggtggtgtgtgcctgtaatcccagtgacttgagaggatgaggcaggagaatcgcttgagcctgggatttggaggttgcagtgagccgagatcacaccactgcactccagcctggatgacagaatgatattctgtctcaagaaaaaaaaaagaaaagaaaagaaaaaaagaaaaaagaaaaagaaaatcattgaggggaaagggtatttgtcataacaggttttaatgcagattgaagtgccctattctggaaaaaatgtcacaaaggacatttattaataaggaagagaaatgaacaccaggacttaaggcttgaagggataggctatctctactgttttgtgtaaaagcagtcagccttataattggaactgctgctcacccctgtgcctggaagggaaaaaataaataacagttggcagtcttttgattgtacaacaggaaggcctggacaatgagagcttttactgaattggttacatttacaccttgtccctcaaggcaggaagtactttgctactaagggaccaccttttaaagttcttttaattttgaacaatgtccctggagacccagaatcctataagtacaacaccaaatgcatggaagtagtctacttgtcccccaacacaatgtctctaattcagcctctagatcagggggtcataaggacctttaagtctcattatatatggtactctaagaaaaagattatcaacactatggaagagaaccctgatggaaagaacataatggaagtctacaaggattacatcattgaagatgccatcgttgttacagaaaaagctatgaaagccatcaagccccaaacaataaattcctgctggggaaaactgtccagattttgtgtacgagttaacaggatttatggtggaggcaatcaaggacatcatgaaagagattgtgaatattgaaaaaacaaggtagggggtgaaggatttcaagatacggatcttggagaaattcaagagctaacagacaccacaccagaggaattgacagaatgcaacttgatggagacaagtgctttcaatgtcagacgatgagaaagaagacagaagaagcaatgccagaaaaccaattgacattagataatatgacagtagagttccagttatttaagactgcttttgatttcttttaggacactgaccttctatgatacaggcactgaaatgaaagcaaacagtgggagaaggattggtacagtatagaaacatttttagaaaaatgaaaaacagaaaagtcagacagaaattacaatgtgtttctgtacagttacaccaaatgtgcctacctctcctgcctccccttccatctgctccaccttttccacctctactactcccgatgcagaaagaccaacccctctttctcctcctccttctcagtctagtcattgtaaagatgacaaggatgaagacctttatgatgatcaatactcaaacattcacttaatgaatagtaaatttattcctcttctttatgattttcttacattttcttttctctagcttactttattgtaagatagagtatataataggtataacatataaaatatgtgttaattaactacttacgctatcagtaaggcttctggttaatagtaggctattagaagttaattttggcagggaatcaaaagttatacacagatttttcaacttcacggtggaggggggtcagtgctcctaatcctgtgttatgcaagggtcagctacccctcacattttaccttcagatagacaacacatatcactactgtctttttgcttttcagctattactaagttgtatattgaaaatatttttgcacattcttgtgtacctagacaaaaactgccctatctaccccaaacaaaaggatctgtggaaagaaattatttatctgatgacaaatttttcctctatgacaactatctgaataagcctcacaagtatgctagttgatcagtgtctcacggtggcctgtattaactgtcctagagctgctggttaccattgaaaaaccaatgttgcactttacataagctctcatcagagtcttttcctctgccctccccaagtaaatcccactgtgaggccactcccatgctgcatgcacagtgggatcattgcaaatttctacccacttcatgtctcaggagaggggaaggaaagatcttatggcaagaaatcggaagattacagtgatttcaatatgagaagaacgtcttcatttcacttcattcaaaatcaaaatgttgcttataattttctatcagcttgataacaattcaggcccacagtgaattataacaagacatatatcttgggaaatatatcactaaaattctgaaatagatgggttccactgttttgttactctacagcacttgcaaaatcgtccttggtatctaacaaacatggattcaacatttttatggcttgtgaaattaaattctctatttcattttagaagtttgatataatgaatttccaataacagcagcagggcaaattccatctggaattccttgttatgtccctgagaagatgattcagtttcaccccttgtgccccatggtggggaattcttcatgggatattatacaagaggctcaatatttcgttccttttttcttttaacagcaaagcatacatcagtctactacctttgcaatatgtttcccaagcagacacatgaatgcagcttgcttctaaaagaggagtgccttcatgtccttgtacctttccctgcagctttattactggtgagatgtcagcaactagcttttcaccaaaagcaatgtttaaagtgagacctttgctatgttaagttttacaaacagctttaatttccgatagctaatgttaagagcttgtggtaaggaaaagaaaaggggaacttgcggaatttcatattttgatcactgcacaggcatcaggaagatgtgttcctatgccttcttcctgctcctggctttctgcttgtcaccttgtagtacaacctcctgtctctctcctccatcgctccctcatctcccctgcctctgccctctctgtttgctgccatctatctatctatctatctatctatcatctatctatctatctatcttttatctatctatctcactttctttctctctctccccccctctttcctgcatcgtttcagtcctccaactggcttttcattccatccttctcctatccatgatttctccttctgtattccaggtttgagactctttcatcactttgctctcccacacacatctctggctgtttccccactaccgggaaagccaacatgtgggaagatcatcagtacatacacatatccaccagtctctctgtcaggccattcattttttccatttggtttttcaactcattcattcattcactcattcatgcctccaataaacatatttgagattctaatatataataggcactggactatgcaggcccttaggatatacagtggagaagaaaacagacaatgatactttcaccctggggctttcactgcaatggggagagagatgtttcaaaaagaatccctctaaaactatgtatcattatgacatatactgggataaatggtatagaggaagtttccagagcactaagagaaagtaaaagagaaaaaataatttaaattgagggtgaagtgttttgtggccagaaaatgctatcatgaagaagtgacatttaagctgaggacttggaaatatgcatgaggtagacaggtgaacagcaaagagggttaccagttcaggggtattggaagcaaaactataaagtcagtcactaaaaccaacaagcatggcttcaacaggggattaagagaaggtcagaataattcaagcaaggggagggtggggatatgttagggtcagagggttgagaaaatcatttccagctcatatcactgttcttgccattctgttaggcaaggcccccatcttcttgccattcatttatttgatcctttttgtttacattctctactcccactgtgcactgctcatctaaatgtaccattctaatatgtttattatttatcatttttcttatgtgataaaaacacaaaatgtgagctttgtaggggggcggttccaagatggccgaataggaacagctccagtctacagctcccagtgtgagcaacacagaagacagttgatttctgcatttccaactgaggtactgggttaatctcactggggcttgtcagacagcaggtgcaggacagtggatgcagccccctgagcgtgagccgaagccgggtgaggcatcgtctcacccaggaagcacaaggagccagggaattccctttcctagccaagggaagctgtgacagatggcacctggaaaattgggtcactcccaccctaatactgtgcttttccaatggtctgagcaaatggtacaccaggagattatatcccgtgcatggcttggagggcctcatgcgcccacagagcctgtctcattgctagcacagcagtctgagatcgaactgcaatgcagcagcaaggctgggggaggggcacccgccattgctgaggcttgagtaggtaaacaaggcagccgggatgctcgaaatgggtggagcccaccgcaaatcacggaggcctgcctgcctctgtagtatccacctctgggggcagggcatagccgaacaaaaggcagcagaaacctctgcagacttaaatgtccctgtctgacagctttgaagagagtagtgcttcccccagcacggagtttgagatctgagaacagacagactgcctcctcaagtgggtccctgacccctaagtagcctaactaggaggcacccccaagtaggggcagactgacaccccacacagctgggtacccctgtgagatgaagcttccagaggaacaatcaggcagcaacatttgctgttcaccaatatccactattctgcaacctctgctgctgatacccaggcaaacagggtctggtgtggacctccagcaaactccaacacacctgcagctgagggtcctaactgttagaaggaaaactaacaaacagaaaggacattcacaccgaaaccccatctgtatgtcaccatcatcaaagatgaaaggtagataaaaccacaaagatggggaaaaaacagagcagaaaagctgaaaattctgaaaatcagagtgcctctcctcctccaaaggaacacagctccttgccagcaaccgaataaagctgcacggagaatgactttgacaagttgagggaagaagacttcagatgatcaaacttctccaagctaaaagaggaagttcgaacccatcgcaaagaagctaaaaaccttgaaaaaagattagatgaaccgcgaactagaataaccagtgaagagaagtccttaaattacctgaaggagctgaaaaccatggcacgagaactacaggatgaatgcacaagattcagtagccgattcaatcaactggaagaaagggtatcagtgattgaagaccaaatgaatgaaatgaagtgagaagagaagtttagagaaaaaagagtaaaaagaaatgaataaagtctccaagaaatatgggactatgtgaaaagaccaaatctacgtctgattggtgtacctgaaagtcacagggagaatggaaccaagttggaaatcactcttcaggatattgtccaggagaacttcctcaacctagcaaggcaggccaacattcaaattcaggaaataacagaggacatcacaaagatactcctcgagaagagcaactccaagacacataattgtcagattcaccaaagttgaaatgaaggaaaaaatgttaagggcagccagagagaaaggtcaggttacccacaaagggaagcccatcagactaacatctgatctctcggcagaaactctacaagccaggagagagtgggggccaatattcaacactcttaaagaaaagaattttcaacccagaatttcatatccagccaaactaagttccataagtgaaggagagataaaatactttacagacaagcaaatgctgagagattttgtcaccactgggcctgccctaaaagagctcctgaaggaagcactaaacatggaaaggaacaacctgtaccagccactgcaaaatcatgccaaattgtaaagaccatcaaggctaggaagaaactgcatcaactaaagagcaaaataaccagctaacatcataatgacaggatcaaattcacacataacaatattaactttaaatgtaaatggactaaatgctccaattaaaagacacagactggcaaataggataaagagtcaagatccatcagtgtgctgtattcaggaaacccatctcacgtgcagagacacacataggctcaaaataaaaggatgaaggaagatctaccaagcaaatggaaaacaaaaaaaggcaggggttgcaatcctagtctctgatataacagatcttacaccaacaaagatcaaaagagaaaatgaaggccattacataatggtaaacggatcaattcaacaagaagaccaaactaccttaaatatatatgcacccaatacaggcgcacacagattcataaagcaagtccttagagacccacagagacttagactcccacacaataataatgggagatgttaacaccacactgtcaacattagacggatcaatgagacagaaagttaacaaggatatccaggaattgaactcagctctgcaccaagtggacctaatagacatgtacagaactctccaccccacatcaacagattatacattcttctcagcaccacatagcacttattacaaaattgaccacatagttggaagtaaagcactcctcagcaaatgtaaaagaacagaaattataacaaactgtctctcagaccacagtgcaatcaaactacaactcgggattaagaaactcactcaaaaccgctcaactacatggaaactgaacaaccttctcctgaatgactactgggtacataacgaaatgaaggtggaaatgaagatgttctttgaaaccaatgagaacaaagacacaacataccagaatctctgggacacattcaaagcagtgtgtagagggaaacttatagcactaaattgcccacaagagaaagcaggaaagatccaagactgacacactaacatcacaattaaaagaactagagaagcaagagcaaacacattcaaaagcaagtagaaggcaagaaataactaagatcagagtagaactgaaggagataaagacacaaaaaaacccttcaaaaaatcaatgaatccaggagctggttttttgaaaagatcaacaaaattgatagaccactagcaagaataataaagaagaaaagagagaagagtcaaatagacgcaataaaaaatgacaaaggggatatcaccaccgatcccacagaaatacaaactaccatcagaaaataccataaacacctctacgcaaataaactagaaaatctagaagaaatggaaaaattcctcgacaaatacaccctcccaagactaaacgaggaagaagttgaatccctaaatagaccaatgacaggctctgaaattgaggcaataattaatagcctaccaaccaaaaaaagtcgaggaccagatggattcacagccgaattctaccagaggtacaaggaggaactggtaccattgcttctgaaactattccaatcaatagaaaaagagggaatcctccctaactcattttacgaggccaggatcatcctgacaccaaagcctggcagagacacaaccaaaaaagagaattttagaccaatatccttgatgaacatcgatgcaaaaatcctcaataaaatactggcaaaccgaatccagcagcacatcaaaaagtttatccaccacaatcaagtgggcttcatcgctgggatgcaattctggttcaacatacacaaatcaataaacgtaatccagcatataaacagaaccaacgataaaaacaacatgattatctcaatagatgcagaaaagatctctgacaaaattcaacagcccttcatgctaaaaactctcaataaattaggtattgatgggacgtatctcaaaataataagagctatttacaacaaatccacagccaatgtcatactgaatgggcaaaaactggaagcattccctttgaaaactggcacaacacagggatgccctctctcaccactcctattcaacatagtgttggaagttctggccagggcaatcaggcaggagaaagaaataaagggcattcaatgacgaaaacgggaagtcaaattgtccccgtttgcagatgacatgattttatatctagaaaaccccatcgtctcagcccaaaatctccttaagctgataagcaacttcagtaaagtctcaggatacaaaatcagtgtgcaaaaatcacaagcattcttatacaccaataacggacagagagccaaatcatgagtgaactcccattcacaattgcttcaaagagaataaaatacctaggaatccaacttacaagggatgtgaaggacctcttcaaggagaactacaaaccactgctcaacaaaataaaagagtacacagacaaatggaagaatattccatgctcattcagaggaagaatcaatatcataaaaatggccatactgcccaaggtaatttatagattcactgccatccttatgaagctaccaatgactttcttcacagaattggaaaaaactactttaaagttcatatggaaccaaaaaagagcccacattgccaagacaatcctgagccaaaagaacaaagctggaggcatcacgctacctgacttcaaactataatacaaggatacagtaaccaaaacagcatggtactcgtaccaaaacagagatatagaccaatggaacagaacagagccctcagaaataatgccacatacctacaactatctgatctttgacaaacttgacaaaaacaagcaatggggaaaggattccctatttaataaatggtgctgggaaaactggctagccatatgtagaaagctgaaactggatcccttccttacaccttatacaaaaattaattcaagatggatgaaagacttacatgttagacctaaaaccataaaaaccctagaagaaaacctaagcaataccattcaggacacaggcatgggcaaagactttatgtctaaaacaccaaaagcaatggcaacaaaagccaaaactgacaaatggcatctaattaaactaaagagcttctgcacagcaaaagaaactacaatcagagtgaacaggcaacctacagaatgggagaaaatttttgcaatgtactcatctgacaaaggcctaatatcaagaatctacaaagaactcaaacaaacttacaagaaaaaaacaaacaactccatcaaaaaatgggcaaagggtatgaacagacacttctcaagagaagacatttgtgcagccaaaaaacacatgaagaaatgctcatcgtcactgcccatcagagaaatgcaaatcaaaaccacaatgagttaccatctcatacctgttagaatggcgatcattaaaaagtcaggaaacaacaggtgctggagaggatgtggagaaataggaacacttttacacagttggtgggactgtaaactagttcaaccattgtggaagtcagtgtggcaattcctcaaggatctagaactagaaataccatttgacccagccatcccattactgggtatatactcaaaggattataaatcatgttgctataaagacacatgcacatgtatgtttattgcggcactattcacaatagcaaagacttggaaccaacccaaatgtccatcaatgatagattggattaagaaaatgtggcacatatacaccatggaatactatgcagctataaaaaatgatgagttcatgtcctttgtagggacatggatgacgctggaaaccatcattctcagcaaactatcacaaggacaaaaaaacaaacaccgcatgttttcactcataggtgggaattgaacaatgagaacacttggacacaggaaggggaacatcacacagcggggcctgtcatggggtgaggggaggggggagggatagcattaggagatatacctaatgtaaatgacgagttaatgggtgcagcacaccaacatggcacatgtatacatatgtaacaaacctgcacattgtgcacaggtaccctagaacttaaagtataataataataattataagagagctttgtagaggctagctatttttgaaaattaaaaaaagcaaaaacacataatgtgtgacatgtgttcttgttttacgtaagattatttttagatatatcattatgcatattatataatatgatatatagatagatagggatatcccatactgtgtctattttttatttttttcgagatagggtctcactctgtcaccccagctgcagtgcagtggcatcttcttagcttactgcagcccggaactccttggctcaagtgatactcctgcctcagtctcccaagtggctgggactggaggcatgccccatcacacctggctaatttttaaattttttatagtgactggggctcactatgttggtgaggttgatcttcaactcctggcctcaagcgatcttcctgcctcgcccccacaaagtgctgggataacaggcgtgagccaccacgcccggcttctttacatctttattaattataatcgacatatgttagactgagcatatttaacatatatgatctaataagttttggtatcacacctgtgaaacaatcattatagtaatgataatgaacacctgtattacaaacaaaaatatatcctcgggctcctttgaaattccagaattttaataaacgtaatcttactccctgcaccctttttttttggtttagcttctttcagagagcatattttcagatgcgtttatgttgtcataagtatcaacaattcatttctttttaatgcgctgtagtattccgttgtatggacatagcacaatttcataattcatctccctgttgatggacacttgggttgtcttcaggcttttggctattacaaataaatttgctatgaatattcataaacaagtaatcatatgaaaatatattttcttttctcctgtgtatgtcttggagtggaatggctggtttatgggaggtgaatatttaactgggtaagcgactaccaaaccaatttccgaagtgtttccatcattcagaagttccacatcattgctagcactgggtataatcagttattttaatttcaatcatgctcatgtatctacgacagtatttaaatttgattttaatctgcatttcctgaatgataaatgatggtatctttttgtgtggttgttagccatctgtgtatcttctttggtgaggtagtctgttgaagtcttttctccatatttatagttgagtatttgccttcttataattgagttataagacttctttatagtctagaagtgtcctgtgttggatatagatatatgaattctaaatattttatcacagagtgtggatttctctttcaatttcaaaagaatgccttttaaaggccaaaaactttaattgtggtggaatcaaatgtattaatttttcttcttttatagtttgtggtttgggtgtctcattttgaaaatctttgccaaaaccaaaaagatgaagaaagttgtaatttcctcaaagagggcattacataagggtaaagggttcaattcaacaagaaggcttagcaatcctaaatatatatgcacccaacaataggagcactggcacctaacaacaggatcattcagattcataaaacaagttcttagagactgacagagggtcttagataaccacaaaataatggtgggagacttcaacaccccactgacagtattagacagatcatcaggcagaaaactaacaaagttatccgggatctgaacagtatgcttgaccacatagactgaacagactattctacaggactctacaccccaaaacaacagtatctacattcttctcatctgcacatgaaacatactgtaaaactgagcacacaattggccataaatcaattttcagcaaaataaaaacaaaccgaaaaattaccaaccaccctctcagaccacaatacaataaaaacagaaatcaatactaagaagatcatttaaaaccatacaataacaaggatattaaacaaactgctcctgagtgacttttgggtaaacaatgaaattaaggcagaaatcaagaaattctttgagattaatgaaaacaaagctaccacataccagaatctctgggacactgctaaagcagtgttaagaggaaagtttttagtgcaaaatgcccatgtcaaaaacttagaaagatctcaaattaataatctaacatcatacctagaggaaccagaaaaacaagagcaagccaaccccaaagctagcagaaaacaagaagtaacaaaaatcagaacttaactgaatgaatttaagttgcaaaaaaccatacaaaagatcaatgaaaccaggtgttggttatttgaaagaaaaaataagactgataaacccctatctagactaatttttaaaaaaaagagagaagatcctaataaacacactcagaaatgacacagtggacattaccaccaaccccagagaagtaccgaaaaaccccagagactgttatgaacacctgtatagacacaaactagaaaacctacaagaaatcaataaattcctcccaaatcaatcaaatacaccctcccaagatggagccaggaagaaattggttcctgaacacaccaataatgagctctgaaattgattcagtaataaatagcctaacaacaagaacaacaacaaaacaactacaacaacaacaagaaaaaaggacccgaggaattcacagctaattctaccagatgtacaaagaagagctggtgctattcctacagaaactattccaaaaaaaaaaaaaaaaacaaaaactgaggaggagggacttctccccaactcattctatgaggccagcatcattttgataccaaaatctggcagagacacacacacaacaaaagaaaacttcaggccaatatccttgatgaacatcgatgcgaaaatcctcaacaaaatactggcaatccgaacctagctgcacatcaaaaagctaatccaccacgatcaagtaggctccatccccgggatgcaagtttggttcaacatacggaaatcaataaatgtgattcatcatatacacagatctaaagacaaaaaacgtatggtgatctcaatagatgcagaaaaggcttttgataaaagttaacatctcttcatggtaaaaactctcgataaactcaatattgaaggaacatacctcaaaataatgaaaatccatctgtgacaaacccacgccaatatcatactgaatgggcaaaagctggacgcattctccttgtaaaccggcacaagacaaggttgccctctctcattactcctactcaacattgtactggaagacctggtcagggcgaccaggcaagagaaataaataaagtgtatccaaataggaagaaaggaagccaaaccacctctgtttgcagatgacatgattctatatctagaaaaccccatagtcttggccaaaaagctccttcagctgataaacgacttgagcgaagttgtaggatacacaatcaatgtacaaagatcactagcattcctatacaccaccaccaaccaaactgagagccaaatcagaaaggcaatcccattcccaattgccacacacacaaaaataaaacacctaggaatacagctaaccaggaaggtgaaagatctccacaatgagaattacaaaacactgctcaaagaaatcagagcagacatgaacatatggaaaaacatcccatgctcatggataggaagaaccaatatcattaaagtggctacactgcctaaagcaatttatagattcaatgctattcccatcgaactaccaaggacattcttcacagagctagaaacaattatttaaaaatgtacatggaaccagaaaaggagcccggatagccaaggcaatcgtaagctaaaagaactatactgcaaggctacaatgaccaaaacagcatggtactggtactggcacaaaaacaggcacatagaccaatggaacagaatagagaggccataaataatgtcgcacatctacaaccagcttttttctttttttttttttttgacaaagctgacaaaaacaagcggtgggaaaaagactccatattctatcaatggtgctgtgataactggctagccgtatgcagaggattgaagctggaccccttccttacactatctacaaaaatccacatgagatggattaaaggctttaatgtaaaacccaacaccataaaaaccctggaagacaacctaggcaataccatcctggacataggagcaggcaaagatctcacgacagaggcaccaaaagcaatcacagcaagagtaaaaattgacacatgggatctaattaaacttagagcttctgcacagcaaaagaaactatcaacagagtaaacagacaacctacaaagtgggagaaaatttttgcaacactattcatctaacagaggtctgatatccagcatctataaaaagcctaaacaaatgcacaagagaaaaacaaacaaccccattaataagggggcaaatgacatgaacagacacttctcaaaagaagacatacatgtagccaagaagtatatgaaaaacagctcaatatcactgatcattagagaaatgcaaatcaaaaccacaatgagataccatcccataacagtcagaatggctgttactaaaaacaaaaaatagcagatgctggcgaggttgccaagaaaaggaaacccatatacacggttggcgggagtgtacattagctcaaccattgtggaaagcagtatcgcaattcctcaaagagctaaaagcagaactaccatttgacccagcaatcccattactgggtatagagccagaggaatataaagcattctaccataaagacacatgcacctggactattcactgcagcactgttcacaagagcaaaaacgtggaatcaacataaatgcccatcaatgacagactggatacggaaaatgtggtgcatatacaccatggaatattatgcagccataaagaagaacaaggccgtgtcttttgtgggaacaggcatggagctggaggctataagctcagcaaactaacgcaggaacagaaaagcaaatcccacatgttctcacttagaattgggagctaaatgataagaacttatgaacacaaagaaggaaacaacagacactggggtctccttaagggggagggtgggatgacggagaggagcagaaaagagataactcttggatagtgagttcaatacctgggtgatgtagtcatgtgtgcaacgaacccccgtgacacgtgtttatctatgtaacaaaccttcacatgtacccccaaacataaaagttttaaaaaatattacagtgcaagtctattgatgatcaattctttcaacttctgtatgtctaaacacctactattttaacttcatttgaaaagatattcattgagtatagacttaagagttgacatttatttttatttcacgattttaaagatggtgtgccacatgacttctgacttgcatattgctaatgagaaatgtgctgtcattcttctctttggacatctaaatgtttcttatggttttcttctgattttctagttacttaggagaaagggtaaatctctgggcgagcagataggtaaaatgtcaggaatgcacaccatggattctctgtgcatagcaccttggacatactttagattatgcgtggcaacgtggaggcctcctgaaagcacagggctcagtgaaaagaaaattaagaaatccggtggatacttgtatttccagccatgatggattaacaggaaccggacttaccgtctcgcctaaatacctataaaccaaaaaaattataaggcttaacgtcatggcaccacctgcatacgggacagtgatccctgagagaaagggaacctgaccaggtgagccctctgatcgcccaattccaccaacttcttgcccggatagagtttgcaggctgcagcacaggggagctgaacacaacagagcccggtggaccgtctgagtgaaggagacagagttgagagctcaagaggtccataggaccagaatttgccgggagtaatggagagaagacagctgcacagagaggcagctctggagacccttcagagcttgcccttctggatgcagcgtatcagaaacggggagtggtgatcgatgactcccagtttctggagtgagtggttgtgtggataatggcgccatttactgagactgtgaagatgggttggggggggggggaacaggagcgatggggatgtgtgagtgtatgggaggagtgagtataccaagtgaccagttttggacaggcaaaccatgaagagcccttgagacttccaagtggagatgccacgtaggtgggtgaatgtatgtacttggacctcaaaagtgaagttcagactggggttgtagattttttggagtgattagcacgtagcactttctgaaggctttcgtttgtagggtgtgttcctctcccgcagaggatatgttacaggggaagggctaaagaggcacaagcagctgacaggagagattgatatataacagctggagaaaaccacagagccaggcagaatggatactggtcagcggagagtaaaagctgctgtcctagcaataccttccattcatacacaggggtcctggtgaggctgacataaaaacaaatataaaaatctactacgaattttacaaacagtccaggttcgactgcagatgagaccacagcattttctgcctcaaaagacatccaagtggagatgtcacgtaggcaggtgaatgtactatgcacttggacctcaaaagtgaagtttgaactgggcttgtagattgtggagtaattagctcagacacacaggtgtctaattgtcctggcggacaccaggagggtctcagcggcagcgtgattgtatcgctgataaggaagaggcctgacaatctgagtagagagtggacccggtggagcaattctcatacctggatggacccacatagagccgcagaggctgggggcgaggcggggggaggctctgtctccctgtgtcctgaatgcggagcatgaacttaggccttctacagcacaaaccttgcttctttgggacagatgttggggtgggggaggcctgtcactcagacggaggaggcggtgcctctgtccccaggccagcaggagcaggaggtggactttggagtccggaagacccaggttcaaattttgcattttctgtttcctggctctgtggtctagttcatgcaatgtgtctgtgcctcagcttcctgacacgccaaatggggatgctgacatccacttcccagcgctgctgtgagaggaagaaaagccccagcacagatccctctgtgacatacaagctgcataaagggtagctgaggaagcagatgttcccagtatgtctgggggccagagagttggctagtggagaagcacacaaagcgaagtgccatcctctggccatgtccatttcgtagccccgcaggttgaggatttccacttgttgcagttagagacccagcttattaattgtgagacctcactaattgtgacctaaggggtcttgccggggaaacggggcatagtgtatcccagaccaggctggaggagtttgggtgaaagggcagggcaggacagagaagcattgtgcaaaagtggggggactgagaagagatgattgggtgggtcgagctgcactgcagggtatgagtgtgcgcgcccgcggtaggaggaggaggaggaggagaggtgaagtggatctggcgggaagagccccccgcaccctaccttcgaccccaccgcccacccacccgcggaatcgcatgcgcactggagacctggaggaaagggcttttgttgggaaagcgggcgggctggaggggtccgcgcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaatttggatgtttcttcctttacctgcacacccattgctatacctggccacgcttgggcttgtagcaaggaaacttcttcaggctctctggggtaggtgggccccacctctgccaaaaaggcccacagggacaggtgggatgctgggaggtgcggaggttggttacgcctgagtgcgtgagcaggagtttggagaggccccagtgctcatcgttatgtgattttctacaaaccttgctcagcagccccagggacatggcaagagtcggggccacagcaggggcggggtggaaaattgcagcttggtgccactgcccctcccgccgagggacagggtccaaggctctcaccaggacccacctcccacaccccctccttggagatgatgttccggaacccttggctcatcatccacacagttcaggaccccgtcctcggtacagagtctgacggacaatgaggtgggccccgcagtgatgttcgcagccctccagtgggtagaaggaggggccgtgattgctgagggagcaggatgtaataaaaacaacgcacggtgcacgcgtacacagccccttgcctgtgacggaacggcggcctgtttggagcttcgcagcccttctcccccagcagcagggctctcccagtgaggacaacaccaggcctacctaggtcctggtgtgttcaagggctgggtgatgtctggaggggtctgaggtagggctgcacatgcttcaggtacaagacagtgagggcagagacagtttggtctcctgggaagggctcagtggcaggcagggacagtgtccagggcttctggagttccccggtaatgtccagggcttgggaggacagagccctagataaggagggaaaacatagcagtggaaggctccctgcttcccaccccctcacccagccccagcctctgtttccccaggaggggctgccatctccgccacggccagatcctgacccagaccgggctacctaatttgggaggcccagtggaaaatgaaaacacgagtctccttgtcaaaaactatgaaggatttcaaaacaacaacagcagagcatggagccacatggggagccctggtgagcatcagactgcattggttgcacaccccagaagctgtccgtcagaaaggctttgggtgggtctccgtgttggctgccgctgtgatttctgcttctctggtgcttgggtccatgcttggccacactgacattctgggactctgacagaaatccagttccaaagttttactggaacacacacacacacacacacacacacacacacacacacacacacacacaatggagtccccttccctttatgtctcctggtttgtggtctgggctgtggaagagatgagggatgcctgggactccaccacccctggcgtcataaatttaatgctatttggctggaacctccccggacacccttgtgcacatagcgggcacatgcctgtccttggatcagggtgggggtagtcaccataagccacaggagtgagtttgaacactgtgtgcagagggcacttgagatacggaagttccaccggaaaggaacaggaagcagccctcagaggtggggtgctggccaggtcacggcctcctcaggcctccaggcttgctggacactctccctttcacatcaccttgctgcggtggggcctcaccagggacccactccccctaccctgtaggggcagcgctgagagcacctgggaagagaggaggagagcagggaggtgagagcaccctggtgggaaatgggggcggactggactgcgcgtcctgcagaagggtcagaccggccaccctggagacggccaccacctcactcacatggcaaacaggagacctaggcaggtttcccccctgcccccggcctggggccttctgcagaccccgcactgcaaaggcccacagtccatgtcagcaagtgttttctgaggccctgctgtgtcagtggacagcactcacagccttctcccagcttggcctgctccctctgatcacccctgccccaggcctggcgatggacgagcattcgtgcattcacttgtttccagttattgacattatgcataaagttgttctgaatattcatgtacaatttctcatctgggcctatgtttctgtttctcggccaagcccgagaggtgggggcagtaaggccatttcatggtctcagccaactgaggctccgagagggaagacgctctccccaagtcacacagccaggaagtggcagagcacagacttgaacctgggaccctctgaggccagggtgcgtgcactgggccctgctgtcggcctcccctgccatccagggtcttgcagtgtcctgggggtgatacacccacctgctgggcactctctcctgacacccaccctcgcacccacgtgcacataccgctccccatctcccttcatcgtgcatgattcgctacccctcacggcttccctgaacgacaggttccaccctaggtttctgaggcctgccaccgccctcccagcctcctgagacatcaggttgggtgctttccttcctgggcatccatcctgctgctcctccttgtttttgtcgtcatcaggccctgggccaagggcgttttgcccactacctcgtgacaccctcaaagatcgtctgagctactactgtgcacttgaggaaacagactcagagaagggaggtgacttgcctgagatctctgacccagctttgccgctgcctccactagtgaccttggcccagcctcttctcttgaccagttgcatatcgttccgtgttgcatgtgaagaaccattcacatggtttgcacattgattatcatttgtcgtcttaatactgaattataagagtgcttttttgcgtgcaaacttttccattgtcgggtagtatatattgcaaacattgccgcaatgaatggtttgctttttcatttcgctaatgatgaaaagccagatttctaaatttgatgaaattcacttaaggtgtttttgcatggctattgctttctgtgtcatagctataagagtccttcgcctacagcaagtttttcaaggctttatcctgaattctcttccagaggtcttatgctttagcttttttgttgacatttaggatcttcacaaacttcagaagtttgaaatcataccaattatcttttctgaccacaatggaatgaaactagaaagcaataccggaaggagaattgaaaaagtcacaaacaggtggaaattacaacactctcttcaacaaccagtgggtcaaagaacagaccacaaggaaattagaaagtatcttgagacacatgacaatgaaaacaccacataccacaactaaggagatgcagggaaagcagtgttaagagggaagtttattgtggtaaatccttacagtgaaaaagaagaaagatctcaaatcaacagcctatctttgtgtttcgagaactagcaaaggaagaacaacgtaaacccgaagttagcagaaggaaggaagtaataaagattagagcacaaataaaggaaatggagaatagacaaataataggaaaaaaaaaaacaatgaaactaagagctggtgtctctgaaaaggtcaacataggttaagcagattaagaaaaaaacagagaagggtcaaataactaaaatcagaatgacagaggggcattacaattgttactacagaaataaaaaagattataaggagaagaccaggaacaactataccccaacaaatttgatactttagaagaaatggataaattctgagaaacgtacacgctgccaagactgactcctgaagaaataaaaaatctcagcagatctcgacaactcataaggagacttaaccagtattcatcaacctcccaacagagaaaaccgcaggactagatggcttcagtggagaattctactaaacagttagagaagaactaggaccagaaacgcgcgcgcgcacacacacacacacacacacacacttcccaaaagaatgtttgtgcatacatattcaacaaaagtctagcacaccgagttcaacaacacatgaaaggcccatgaccacgtgggatttattcgtggaatgcaaggaagtttcgatcaatgaaaatcaactaatttagtgtacggcatcaacaaaatgaaggacaaaaccacatgatcggctcaattgatgcactaaaagcatctgacaaaagtcaacccccttcgtgataaaaacactcaaactccttgaaacagaaggaaacaacctcaacgtcacaaaagtcctatataaaatactcattgtgaacactgtacacgatggcgaaagagtgaaagcttttcctctaagatcaggagcaagacagagatgcccgcttttgctacttcttctcaacatagtcccggaagttcagagggcaattaagcaagaaaatgaaataaaagggcatcctttttatttcacttcattttatttttagaaaaggcatcctttttatttcctattttctaaataacccatagctcaaggaaaacatcaccaatgaaatcgcaaagtattttgaacctgatgaaatcttatgggatatattttaattgtctagattgcatgaaaaagaaaggcacaacatttgcatctttcttaaccatgttgaacaacagattaaacctgaagaaagcagaagaaatgaaataacgataaaagtacaaatcagttaaagataaaacaacacagccagaggtggttttttgaaaagatgatgtgattaagacatgccttgtgtaggcctgaacaaaaaggagagaaatcatgaagcaacccgtgtctggagtggctaaggagacatcactatgggcaatgaaggcattaaagagatcattattcaaaaccatgagcaactttatgcccacaaacgtgaaactttggatataatttacacatttcaagaaaatacaacaaaatgacagaaaacagactaaacatctgaattgtcctacaaattctaaacgggcggaatctgaaggaaacaacagcaacagccacaagaacctacggactctgatgctgccaccgattaattctacaaaacgtttgtgaaggaaggaatatcaatcttaccttcttgccaagtaacataaaaaacgggaaatgcttcccatcccgttttatgagggaaaaaccttaaagggcatggtaagaaatgaaatgcacaggcctatcttttacataagcacagaagaagaaatcttgaataaagcattagcaaaacaaatcagttaaatctccaaaaaggaaaacgtatcacaaacaagtcaagagtattctagaaatgaagcggttcagcgcttgaaaaatctatctctcagaagtaatgtatgaaggagaaaaaatatgatattccctacagacgcaggaagggtatttcatgggtttgattttttttaaatgaccatgcacttatgataaaacctcttagccaactacgaacaaaagggaagtctcttgattccgttggaatatattttaaaagcctacaaaaacaacgatacttacgggtgacatgttgacagctttccctctgagatcagggggaaaaaaaaaccagatacatccactgtcaccacttacagtgccatgaaggaagaaaaagtaatcaaagcagtcctgcaagcacagccttaaatgcatacgcatgttaaccaaaggacatccttgtgaacgtgcaccacaataataacactaacactccagcgctggaaactactgaagagcccattagaaataaaaggcatgaataaattgtggcatcgtcatacaattcaaaacactgcgcaggaatgcaaagaaacgaaattcagctacacagcacgacaaaagtgaatagcaaggagaaaaacctaatgttgccaagagaaacccggattataaaatacgtactgtactgagtctactcatgtgtaatgcgttcacaaacaggcaggattatcgtcaagtgttaaaagtcacaagagtggttagatttgctgaggtggaagacaagagtgactggcatgagagtgcttttgagctgccggcaatacactacaccatttcttaacccagatcgtaggggatcagacgtccctgtggaaccatttactgagtggtaccctcattttgcgtgcaactccatttttgtattatattccattacagtgtacatagagatatttaaatgaatactatcccaggaatgtccataaacaatggattcttcagcgatttgtatattctctgaccacaatgccacaatgggatctagaaattaataacaaaagatcattacaaacccccgtatatgttggtaaattaagaaacatcctcctaagtaacccatggctctaagaaaaactaacgttgaaataagaaaatattttgagcttactaatgaagcaaactccagaggtctttgcctgccaatattactaagtctcctctctggggaagtttagattacacaggaagactctcctgcatctctgagaaggggcaagatgccagcaatctggacgccaaactccagcggaggtgagggactgaagattgctgtagacagcaactgaaatccctacgccgggttgggatgtatgccttgaagtgagcctgaagttccaaagcccataaatctgctggttcatgctctgcagagagtacatttgtccgccatctcccagagtggggggagagcgatttgtcatgctacgaggagctgagaggggatctgggcgtctaagtgatttgtaaatacactttctagagcaatcgtgcaatttacagcccccaccattaccaacaacgtgccgggatacgtggcaatgccagtgttgcagacagttggaaggtctggtgagaggggataagtcagttgctttcctgccatcctcactgccagttgatgctcaagctctcttggcaacacaagtgagactccgtctgtaaaaaaacaaaacataaaaaaaaaattaacatgtactcccagctactctggaggctgtggctggaggatcccttgagctcagcagttcgaggctacagggagctatgatcataccactgaactccagcctgggcgacagagcgagaaccccccacaccctcaaaaaagatcaagctctcttaatcagctaagtcagtgtcactcacctgtttccttcccatcttctgctactttctttctcttgtctcctcagccagtttctttgtctttatggggtaaagccttaggagaaaaggatgcagccaggaaagagggagggggaagagaggtgagaagtgaacgtgagaaagagaaggggtgagtgaagtacatgaccaaaggtgccctggggaagctgggagcaggaacaagggtccccgggcgagttgaaactacccctcatgctctttggtctgttgggtgctcaggttgcaggaaatgggcatccggttggacttcatgagaactcacaccttggggtgtggagggcaggacaccatgagaggagtcccaccctgctgcaaaagatagaagaggagagttgcccccaacataaaagggaaggcagtgacagaaagaggcaagcagaggatggtggatggcagaacaaggactatcatcaatgacattttcttcactgagcccaccccagaaatgagctcccttcctgtgcgctctcacagctccttgtcgttgaatctcgtatcactgatggtaatttgcagaggaataattaagttggtgattcactttaggatgtactgccctccgaggctgaaagctaaacacatagagcccacgttacgcccagtaccacttaaggaactgcggattagtcactgggtgagtatcaggggaggggagggcggggagggtgaggggagggaacggcatagagagaaggaaaaagcaaaatgaggggaaaaccaggggaggacaacatgagaaaggaaagagggagagaaagggcagtgagggatatgggaactcggagggaggacaaagggaaagacaaggcatggaggagagagagcagagaggggagatgagaggtgatgacagaggctgaagtgaggtaggaagagagaggaaagaggaaaggagtgtagaggaaatggatgagggagtaaagagaaaggaacaaggggagaggtcctttaccaaagggtgattgatgagcagggggcaagaagaaggggcagcgagggagaaagggaaaggaggagaaaactgccagctttgagaactctaccctgcccctggaaagaggggatccccatcccaggtcaacctggggctccccatgggactatctcagagggaggagctggataagccaagaaagagcaaagggtgcacgggaccactcttgccttgctgcatgtgtcattcagggccttcccacccaaacagggggactggtcacatcaacagccacctctgctgaatccaagctctgcaccggatcctcctttcccctgccagatacgggtttcaacaagcaaatttaagggaatcactccccttcctgggatccctccctgactgtatcagttgcaacccctttcatggtcacagaggcctggcctctcccacaagaaccctatgggccagccagtgcgatgctctgtacatcgtatctgttcaggatgaagcctgtgtgtgtgtgtgtgtgtgtgtgtgtgtgtgtgtgtatggggtgggggtgtgtgggatgtgtgcgtgtgtgtgtgtgtgtgtgtgtgtactaataatcacaaggatcaatatatctgtgggaattgtgaattctttcaatgtgactgccttgctagaatcccctctcccaggggcctttatttcaaggaccaactctgcttttctcccacagcccaatgaatgcatcagacactcagcttcagttcccatggcaacaggggctaatggcctagagactaaagatgagacaaagagaaacgcagagaaatgtgcgtgttctgtcttcctctgaggtacgcaagcccctattcagggattgaaaagaacattcgctttagttctaccctgccctcccctcaatgctgggtggaggagggcagaaacgcagacgggcctgacatgaatccagaatttctacatcctctcaatgcacctgcacggtttggagacaggcttctttgtccccgagccatcatgttaccaacaatgtattgtacctgcaaaccatgcctgtggaacctaggattcctgctaccccaactcaccttcctctttaccaccctctagcctctatcacagtaggggagttttttcagtcattcctattttctgacagaaagttccagccagcccaatttcagaagcgctgtctcaggagggctccctgatccttcctgccagagtcacacaggacacacctcctccctcttctcctctgtggcctgggagacctctgcccagaccatgggacaagttcctagggctcccccttcctgccacactcctgttccgccagggccttggggagactcagacgagggaggtttctgatagtctcccacttctggaagcagccaaactaatgagaggcctcttgcctgcccctcttcctgagaagcccaccacctcctgtgtattgactccccttaccagaggctggacaaacagcgtgccaggcccgacatgagacgtcccacactataaatttgtgataaacaacaactcaaaagctgggcatatgcccccaactttccctcccttctttccatttattccagtgagtctcagaagtccctttgtccagctgcactctcctctcctgggacccagctgccctccatttcccatgtcctggaacccctcagtccaaaatacctaagtaaactcgtcttcactgcaatgtgcaacccacacccacagccatgccctacgccagaaggaaccacatgaagttctgcccatcttcctgacctccacggatgttgcgcgacatccagtctcctctgggtcagggggtttgtctcatatgcactcctgagtgcccacctgccagtgactcccctgtgtttcacacccctctcgggggatctcagatccactcggctcctggtctctgtctggatgaccacgaccagtttcccttggagaaggaccaatggggaatggcaatgccaggaaggcaacgcttcgcttgactgctctgctccttaaatccccaaaagcaccactcacaggactgtagacgctatgccagttacagacttcagcgaagggtcaatagtgactacatgaaattatagtggaacaaactactagtgagcgatggctaagcatccatgctgctagaatccaaaaagaatcacccatcccctgcctcccacggaaaagataaggtcttctgaggacattccatttccggtgaattcccgttcatggcttttcttcctgttttgagcactgcccttttctctccctggaaagaaggaagtccctccattaatctgcttcattgtagggatttctttatctctcagtaatgggatctgtctatgtctccacctccctgtgaacatgtgaacacccagagacaatcaccaaacactaaggagctatgagtgtcacatcataatccctcacctagctctgcgcagtggctcacacctataaccccagctatgcaagacaccgaggcaggaggattggttgaggccaggagttggacacgagcctggtcaatgtagcgagacctcatctctaaaattataaaaatagaaaaaattagccttatatggtggcacgcatctgtggtcccagctactcgggagactcatgcaggaggatcacttgagcccaggagtttgaggctgcagtgagttatgacagcaccactgcacagagctttgggaggctgcactttgaaggcaggagttcaagaccagcttgggcatcacagcgagaccccaactgcagaaaaaaaataaaattaaatttaaaaaaattaaaaatatctctgaccgatacatttctcaaaatttgaatttgtcagtttacattaaccttcgttactcagcctggatcctatggacttcaaacttcatttcctcatcctctggacatctctgccctgccaatccctcattctcaatttggccatccccggggatggaggttatcagcatggctttaactgagagcatgaagcatggggctggtggctcatatttttaacaaagccagcctctctggttgaccccatctttacccctcactgtttctcacagtttgaattcctgcagatgtccactgtttctctgcatcttcaaattcttctgctccagtggctattcccctcagcatacaattacgctccactgtcctccattttaaacaaataccttcccttggcgacacttccctaccagctgttctcccacatacctgctgcctttcacagcaaaacttttctggtaagttgtctgaacaggttgtcaccacttcctcatctccacctccgatgtcttgcatggccttctgtcctccaatatgctttttttctttttcatgctctttagtaacttacatgatgtcaaatccaattatcatccctctgacctggcttgccctcttagtagcattgaacgtgctggccactatcggtctcttgagatcttgtggattccatgaaaccatcttcttctggtgatcttccttccaggatagatcctattctttgagttgtttcctggctcctcttcttgtaaactcctctactttttgatatgctccagattgtggccttgtttcctccttttctacatttttttctcgaagaaatttcctttcactttacagatgtaaataacacctacatctgccacctcctgtgtccatcagaatgtttggttagcaacaacagaaaaacactcacgattgctcaaccaaaaaaaaaaaaaaaaacaaacaaacaaacctgatgcaagaatatcaggttgcacacgaagtcaataagagggctgcataaccagaattggaaagcaggtaggatccacgggagtctgagacatagaaacaatcacaaaggtcatgcctgagaaatagctttgttttgacattgttcttgcaaccttgctactctgccagagaggccgctttggaagcctcctaccacatttaatttttcagccttatggaagtcttcgtataggtttcgttttgtaataattcaaaaatatccctccaacttgtatcctaatatactagcatgtatgttaacttaggaataagttatgaacattttgaattccttcagagattctttcctccttcattaaaagaaacagctttattgagatataattcagataccacaaagctcacccttttaaagtgtaccgtgcagtggttgttagtatattccaaaagttgagcaactcccattccgtaggtggccttttcaccgtgttgattgtttcatttggttcaccataggtttttgttttcgtttttggtttttgctttcattttattttattttttatatatatatatatatatatatatttattatactttaagttctaacgtacatgtgcaaaacgtgcaggtttgttacctgttggtgtgctgcacccattaactcgtcttttgcattaggtatatctcctaatgctatccctcccccctcccccctccccctacccacaacaggccccggtgggttcaccataggtttttggttcgacttagtctcaccagtctaacgtggctttttgttgcttgtgctttttgtcatattcaagagataatttccaagtcaaatgccatggaacttttcacctatgttctcttctaggagatttacaggaaaagatatttgaaaaggatatatatgataagggattaatatccaagctatacaaggaactcctacaactcaataccaaaaaagaagacaacaaactgactaaagaatgggcaaaagacttgaatagacatttcttcaaagaggacatgcacatgcccaacagtatatgaaaaagtgctcaacgtcactactcagcagagaaatgcaaatccaaaccacaatgagctatcacctcacactttgaatgatagctattatcaaaacaaaaaagaaagaaagaagaaagaaagagaaagaaaaaagaaagagaaagaaagaagaaagaaaaagaaagaaagaaagaaagaaagaaagaaagaaagaaagaaagaaagaaagaaagaaggaaagaaaagaaagaaagaaagaaagaaagaaaagataacaagtgttgttttggagaagatgtgtaaaaattccaacacgggcacactggagtaggcacataaagcggtgcagccactatggaatacaccgtagtggttcctcaaaaaattgaaaatagaacgaccatgtgatctggcaatcccacttttgggtatatatccaaaagaattgaaatctggacctcgaagggatatatgcactcccacctctattgaagcattacatctaacagtcaaaatttaaaaacaatgtggaaacaacctaaatgttcatcgacagatgaatggatattaaaaatgtggtatacacataaaatgggacattattccacttccatgaagaaggaattcctgccatcacacccaaataatgtgggttctaaatatttcagctatctaaaatagtcaaatttaaaaaccagagtgcagtgtcggctgcttgaacctggagggagggggaaacagggagttgctattctatgggtataaagtttccgttgtgccaggtgaatacattcttgagatctcctgtacaaccctgtgcctatggttaagaatatggtattttgcacttaaaattttagtgagggcggatctcatgttacgtgttcttagcacaataaaataaaatttaaaaaacggaaaagttgtgcaactatcacaaccatgtaatttaagaacttttttattcaaaaaacacgctgtatgtatttaagtgacctaatctcccctcttcttcaaaccactggtaccctctgatctatcttctggctctctgattttgcatgtagtgaatgtttcctataaatcagatcatacaatgcgtgaccttttggaccggcttctttcagtaagcactatgttttccagattaatcaatgttgtggctcgtacattccattaactaccatataatgatactacatattggttactcattcaactgtggatggacttttagattctttcactttttggctactatggaggaggctgttatggacactcttgtacaggattttacctgagttattttttgaaatctcttgggtgaacacctggagtggacttgctgggtcataaaggaactcttacttttggaggaactgctgcaccctctcccaaagtgattgggccatcttacaatcccatgagaaatgtcttaagattccagttcctccacaaccttgccaacatttgttattgtctatctgtttgatttcagccatcttagtgagtgggaagtggtatcacaacgtggatttgacttgcacttccctaatgactaatgacactgagcatcttttcttgagcttattagccatttgtacatgttctttagagaaatgtctattgcaatgctttgcccacttttatttgggctgtgtgtcttttttattaggcagtcgtaagtgtttagtagatattgcaaatagagtcaaatatgagatatatgattttccaatcttttcaatcatctcataagttgtcttccctgtccttgatggtgggctttgaagcacaaaagtatttaattttaatgaagtacaattcctctgtgtttcatgtttttcacccgtgatatgggtaccatatctacaaagccaattccaatttcaaggtcatgaaggttatccccaaagtttttttccaaaagttacatagtttttttccccttaggtttatgtctatcattcattttgaattaattttcaggcatggcatgagatggtgggtccacttcattcttctccatgggcataaccatttgtcccagcaccgtttgtggaaaatgctattctttctcactttgagttgccttgatacacttgtggaaaatcaactgaacttaaaagaagaggtttatttctaaaatttgcatttttatgacactgatatatatatgcctaaatttatgccagtaccacaacacattgattactgtagctttgcagtaagttttgaaatagagacgtgtgagtcctccatcattgctctttttcaagattgttttggcttttctgggtcccttgcgttgccaagggaatgtcagaatcagattgtcaattatggcaagaagatcctggtgggatttgaaacggtgagtatgttgtatctatagatccacttgtggactgttactattttaatgatacacagtcttccccgtccatgtgtaagggacaccttcacatttctttaggtcttctttaatttctttcaataaggttttgtagtgttctgcgtacaagtcttacacttcttttgtggaatttatttctaactattgtgtttctttggatgctatgataagtggaattgtttttaaagtgtcctttattggattattcattggtagtacaaagacataaaattgtatgttttacattgatgtagatattatatggaataaattcaatgactcgtcctgatagtattttcttttccggcttctttagtgttttctatgtacaagataatgtcatctgtgagcagagagagttttacttattcctttcaagtctggaggtcttctatctctttttcttgcctaaatgcattagctagaagctcctgtacaatgttaaatagaaatggtgagagcacacattgttgcttgttgagggtgaaagttttcagcctttcaccattaatcatgatggcagttgtgagtttttggtagagtctactgagttgcagaagcaccttttttctccagtttcttcatatttttttaattgtgaaacggttttggatctgtcacaagttttttctgtgtctacggaaacgataatatggggtttttatttggttagtgtggtatattatattgattgatttttgtacgttgaaccaactttacattcctggagcaagttccacttggtctttgtgtaaaatctgtgtgtgtgtgtgtgtgtgtgtgtgtgcacgtgtgtgtgttgctggattaggtatgtgtgtaatttgtggaggagatttgtgtatacataacagatatgcatctgtaattaggttagttatttccttctgatgccttgtctaattttggagtttggttaaagttgggctcgaaaaactagctgggaagggcgcccttctgttcttgagcaatcttgtgaagctttggtgttaagtgtcctttaaatatttggtagaattccaccagttaaccctggacttttctttgggggaatatatttgttagtaattcaatccctttacttgttgtaaatcaattcaaatcttctacttctcctttaggcagtttcagtaatttgtgtgtttctggacatttgtccttgtcacaagattatctaatttgttgccatgctgttgttcacagtatttcccataacctttttatttctgtaagattgtattaatatcctatattctagttttgatttttgtaatatgcatcttttctattctttcttagtctagcaaaagcatgtcaatttcgttgatctttgttaatgaaccaacttttggtttggttaattttctctattatttcctatattctttttatttatatcactctaacagtccttatttccttccttctgcctgtttggggttagtttaattttcttgctcctgtgtcttaacataaaaatttagaagaattttttgagagcactactcttttttcaatataggtgtttatagctatacatttgcatctaagagctaatttagccacatcctacaaggctgggatcttgtgtgcatctttctcccttcagttgtgtccatttttgcttcgtgtattgtggggcactattgctatgtgtctatatatttttataaaaatctttatatcttcttgatggattgagcactctaccgtgataaaacgtccttctctgtatctaaatcgaattgttgtcttaaagtatatttttgtctcagagaatattagtagagccactccaactctcttttcatgattgtttccacactatacttttccacgcttttattttaagcaatttatgtctttgaaagtaaagcacacctcttcaagatagcatgtaactggagcatttaaacaaatctgttctgccaatctctccttttggttttgttgagggcattttcttctacatttataaaagatattgttctgtagtatgctcttcttgggatgtcctcttctgcctttggtttctgggtaatattggtctcatagaatgacttcagtgaatttgagcaagttacctaactttcatgaacctcaaagactaagaggaatgtgaatgggctgagtctggaaggtcttcttttctctaagcagtcttctccaggtggtggtggggcggaggcacctgctaggagtagaatgaggagtggatggatagtggggtcagatatcatcctgtgcaccccttatctcccaggtcctcccttcaccttcctgcccatcctctctccctccccatttacatctaccacaaggaattcgaaggagtttgcagaactttagatgaaatttctctttctccaacagtggattggataagaggcgcacaaaatatttccgaacccaaatatttttcagagaacataggatgatgaagaaacaatgtgccgttgaacttctatactttcttccacacagtgaaaagcatatttagtctttacagtgggtaataaaatccctgagtccagaaaatgaaacctgggggaacgaagaggcttcactgaggcttcagtattttggcaatcttcatagccaaggaaaggcttgctggggcactaggagcaggactgatggctgtagaatcacacagcatacagaatggaagatcaggcttcctcttaccacgggaactcccaatctggtttgaaaaatgggacccatacatgacattattcaatacaacgaaaggtgctatataagctgaagagccttcgaaaagatggacgagaattagtcactgccattgagaagttcagagtccggtgggagagataaggctcatagacaatgatacttatcatagtgaatattacctttcttacaggaacaaagaggagggaagaaacaacttcctgagggagtcaggagcacttgctccaagtttaagcgatgaattgcaggttatcaaccatcaaagctgtggcaatgacattctgggaagaaggaacagaatttgcaaagaaggaagcttatttgacacacattttttgagagctctgtcttccccaaatagtgtgcaagttttgagagctacagaggaaatgaacaatgcctctgtccagatcactaatgaatccatgtaccctgaactggcaagggaaacattcacaagccggttctcatcattttaaaaggtataatgactccaaggatgcctggggaaggccatctcgtcatccggtcaggtcccccacaggggaagtcagtaccatgctatgatcaccgttattcccagttttgtaggtgcagcaattaaacgttgtccacacatccagagggaattgggctacagaagactgcctcacattgataaaatttaccaaaattatacccatatggtacacaaaatgaggtcaggtgcatcatttgaatgaaacattgacaattttaaaacacattaaataatttttcctaaatggtacattttgcctcacgtttgttttttacagtaactttctatttatgacaagtcatgttggatttccacttatggtagtgatattaagtttcctttgaaaatatacttattgatgaaaaactattttgttcaaaggaaaacactatgccttctaaacacgacaatgaagatagcgtgtgatattaatgaattaaaattctaaacaaactataagaaatgcaagtgaaatattaacgtagatcggaagcatttggtattataatagttttaccacaattaaatatcgcaaaaagagtgaaggtggtaaacggatgattactgaaatcagggaccaactcgaattttctcccagagtccagtgaatgcgtcagacactcagctttggttcccatggtaactaggactaatggtctcaggactaagaatgagacaaagagaaacacagagaaatgtgcacattctgtcttcctgtgaggtacacaagcccctattcagcaaatgaaaagaacattcactttagttctgccctgacctcccctcactgctgggtggaggagaacggaaaggcagagggatccaataccaatcttaagcgtttacatccaggcttccttgtcccttagccaccatcttaccaacaatgtgttgtacctccaaatcatgcccgtggaatctaggattcttgctatcccaatccacttgccctgttccccacccactagccgctatcataatatgggaggttttcagtcatccccattttatgtcagatagttccagcccgatttcagaaatgctgccccagaaaagttccctgacccttcctgccagatcgcacagaacagaactgactccctcccttttctcctctgtggcctgggagacctcggcccagatcatgggctcccacttcctgccacactcccattccaccagggcctggggggagacccaaaggagggaagtttctgacagtctcctgtttggggaagcagccaaactaatgaggggcctcttccctgtccctttttcctgagtagctatctcctttgtattggctccctgtatcagaggctggacaaatagggttccaggcaggacatgacacattccacaccataaatttgtgaagaaaaaacacacaaaagctgggcataggcccccaacttcaactcccttccttccatttattccagcgagtctctgaagtccctttgtccagctgcactctcctttcctgggacccagctgccatttcccatgtcctggaaactctcggcccaaaatacccaagtaacttcattgtactattcctttcttgcattgctgtaaagaaatacctgagactgggtaatttataaagaaaaaaggtttaattggctcacagttctgcaagctgtacaggaagcctgattttggcatctgctcggcttctggcaaggcctcaggaaacttgcaatcctagcggaaggcaaaggaagaaggagcacttcacagggggagggagaacttcacatgggtggggcagaaagaagagagtcaggaggagatgctacacactgttaaacaaccagctctcatgagagctctatcctgataacagcactagggaaatgatgctaaaccattagaaaccacccccatcatccaatcacctcctatcaggcccaacctccaacattggggattacaactggacatgagattttggcagagacacaggtccaaaccatatccctcatcttcactgcagtggagcaacccacacccatagccatgccctccaccagaaggaaccacatgaaggtctgcccatcttcctgacctccatggacagtaggcgatgcccagtctccttttggtctgggggtttgtctcatatgctctccttggtacccacctgccagtgactcctctgtgtttcacacccctctcaggggatcccagatccacttgggtgctggtctctgtctggatgactagtaccagtttcccttagagaagggccaatgggaaatgcttatgtgaggaaggtaatgcttcgcttgactgctttgctcttaagtcctcaaaaaacaccacttacaagactgtagactctatgccgcttacagacttcaatgaaaagtcaatagtttctatatgaaatgatagtggaacaaaccactagtgagcaatggctaaatatcattgccccgggagtccaaaaagaaccacccatctcctgcctcccacagaaaaggtaagtttctctagggacacttcattttgggtgaatccctgttcatggcttttcttcctgttttgagcactgcccttttctcaccctgtaaaggggaaagtccccttcattaatctgcttcactgtagggatttctttatgtctcatcagtggaatctgtccacatctccacctctctatgaacatatgtacacatagggatactcacacaaaagctaaggaacgatgactgtcacacaataatccctaaccaattcactttgcaaaatctgaatttgtcagcgtaggttaacctccattactcagtctgagtctcagagtcttcaaagttcaattcctcatcctctggacatctctgtcctgccaatccatcattctcaatttggccatccctggggatacagattatcagcatgtctttaaccaatagcatgaagtgtggggctggcggggtgacttttttttttaattaaacaaagctagcctttctggttgatctcatctttacctctcactgtttgaaatgttttatttctaaagatgaccattgtttctctgcatcttcaatttcttctgctccactgatacttaacatcagcatactccaccatcctctatcttaaataccttcccttgttcacacttccctactacttattgttccatatatttgctgcccttcacagcaaaacttttctgatatcttgtctaaactggttgtcaccacttcctcatctccactgtcaatgtcttttatccccttcagacctttaaacctgcctttcttcatggtctttaacaaataaatgcaatagcaatccttagaggaaagtttatagtaataaatgcctacattaaaaagtagaaaaatgacaaataaacaacttaactttacacgtgaaggaactagaataaaaagtaaaaacgaagtccaaagttagcaaaaggaaataataaaatataatatagactagagcagaaatatgccaaataaataacaagtcaaatagagaaatggtaaacaaaatcaccaaaattaggagtttccttcttgaaaagattaacaaaattgataagcctacagctagacctactaagaaaaaagagagaagccactaataaataaaatcaggtttgaaagagaagatatttcaatggatgcctcagaaacaaagaatatcctaagggaagattatcaatgtatatacaccaacaaatcagataacctacaatggatacattcttagaaacataaaacctaccaaaactgaataaagcgaagtagaaatcctgaacagaccaaaactataagggtattgcattattaattaaaaatagcccagcaaataaaaccccagaagcagatggattcatgggtgacttctaacaaacattcaaagaaaaagtgctaacaatccttctcaaactcttccaaaaaatagaagatggaatactggcaaactcatcttataaagttagcatcaccctgatcactaaagataccaaaagaaaatacgactgctgacctatatccctgacaaacatagatgcagaaatcctcaatgaaatattagcaaattgaattcaacagcacgttaaatgtatcatacgtcataaccaagtgggatttatctctgggatacaagaatgattcttcgtgctcaaatcaatcagtgtgatacatcacattaacaaaatgaacataaatataccccacatgattaccttgatagatgcacaaaaagcatttggcaaatttcaacatcgattgattaatctgtccatgattaaaactctcaacaagatagatgtagaaggaacttacctcaacacaataaaggccatgtatgaaaatcccacagcaaactttataatcaatagggaaaacctaaaatctgtccctccaagttcaggtactaggcaaatatgcccactctcaccaattctattcaatagagtactggaagtcttggagttttagccagaacaacgagatacaaaaaagaaataaaatgcttccaaattggaaaggaaaaagtaaaattatctctgttttcagtatcatcataaaaacgttttgtttaaacaatgtttgtaaaacgatgatgttttgacatcatcataaacaaagaaaaccataaagactcaaccaaaagtaacgttagaattcataaaccaattcggtgtaattgcaggatataaaatcaacatacaaaaattagtcacatttccacacgcaaacagtgaactatccaaaaatgaagttaagaaaacaacccattcacaacagtaacaaaaataattaaataataaaatacttaggaataaagccaactgaagaagtttaagacctgtacactgaaaattacagaacattgatgaaataaattaaagaagacacagatgaatggaaagacatcttgtgttctatacatttccaatatgtatagaaactcctaaaagtcaatagcaaaacatgtattaaaaatttaaaaatggcaaaagacttgaatggacatttctctaaagaatacaaacaaatggccaacatgtatatgaaaagatgctcaatatcactaagcataaggaaaatgcaaatcaaaactagaaggagatatcacctcgtgcctgttagaatagttgtaacaacagaaaacactaagggcaatatgtattgacaatattgccgagaaattgaaacccttttaaaatatggtaggtatacaacgtgatgcagtcattatcaaaaacattacagggttccacgaaaaaattgccatatgatccagcaatcccacttctagatatattaaaaagacgaatacaggatctcaaagggatatctgcactctatgtttgcttcagcattatttacaataatcaagtgatggaaaaaacccaaatgtcaattgacagatgaatggatcaagaaaatatggtgacacacaatgggatattattcagactttaagaaggaagacttcctgtggaggaggtagagcaagatggcagaatagaaggctcctccgatcgaccccccatccctactccgcaaggacatcaatttatctacacacaaaaatatgttcatgagaaccaaaaatcacagtacctggttttcactttgtatcactgaaagatgcacttaagatgtaaaagggactgtcttgaattgctgacatgacccatcccacacctcccaacagcagtggtgtggtgtggagagcacttttgcacgctggtggaaggagagcacagcaactgcaaggcattgaactgaatgctgtcctgttagagcagaaaggaaaacacagccatcaactcagctgatgcctacccacaaagggagcatttaaaccagcctagccagaggggaattgccaatgccagcagtcagaacttgagttcccacaaacctcgccactgaggagtaacatgctctgggtctctaagtaaacttggaaggcagtctaggccacaagaactgcaactcttaggcaagtcctagtgctgaactggacccagagacagtggactgggagggcacgtgacctactgagacaccagctggtgtggctaagggagtgctggcatcaccctccctgaaccccaggttgcacagcttgcagctccaaaagagaccccttccttccacttgaggagaggagagggaagactggggaggactttgtcttacatgttggataccagctcagccacagcaggatagggcaccagtcagagccataaggcccccattcttggcactagctcccatacatgtctagacactccctgggccagaagggaacccactgtcttgaagggaaggatccagtcctggcatcttttatcacctgctaactgaagtgtgcttgggcccttaaaaaccagaagtgatacccaggtactacgttgagggccttgggagagtctctgagactttctggattcaggagagacttagcacattcttagctgtggtggctagagagcaaaactccttctgcctgtgaaaagcagagggaaaagtaaaagggactttgtcttgcaccttaggtaccagcttggccacaggggagttgaggaccaagcaagctcttggagttcctgattctaggacttgactcttggatggcatttctggacctgccctggggcaaatgggagcccattgccctgaaaggtgagttccaggccaggcagcattcaccacaagctgacttaggagcccctgggccttacaggaacatcagtgatagtctggcagcactccctgtggcctgtggtggtattggctatagggtgaggctcctctgcatttggaaagaggagggaagagtgagaagggatgcatcttgtggtctgattgccagctcagccacagtacaatagaacaccaggtagatttctaaggatttttactctaacccctaattcccggacggtatctctggacccacttggggcctgggggacctcactgccttgaagggaaggacagaggtctggctggctttgccccctgctgattgtggaatcccagggctttgagtgaacataggcagtagccagggagtggttacatcaggccttgttcaaaacccagtgttgttcaggcatcaggtctgacccagtgcagtcccagtggtggtggccacagggcatcttgtgtcactctaccaccagctttaggtggcttggaacacagagagagactccatttgtttgggagaaaataagggaagaaaataagagtctctgcctggtatttcagagaattctcccgaaatctgtcctagaccatcagggtggtacctctgcacatctgcaagaatgatagcattatgggcttggggtgccccctaaagcaaatacagcttaaatcacaacaccaactccttttgaatagctggaaagccttactaaggaggacaggtacaaacaagcccagacaatgaagactacaataaataccaatgcacagacactgacaaacatctacaaacatcaacatcatctgggaaaacattacctcaccaagtgaactaaataaggcaccagagaccaatcctggagaaacagagatatgtgacctttcagacagataattcagtatagctgttttgaggaagctcaaagaaattcaagagtaacactgagaaggaattcagaattttattagataaacttaacaaagatattgaaataattaagatgaattgagcagaaattctggagttgaaaaatgcaattggcatactgaagaatagatcagcatcttttaataccagaattgatcaagcagaacaaagaattagtgagcttgaagacaagctatttgaaaatacacagaagagacaaaaggaaaaagaaaaacaaacaatgaagcacacctaaaagatctagaaaatagcctcatgaaagcaaagctaagagttattagccttaaaaagaaggtagagaaagagataggggtagaaagtttattcaaagggaacataacagagaacttcccaaacctagaggaagatatcaatatgcaagtactagaaaattataggacaccaagcagatttaacccaaagaagactagctcaagacatttaataatcaaactcccaaagatcaaggataaagaaaggattctaaaagcagcaagagacaagaaacaaataacatataatagaattccaatacatctggtagctggcttttcagtagaaactttacaggccaggagagagtcacatggcatatttaaagtgctgaaggaaagaaacgcttaccctagaatagtatatctggcaaaaaaaaaaaaaaaatccttcaaacatgaaagaaaaataaagacattaccagacaaacaaaagctgagagatttcatgaacaccagacctgtcccacaagaaatgctaaaagaggtacttcaactggaaggaaaggacaataatgagcatcaagtaatcacctaaagatacaaaactcacaggtaatagtaaatacacagaaaaacacagaatattacaacactgtaactgcagtgtgtaaactactctttccctaagtagaaaggctaaatgatgagccaatcaaaaataataattacaatgtttttcacgacatgaacagtacaataagatataagagaaaaaagaaaaaattaataagtagggggacaaagttaaggtatagcatttttattagctttctttttgcatgtttgcttatttatgcaaacagtgttgttatcagcttaaaacaattggttataagatagaaattgcaagcctcatggtaacctcaaaccaaaaacatacacaagggacacacacaaaaaaatcaagaaaccgacatatatcaccagtgaaaatcaccctcacttgaggaagacaggaaggaaagaaagaaggaagaaaagaccacaaaacaccagaaaacaaataacaaaagggcaggaataagttattacttatcagtaatatttgtattacttcattctcatgttgctttaaagaactgtctgagactgggtaatttataaagaaaagaagtttaattgactcacagttccacagggctggggaggcctcaggaaacttgtgaccatagcagaaggggaagcaaacacatccttttacacatggcagcaggaaggagaagttttgggagcaagccccccaaaatctggccataaactggccccaaaactggccataaacagaatctctgcagtactgtgacatgttcataatggccctaatgcccaagctggaaggttgtgggtttacgggaatgagggcaaggaagaactggcccacccagggtggaaaacagcttaaaggcattcttaagccacaaacaatagcatgagcgatctgtgccttaaggacatgctcctgctgcagttaactatcccaacctattcctttaattcggcccatcccttcgtttcccataagggatacttttagttattttaacatctatggaaacaatgctaatgactggtttgctgttaataaatacgtgggtaaatctctgttcggggctctcagctctgaaggctgtgagaaccctgatttcacacttcacacctctatatttctgtgtgtgtgtctttaattcctctagtgctgctgggttagggtctctctgaccaaaatcatcagatcttgtgagaactcactcactatcacgagaacagcatgtggtaaccgcccccaagattcaattacgtcccaccaggtccctcccatgacgtggggattatgggaactataatacaattcaaggtgaaatttgggtgtggacacatccaagccatatcaatattgaatgaaaatggactaaactctccaatcacaagacatagactagctgaatggataaaaaacaatacccatcagtctgttgcctacaagaaacacacttcacctataaagacacacaaagactgaaaataaaaggatggaaaaaggtagtccatagcaatggaaaccaaaaagcagcaggagtcactgtacttacatcagacaaaatagatgtcaagaccaaaaccataagaaaagaaacaggtcactgtataatgctgaagggttcaacttagcaagaggatataacaattttaagtatatatgcacccaacactggagcacccaaatatataaagcaaatattattagagtgaaagagacaggccccaatacaatgatagctggaaacttcaacaccccattttcagcactggacagatcttccagtcagagaaccaagaaagaaacatcagatttaatctttattgtaaatcaaatggctctaatagtttgcaagagcaaatcaaaccccaacattagtagaagaaaaggaataataaatatcagagcagaaataatgttgaagaaagaaggcagaagattaatgaactaaaaaagttacttttttgaaaacttaaacaaaattgaccaacctctagccagactaagagagaagatccaaataaataaaatcagacatgaaaaaagagacattaaagctgatactgcagaaattcaaaggattattagtgactaatatgagcaactaaatgccaataaactggaaaatctagaagaaatgggcaaattcctagacacatacacccaccaacattgaacctgaaagaaacccaaaacctgaacagaccaataacaagtaacaaaattgaggccataataaagtctgccagtaaagaaaagcccaggacccaatggcttccctgctgaattctaccaaatatttaaagatgagctaatactaatcctactcaatactactccgaaaaatagaggaagagagactacttccaaactcattctacgaggccagtattaccctgataccacaaccaggcatcaaaaaaagaaagctacaggccaatatctcttaggaatattaatgcaaaaatcctcaacaaaatactagctaactgaattcaataatacattagaaagatcagtcatcacgaccaactgggatttctccctggaatgcaaggatgattcaacatatgccaatcaatcaatatgatacatcctatcaacagaatgaaggataaaaatgatataaccatttcaatggatcatttctatataaagcatttgataatatccaacatcccttcatgataaaaaccctcaaaaactggggatagaaggaatatacctcggcaaacgtgaagatggctgaataggaacagctccagtctacagctcccagcgtaagcgacgcagaagacgggtgatttctgcatttccatctgaggtaccgggttcatctcactagggagtgccagacagtgggcgcaggccagtgggtgcgcgcaccgtgcgcgagccgaagcagggcgaggcattgcctcacctgggaagcgcaaagggtcagggagttccctttccgagtcaaagaaaggggtgatggacccacctggaaaatcgggtcactcccacccgaatattgcgcttttcagaccggcttaaaaaacggcgcaccatgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcacagcacagacaaacaaaaagacagcagtaccctctgcagacttaaatgtccctgtctgacagctttgaagagagcagtggttctcccagcatgcagctggagatctgagaactggcagacggcctcctcaagtgggtccctgacccctgacccctgagcagcctaactgggaggcaccccccagcaggggcacactgacgcctcatacagcagggtattccaacagacctgcagctgagggtcctgtctgtttgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctgctcctccaaaggaacgcagttcctcaccagcaacggaacaaagcaggatggagaatgactttgatgagctgagagaagaaggcttcagacgaacaaattactctgagctacgggaggacattcaaaccaaagcaaagaagttgaaaactttgaaaaaaatttagaagaatgtataactagaataaccaatacagagaagtgcttaaaggagctgatggagctgaaaaccaaggcccgagaactacgtgaagaatgcagaaccctcaggagccgatgcgatcaactggaagaaagggtatcagcaatggaagatgaaaggaatgaaatgaagtgagaagggaagtttagagaaaagagaataaaaagaaatgaacaaagcctccaagaaatatgggactatgtgaaaagacaaaatctacatctgattggtgttcctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcaggaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccagtaccagccgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacacactttaaaccaacaaagatcaaaagagacaaagaaggccattacataatggtaaagggatcaattcaacaagaagagctaactatcctaaatatatatgcacccaaaacaggagcacccagattcataaagcaagtcctgagtgacctacaaagagacttagactcccacacattaataatgggagactttaacaccccactgtcaacattagacagatcaacgagacagaaagtcagcaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccactcagctacatggacactgaacaacctgctcctgaatgactactgggtacataacgaaatgaaggcagaaataaagatgttctttgaaaccaaagagaacaaagacacaacataccagaatctctgggaggcattcaaagcagtgtgtagagggaaatttatagcagtaaatgcccacaacagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatctacaaaattcatagacagctagcaaggctaataaagaaaaaaagagagaagaatcaaatagacacaataaaaaatgataaagaggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagtttaccaaccaaaaagagtccaggaccagatggattcacagccgaattgtaccagaggtacaaggaggaactggtaccattccttctgaaactattccaatcaatagaaaaagagggaatcctccctaactcattttatgaggccagcatcattctgataccaaagccgggcagagacataaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcagtaaatgtaatccagcctataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaattaggcaggagaaggaaataaagggtattcaactaggaaaagaggaagtcaaattgttcctgtttgcagacgacatgattgtatatctagaaaaccccattgtctcagcccaaaatctccttaagctgataagcaaattcagcaaagtctcaggatacaaaatcaatgtacaaaaatcacaagcattcttatacaccaacaacagacaaacagacagccaaatcatgagggaactcccattcacaattgcttcaaagagaataaaatacctaggaatccaacttacaagggatgtgaaggacctcttcaaggagaactacaaaccactgctcaaggaaataaaagaggatacaaacaaatgtaagaacattccatgctcatgggtaggaagaatcactatcgtgaaaatggccatactgcccaaggtaatttatagatccaatgccatccccatcaagctaccaatggctttcttcacagaattggaaaaaactactttcaagttcatatggaacaaaaaagaggccgcattgccaagtcaatcctaagccaaaagaacaaagctggaggcatcacactacctgacttcaaactatactacaaggctacagtaaccaaaacagcatggtactggtatcaaaacagagatatagatcaatggaacagaacagagccctcagaaataatgccacatacctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagatttaaacgttagacctaaaaccataaaaaccctagaagaaaacctaggcattgccattcaggacataggcatgggcaaggccttcatgtccaaaacaccaaaagcaatggcaacaaaagacaaaattgacaaatgggatctaattaaactaaagagcttcttcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaactccatcaaaaagtgggcgaaggacatgaacagacacttctcaaaagaagacatttatgcagccaaaaaacacatgaaaaaatgctgatcatcactagccatcagagaaatgcaaatcaaaaccacaatgagataccatctcacaccagttagaatggcaatcattacaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagtactataaatcatgctgctataaagacacatgcacacgtatgtttattgtggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaagtatcgcaagaacaaaaaaccaaacaccgcatattctcactcataggtgggaattgaacgatgagatcacatggacacaggaaggggaatatcacactctgggactgttgtggggtgggggaaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaagaaggaatatacctcaacataattaaagtcatttatgacagacccacaactagcatcacactgaatggggaaaaactgaaatcatttcttctaagatctgaaacacaacaaggaagcccactttcactgctgctattcagcatggtactagatgtcctagctagagcaatcagacaagagaaagacataatggacatccaagttggaaagcaagaagtttaattattcttgtttgcagaaaatatgatcttataaatgaaaaaatctaaagactccgtgagaaaactatttgagctaataaacaaactcagtaaagttgcaggatacaaaatcgacatatgaaaatcagtagcatttgtatatgccaacagtgagcaatctgaaaaagaaataaaaaagtaatcccatttacaatagccacacataaaattaaatacccaggaattaaccgaagaagtgaaagatctctataaagaaaactataaaacactgatgaaataaattgaagaggacacgaaaaaatggaaaaatattccatgttcacagattggaagaatcaacactgttaaaatcttcataccacccaaagcaatttacagattcaatgcaatccctatcaaaataccaatgacattcttcacagaaatagaaaaaacaattctaaaatttatatgaaaccaaaaaagaccaagaatagccagcactatttggctaacaaataaaaataaaacattatgaacttaaagtttatactactgagatataataaccaaaacagcatggtactggcatcaaaagagacacagagaccaatagaacagaatagagaacccataaacaaatccacacacctacactgaactcattttcgacaaaggtgccaagtacctacagtaggaaaaagacagtctgttctataaatgttgctgagaaaactggatatccatatgcagaagaatgaaactaggcccctatctgtcaccatatagaaaaatcaaatcaaaatgtattaatgacttaaatctaagacctcaaactatgggactactgcacaaaaacattggggaaaatttccaggacatcagactgggcaaagatttcttgagcaataccccacaagcacaggcaaccaaagcaaaaatggacaaatgagatcacatcaagttaaaaggcttcttctgcacatcaaaggaaacaatcaagaaagtgaaaagacaacccatagaatgggagaaaatatttgcaaactacccatctgacaagggattaataaccagaatatagaaggaggtcaaacaactctataaaacatctaatgatccgatcaaaaaatggacaaaagatttgaatagacatttctcaaaagaagacatacaaatgacaaaaagtcatatgaaaaggtgctcaacatcactgatcatcatagaaatgcaaaacaaaactacaatgagatatcatctcaccccagtttaaatggcttctatccaaaagacaggcaataacaaatgctggcgaggatgtggagtaaagggaactcttgtacactgttggtgggagtatacattggtacggccactatggagaacagtttggaggttcctcagaaaactaaaacttgagctaccatatgatccagcaatttcagtgctggatatatacccccaaagaaagaaaatcagtatattggagagatatctgcactcacatatttgttgtggcactattcacaatagctaagatttggaagcaacctaagtgtccatcaagagatgaatggataaaaaacatggtacatatacacaatggagtactattcagccataaaaagaatgagatcctgtcatttgcaacaacatggatggaactggagatgattatattaagtgaaataagctaagcacagaaagacaaacactgcatgttctcacttgtttgtaggatctaaaaatccaaacagttgaactcatggacacagagaatagaagcctggtaccagaggctgggaagggtagtgggggctggtgagaaggtaaggatcattattgggtacaaaaaaataaaaagaatttataacacctactatttgatagtacaacagggtggctgtagtcaataataatttaattgtacatttaaaaataactaaaagagtgtaactggtttcttttattataacacaaaggataaatgcttgaggggatgcatatcccattctctatgatgtgatcattgtacagcacactcctgtaccaaaacatctcatgtatgcccacaaaaattaaaaataaaaaaaattaaaataaaaaaggaaattctatctttcatgacaacatcgatggacctagaagatactagctaagtgaaataaatcagttgcagaaggacaaatactgcatactttctcttctatgaggcatcaaaaatagtcaaacatgtagaagtagaaaatagagtggtggttaccaggagatggggatatgggatattaggagctcttttttcagtggttataaagttacatttatacaagatgagtgcgttccagagatttcctgcacaacatagtgtctgtagttaacaatgaggtattgtgcacttaaacatttgttaaaagggtatatgtcatgttaacttttcttataaaaagaaaagttaaaaaacaacattaaaaaacaacaacaaaggaacacaaggaaacttttgcaggttacggatatgtttattactctgattgtagtatggcgacatgagtgtatacatatgtccaaactcatcaaattgtacacattaattaggtacagtttttatataccagttgtacctcagtaaatctagaagcaggaagaaaccttgtgtcacttcatcaaaaatacataaccatccaaatatgttatcagctaattccagagattcaaaatatatgaagaaaatattgacaataataaaataataaatagacaaatatacaaatataactgaagactttcaacatctttctgccaaaaatttacacaagtagacaaaagaaaaccagaaagaacattttaaaaactaaacactaccaaccaactcgacctaattgatgtttataatacattctttgtgagtccataagaaacatctaccaagattgactgtgttctaggctctaaggcatgtctcagtaaatatcagaggactgaaattcagattatattttctgatcagatcattattaaatgagttatctataataataatatatcaagaaatatctatttggaaattaaacaatccacttttaaataactaatctattcaggaataaatcataaggaatttataaaatattttctactgaattgtcatcaatttttttaggcagatctcaaatcaatcatcttatgccttaagactcaagaaaaggagtagaaaattaaacccaaagtaaataaaagaataaataattaaagtggtagatgtcataatgagaaaatataaaaaataaaaaaacaaattcaaaaggccatttaaaaaatattagtaaagtttatataaccctagccagagtgattaagaaccaaaatgactcaaaataccaacataaggaatgtaaaagtggaaattactgtagactctagtgaaattaaaggaaagtaaaaatatataaaaactggataacaaaaatttggaaaacttggataaaatgaacaaaatttcttgaaaaatataatttaacaaacttacacatgaaaatatagaacatgtaagtggtcccacatagaacttagtcaaaagccttctatcctagttagcttcaccagtgtattctcttgataatcaagcaggaaaacaatgccaattctacagaatttctttcagaaaattgaatagaattaaaaacttcccaactcattctatgagaccagcatcaactagataaaatgttaagtttcttaagtatttccaaatcaagcaatgtaatatatctcattaacagaataaaggaatgatagtgtaactatctcagtagattaagagaaaacttttgacacaatttaagacacacacgtgatttcttaaaaccaatttctagatgttaggagctactatttgtatctttcttaaagaaagtcttagttttaataatcttttggggtaaataattttaagtttacataaaagttccaaagatagtacaaagaattcttgtatagcctctaccaagtttcctttaatgttaacatacaatgatacttttgtcagaactaagaaatcaacattcgtacaataccaatagctatagacgttatcagatttcactaattttctaatgtaggggcagaaaaggtgtgatacctttcttcaaccatcataacagtcatgaccaacattcttataacaaagacagattaacaaaagaaatgtacaacaagtttatttaatcaaagttttacacgacatgggagaattcagaaatgaaggctcaaagacccagggaaaactgcccatgtttatgcttagattctacgaataatggacagccatatggaaacgtgattggacaaaaaggtatgacctaataataataggccaagagggggaacctggcaaggcctgtccagattcttcttggcctctctgtttagcattccttcatccatggtatggagcaagacccttctggaatggaggtcttatgacctactgtcagacaagttagttcagagaatttctttatggcccgttcttacacagaaaggagggagtaggttagagtagtatttctaggttttatggctggctttgggggagaggagttgtagtttctataactatccttggggaagaagaattttgtttctatgacttgtttgaggggagaaagaagggtgagagacaggagggcaggagaaggtcggagagactttgcttctgcagctacttctgaggtcttctggtctcctttagttcaaagtactcatcatacaaaaacaccatactttggggtattattttctgagccctaacaccactaatacccttttactgataatatgcagtatatcacattacattttgttattgtgtctctgtattctcctctactcagtgatagtttttattgtttctctttttttatggccttgatacaattgaagcattctgttaaggtaatttgcagcatgttcctcaatttgaatataactgatgttttctcatgattaaatggggttataagtttgggagaagaatatcagaaaaggtgaagtttcctcctttgcatctttctctccagaagctggagcttaatttcttccctagagtgtgggctgaattttgtgacttgcttcctaacagtagattatggaaaaggtaaatagcaactttacagtgaagaaacatggcagacaacaccttaaacaagtgatcaatagtaacatcatgcttgatgtaacgcaatgagaagtgaacctctcctttcatgaccagtgttaacacatgccctcaatctgagggacctgaatctaactccaggtggataatgtcagaattgaattaaatcataggacacatgattagtgtccactgaagaactgtttggtgtaggggtaagcccctacacatctggccacagaagtgatctgtcttgggagtataataggagaaaaaacaattagcttgtttagtttttttttcctactttacaaaatgtattttgtgtgatctctattatcttaagtttgttaagacttatggcccggaatgtgatgtctcttgatgaagaatatatattgtcctgatgttgagtagagtgctctataaaatgttcaattggtcaagtaggttagaagtgtcattcaggtaatctatatctttataaattttctgcctacttgttctattgattacagagaaatgagttttaaactccccaactattactctgaaattgtctgtttctcctttcagatctatccatttttgtctcatgtattttaaataaagctctgttgttaggcacatacatttttaggattgttatgtcttcttggagaagcgacatcattatcactatgcaatgttcctctttatctgttataatcttatgtgacctgaagtctacttatccaaaatcaatatagctattccagtttccttttagtgttagcattgtatacctttcttgatccctttacttttaacctaagtctttatatttaaagtggctctctgtagacaacaaatagctgggtcttggcttttaattcaatctgataatctctatcttgtttttatttgtaaaaatttaagaggtacaagtgcaattttgttacatggatatagtgtatagcaatgaagtctgggctttcagtgtaaccatcacctgaacagtgtacattgtacccattaagtaatttctcatttctcatccctcatccccctcccaccttcccatccttcaagtctccaatgattattatttcacactatttgtccatttgtacatgttatttaactcccacttatgagtgagaacatgtagtatttgactttctgtttccgaattgtttcacttaagattagggcctccagttccattcacattgctgctgaaaacatgattttattcttttttattgcagaatagtattccattatgtgtgtgtatatatatatatatgtatatgtatatatcacagttttatatatgcatatatttgtgagatatatatgtatatatgtatgtatatatatcacattttctttacccaatcatccattgattgacacgtaggttgattccatatctttgctattgtaaataatgttgtgataaacacatgagtgtaggtatctttttgaaataatggtttcgttttctttgggtagatactcagtagtgggattttgctggatcaaatgatagttctatttttagttttttgaggaatctccatgttgttttccataaaggctgtactaatttacattcccacaaacagtgtataagtgttcccttatttcccatcctcaccaacatctgtggggtttttttgtctttttaataatagctattctaagtagtgtaaggtgatacctcattatgattttaatttgcatttctctgatgattagtgatgttgagcattttttcataagcttattggccatttttatgttttcttttaaaaatgtgtgttcatatcctttgtccactttttaatggagttatttgggggtttatgttaagttgagttccttgtaaattctggatatctgtcccctgtcagattcatagtttgcagttttctcccattctgcaaattgtctgttcactttgtggattatttcttttttttttttccttttttttttttttttttgctttcttgattttatttcaaaagtacacaaggtcacaaaactagagcaagttgtttttcttaacaaattttgttcttacaaatttcaaaatctgcaccattggatatataagccaaaaatcatatatacaaaatctgaaactgacactgtcaattctatactttgcacacgtgaagtgtcaaaatatttttctcagtagtacaagtgtatttatcactaaaattcacaattagggaaaagaataagtgaatcaatgaactgtggttctcttaaaacttgtgtcattaaatatgttagcagaaaacacaaagttctgttttgttggaacttttagtctcgatgactaaaaccaaacccaacggatatgtactatattcttaaattataaaataagataaattataatagttaaccttaatgaataagaggctagttgttgcgggaagtcagggaccccaaacggagggaccagctgaagccatggcagaagaatatggattgtgaagatttcatggacatttattaattccccaaattaatacttttataatttcttatgcctgtctttactgcaatctctaaacaaattgtgaagatttcatggacacttatcacttccccaatcaatacccttgtgatttcctatgcctgtctttactttaatctcttaatcctgtcatctggtaagccgaggaggatgtatgtcgcctcaggaccctgtgataattgcgttaactgcacaaattgtagagcatgtgtgtttaaacaatatgaaatctgggcaccttgaaaaaagaacaggataacagcaatgtttaggaaacaagagagataaccttaaactctgaccgccggtgagccgggcggaacagagccatatttctcttctttcaaaagcaaatgggagaaatatcgctgaattctttttctcagcaaggaacatccctgggaaagagaatacatgcctgggggtgggtctatagatggcccccttgggtgtggccgtcttctatggtcgaaactgtaggggtgaaataaaccccagtctcccatagtgctcccaggcttattaggaagaggaaattcccgcctaataaattttggtcagaccagttgctctcaaaacgctgtctcctgataagatgttatcaatgacaatggtgcccgaaacctcattagcaattttaatttcgccccagtcctgtggtcctgtgatcttgccctgcctccatttgccttgtgatattctgttaccttgtgaagtacctgatctttgtgacccacaccctattcgtacactccctccccttttgaaagtccctaataaaaacttgctggttttgcagcttgtggggcatcacggaacctactgacatgtgatatctcccctggacgcccagctttaaaatttctctcttctgtactctgtccctttatttctcaaaccggctgatgcttagggaaaatagaaaagaacctacgtgactatcggggcaggttccccgatagctggtattatctgctataagataaatgatcagccttccctaaagataaactgaaccacaattcacaaatttgtttattattcttccctgcttctataacatttacaaaaataatttgtcctcagttatggcctattttagtgttaaaataggtaaatgagtaagaaatcctattgcagaacataatgcctttattgctggaatatccaaaggcattcaaaatattaaaacttgcccagaacatttacactactaaacacaggaatgttataaagatatatgtacatatatatataatatataatgtcacaagccactaagaagttaaaattctgccaacattttatacaaactactctttatgtgacacatcaaagcattaaccatgtaaaatatgaactttttctgttcccacttgaataaggcatctgaaagccctaaacactgctgaagtgaaaattagaagaaaaaacacttaacattcacataacaccaaatgtacatgctgcacgcacacaaaagacacttagaatatttttaagattatttcttttgctatgtagaagctctttagtttaattaagtcccattgtctacttttggttttgttgcttgtgcttttaaggtcttaatctccatcttttaattggtatatttagatcattcacatttgcagtggtattgatacagttggattaaaatatataacctttctagatctttactatttgtttcatttgttttttgtttcttttttccttttatgtctaccttctctgggtttaattgatgtgtttatgacttttctatatgctttattgaattattatttatacctctattttgctttttacatgattgttcttacatttgcaatgaacatttttaaataacctaagtccaatttcaaatactattatatgaatttttgtgtagtgtaagaaccttataacagtacattcctattgtcccctctcataccttgtggcattacgtttcatttttacataagctatcaacacatagtattttgttactattgttttaaataatctgtcctattttctagtaaatagaaggaagattatattttatcctcatgtattattccgttttcaatgttctagatttctttgtgtagatccaagtttctggccttatcattttccttttgcctgaagaatttattttaacatttctacaaatggtctgctaacaataaattatctcaacttacatttatctgagaaagcctttatttctcttttacttttgaagaatagtttcacgagagatagaattctgggttgaaagggttttttttttctttcagcactttaaatatgtaacttcattgtcttctggcttgcatgatttctgatgagaagtctgctgtaattattattatagtttctctatagataatgtgccccttcccatccattggctaccttcgagaatgtctttctttggttctcaaaaacttgaatatgacttgactgtatgtggttttattttgctatctatcctgtttgatgttttctgagcttcttggacccatgtggggaggggttatttgtcattaattttggaaaatttggggctatttttctgctcaaatttatcttatggccctttccttctctttctaagacttcaattatgcatatattaacctatttgatattgtctaatagatgttggaagctctattctgctttgttttcactctttattctgtttcagtttatgaaattttgcatgatactttttcaagttcagtgcttcttcccttggctatattaagtctactgatatacccactgaaggcattcttcatctttgctactatgtttcttatttctaccatttacatttgacctgttctcatcattttcatctctctgctaaaataatctgtctgaccttgcatgctgtctacatttctcattagagattttgatacatttaaatcacagttacttttaattctttgatagttagaacatgtgtttcatacctgagtctggttctaattattgctttgattcttcagaatgtgagatatttgtatacctcataatttttgttaaaagcaggacatgtgtataggacaggagatacaaacataaatattacattttatgcttggacatgagtatggctttcattttgctagaattttattatggggagtttgctaatatagtaaggagttgacctgggcatttgaagttccttgttgcaatggttactctacatgaaccagagatttaagattgatacattgagacactttctgggggaagcaggacaaagggaagatgcaaagaaaaggggagtagggagacaataacaagacaaaaaatttctcctcctgctccttcccaaggagtagcactgcttttcttttttctatgttcccctcctacagctaggttacagttttgatacctctttccctatagattaaatcttttgtactgtaaggaaaatagggaagacgagtcagctggaacttttggtaggggcttctctttctctctcccagcaagctctattggtgttcgttctaaggatcctctcagatctttttgtgggcatctagagaggttcttggagaaaaagctcaggagacaatgtgagacccctccagggacttcatactctcctagtagcccacattcagccttgtcttgaaatttcagacatttcttgaaattttctattttaatcttcttaatgtcttatgtcagtgtcagtggtcctcaacctttttggcaccagggaccagtttcgtggaagacaatacgttttttttttttttttgagatggagtctcgttccgtcaccgaggctggagtgcaatggcgtgatcttggctcactgcaacctctgcctcctgggttcaagagattctcctgcctcagcctcccgagtagctgggataatgggcgcgtgccaccatgcctgactaatttttgtatttttagtagagacgggtttccccatgttcgtcaggctggtctcaaactcctgaactcatgatctgcctgcctcggcctcacaaagtgctggcattacaagcgtgagccaccgcgcccggccggaagacaatttttcacggactgggcatggagtatggtttcgggatgattcaagtgcattacatttattgtacactttatttctattattattacattgtaatatataatgaaataattatacaactcaccataatgtaggatcagtgggaaccctaatcttgttctcctgcaactagacagtcccttctgggggtgatgggagatagtgacagagcatcaggaattagattctcataaggagcgtgcaaccaaatccctggcatgcacagttcacaatagggttcccattcctatgagaatctaatgccgccactgatctgacaggaagtggagctcaggcgtaatgcaagtgatggggagtggctgtaaacacagatgaagctttgctcactcactctccgcttacctcctgctgtgcgaccctgctcctaacagaccacggaccagtaccagtccgtggcccaggggttagggacccctggcttacatggcatttgggcagtgtctgtcccatgcaagcaaatgctcatgtcctctttccacctgcgagcacctgagtttcactaatttttgtgttaaatgtatttcatgagacctccgttctctgaagtgttcccaagaagtcattactttgcagtttttccacctctttttcttgttttatgagtaggaatgatgctcctgacatctatgggcatttctgagctcaaaccataagcactcagcaaaaatctttttaaaagatggtgctgatcagttgaatatcaatatgaaaagaaatttgatccttgatccctatcagacttcatatatggtccttcaccaaatagcaatatttcagtcaatgacagaccacatatataatggtggtcccataagattgtaatacagtatttttattgtaccttttatatgtttatatagttttatgtatacagatacttaccattgtgccacaatcagttataatattcagtatagtatcatactgtacaggtgtgtagcccaggaacaatatggctaggtatatagcaagctatatagtctaggtgtgtagtaggttataccatctagggtcatgtgagtacactctatgatatttgcacaattatgaatttgcctaacaatgcatttctcagaacatatccccatcattaaacaatacacgattgtacatccttatcttattactgtccactgtttgggcctcttgaagacaccaatctggcaagctactctacatgctcttaaaagttctactggctttttctcactccagtaaagttccttctcctattattgttctgataccttgtccaccattgcacagactcatcacataactctagcagctagtgatctttgttcaccaaacaaggacatgtcctattatggaatttagtttctttaaatttatttgtctacacagatctttcgtgtctttacaaatgagtacttttttgagttttcttttattttgtcagttttttgtcttagttgatacaattgtcacaatggtctgtcatgatattctacctctgaaatggaagtgacacatctattaatagttatttaaatggtatgttcaaagaaggtacattaaggactgcctgacacaagtcatttctaactaaaagccaccacaaattattcctgactagatgccttcatgtttattttttgaaaaaaaatcaaaataatactccataaaacctgttgtaaattttatattctatgtattactgacatatttggatatttgtacataatctttaactatatatttattaatgcctgtatactacaatgccatatggatgtaccataatttatttaaacactcccctgttggtggtcatttagatttttctcctggtgataagtatgtttgagcaatagctacacacaatataattggttaggtagttttttaaagcacagacatgttcttaattattcttgaagattatattttatgttagaagaattttaaaggactaaattaatgtagttagtagaaaaactcttagtcaataaaatatgaggagacagagatgagatttaaaaaaaaaaaagaagactattgccaggcgcgatggctcatgcctgtaatcccagcactctggggggccgaggcgagtggatcacctgaggtcaggagttcaagaccagcctggtcaacatggcgaaatcccgtatctacaaaaattagccgggtgtggtggcgcctgcctgtagtcccagctacttgggaacatgaggcaggagaatcacttgaacccgggaggcggagactgcagggagccaagatcacgccactgaactccaacctgggtaacagagcgaaactccgtctcaaagaaaagaaaaagaagactacaaatattctcaaggctaaggaccacaaaatgtaactgaactaaggatatagctggaatctgagagagtgggggacacgtttcatgtaaaactgaagggacgaatctacttcaggtttttccatttatgagaaccacctcctcacctctccccacccacccccaaggacacatttgctgttgaaattatatgaggcaaatccagccacaagttaaataagtagaaatgaagagcagagatacagggcttttatgaattttaactagggggagaatttgggagatgtttgactagagaataaaggaataaagtgtgacattctatggagaagggcttgaagctaaacacaagatgtattttgaacctgcaaacttgagaaattcttgatctttgtatctgcctgtcatctccccagctgcaatgagtaggatcaaggtaaaataaccaagtctttttttttttttttttttttttttgagacggagtctcgctctgtcacccagcctggagtgcagtggcgcgatctcggctcaccgcaagctccgcctcccgggttcatgccattctcttgcctcagcctcccgagtagctgggactacaggcgcccaccacctcgcctggctaatttttggtttttttttttttttttttagtagagacgggggtttcaccgtgttagccaggatggtctcaatctcctgacctcgtgatccgcccacctcggcctcccaaagtgctgggattacaggcgtgagccaccgcgtctggcaaccaagtctttcttaagtccaaactgcatatttctattatatttagaagagaataacaggagagcggagagaagagggaaagcctgggtgcaggtatatctgggagtgggtggtggcttatttgttttgatgggagttgtcagctgttctcagaccactatcttgacttatcttcttgcctcttgctgctgccaaagatcaccaatttactcagagttagttgaatgggaatacctcggaagtcttagacaaacaatttataatatcttatttcaaatactgttgtaatgggcatactgtacataaaattcttattaggccagggaggctgaggtgggaggatcacttaagaccaggagtttaataccagccttatcaacatagtgagaccccgtctctacaataaataaatagccaggcaaggtggcacacacctgtagtcctagctactcgggaggctgatgtgggagtatcgcttgagccctgaaaattaaggctgtcatgagctatgatcatgcaactatactccagcccaggtgacaaagtgagaccctgtctctaaaaataaataaataaataaataaataaatacatacatataaatataaattctcattaatctctgattttttccttaggattaatctccagaagttgtgctaccaggttattttctcctatattgccaaatttcactgtaggttcttcttttaatgaccaactcccagaagtttctacatgatttattttccctaaatagggcgtaaatcatgagaacattacaaaagaggacagaaacaagcagtggagaaaggattccctatttaataaatggtgctgggaaaactggctagctaaatcaggaaactgaaactggaccccttccttacaccttatacaaaaattaactcaagatggattacagacttaaatgtaagacctaaaaccataaaaactctagaagaaaacctaggcaataccattcaggacataggcatgggcaaggacttcatgactaaaacaccaaaagcaatggcaacaaaagccaaaatagacaaatgggatctaattaaactaaagagcttctgcacagtaaaaaaaaacaaatcatcagagtgaacaggcaacctacagaatgggagaaaaactttgcaatctatccatctgacaaagggctaatatccagaatttacaaagaacttaaacaaattcacaagaaaaaaacaaccccatcaaaaagtgggggaaggatacgaacagacacttctcaaaagaagacatttatgcagccaacaaacagaagaaaaaaagctcatcatcactggtcattagataaatgcaaatcaaaaccacgatgagataccatctcacgccagttagaatggcgatcattaaaaaatcaggaaagaacagatactggagaggatgtggagaaataggaatgcttttacactgtgggtgggagtgtaaattagttcaaccattgtggaagacagtgtggcgattcctcaaggatcgagaaccagaaataccatttgacccagcaatttcattatgggaaccacctgggtatacacccaaaggattataaatcattctgccataaagacacatgcacatgtatgtttattgcggcactgttcacaatagcaaagacttggaaccgacccaaacgcccatcaatgatagactggataaagaaaatgtggcacatatacaccatggaatactatgcagccataaaaacggatgagttcatgtcctttgcagggacacggatgaagctggacaccatcattctcagcaaactaacacaagatcagaaatccaaacaccacatgttctcactcataagtgggagttgaacaatgagaacacatggacacagggagggcaacatcacacaccagggcctgtcggggggtagggggctaggggagggatagcattaggagaaatacctaatgcagaggacgggttgatgggtgccgcaaaccaccatgggacttgtatacctatgtaacaaacctgcacgttctgcacatgtaccccagaacttaaagtataataataataaaaaaaaagaatactaaagctgaaaggttcacattaccagatagcaaggcttatttaaaaactgtagtaattaagagactgtattatgggtaaaagaataaaaactagaccaaacgaacaggctagacagcccagaaacacacatacacatatatggtcacttgatttatgacacagtaccataacactgcagtggcaaaaagtatttctaattgtgctttgtcaattggatattgctatggaaaaaaagcaaatcttaactccttctgcataacatacaaaataatcagttctagaagtattttagatctaaatgtgagaggtaaagtaataaatattttagaggaaaacatagaagaaaatgaccataaacttgcagtatcaaatgtgtcttttaaaatttctgtattccttttatttattcatttttaaatcttcgacacaatttaacctccagaaaagttacgagaacaacactaaaaggcctatatacatcttaatattatattatgtcatttcctaaattctcctctctctttaattctctatatatctctatatattttttctgaagcctttgagagtaagttgcaggcatgatgtccttttatctctaaatattttattgcatattttcttaaaaactaggaaattctcttttctaatcacagttcaattagaaaaatcagacaactaatattgatgtaataatatctaataatagaacttatattttataacttcaaatgaatccatttttatggcctctggattttcgatgttagttggaaatcctttcactatacacacgttaaagaggaatttatacacattcttctggtatttatatgatcattttttatctatttggcaaaaccagtcatctaagcaaaatttattaaacagttgatcttttagccatttgaaatgccagcttcatctcatactgaaattctacatgtacttttatttaatggatagtcttaaagggctagtccccctccccccttgcagctttttcttttttcctttttaaaagactgggatctcattatatggtccaggctggacttgaactcctgggctcaagcaatctttctgcctcggcttcccaagtaggtaggattacaggtacatgccaccatgcccagctgtagctttttcttttagcgtgtattattgtatattatgtttatttttccatatggagttttataccaaaatgtctggatccatcaaaatggtgattgacatttttaattgagattgagtgaaatttacaaattaacttacagaaaaattataattttatgatgctgaataattctatccaagaaaatgtgaagtctttccatttattcaagtttacttgtgtctttcacaagtattgaaattttaattaattattatttttttgtgacggagtctcactctgtcacccaggctggggtgccatggcacaatctgggctcactgcaacctctacctcccaggttcaagcgattctccagggtagtagagatggggtttcaccatgttagctaggctggtctccagctgctgacctctagtgatccaccggcctcagcctcccaaagtgctgggattacaggcgtgagccactgtgcctggcctctcaataaatttaagtatcttatcatgttttttctatttcaaacggatttaccctacaggattataatctctaattaatttgtttctataaaaactattgagatctatatggtaattttctatcctatttattgaattgaattgttttcttgtttgagtagcctttatcattgattctcttaggttttccagataaacaatcatatttgctaatagaagtagtttcaattctttctgagatcttacagctctaattgatgtttctaattgcattagttaatacctccaggaaaatgatgaatagatgtgaaacaaattatatccttatctgtgtcctgatctcttaatgtcttaatgtgaaatgatctcttaatgtcttaatgtgaaatgcatttagtgtttcatcattaagaaagacgatgagttttagtatgaagggtgtgtgggtacgtgtaatatacaatattaataagtgatgtctacctgtattattctttttgatactgtcttgcccagtttaagtatcaatgctttagttgctttcataaaaacaactatgacatttcccataattttcaacgctttggaatagttaatgaagcattgggactatctagtttttgaatatagggagaattcccctttaaaaccgtcttggcttggagattttaatgggatagttataaatttatattttattctttctatgaaacttagtctgtttaaattttccatctctaatggagtcaatgttgacacacagtattttcctaaacaattatacatttcatttgggtttcaattttatatgcatagagtatcagaaagaaatatttatgatttttaaaaaagtactctcattttaactgttattatccattatagcttagattgtatatttgtaatttctctggttgttaatacagtgaagttagctagtgtgttgcctactttattttttctaaaaatctatgattttaattaactaatacatctagcatttatagatctagtatttatctctcttctaactcattactttctccttttttctttattattttctttcttgtgctttcttttggtttatttgattgctttttttagctttttgagatgggaggtcaattaatttattttcattccttcatttttattgatgaaaatgtataagactagatattttttctttgatcatcattttaaatgtatgccatagattctcatacacagtgttttcattattctttgtttagaaatcctatcatttttgtttgtacttcccactttacctgcgagttttaaaacagacttttcttaaaattccagtcggaaggccttgtgtgctttcttagtttatttataattttttgtttcattacattgtgatcgggtaatgttgtttgtaaaatttccactttgaagattaaacaaagcccaaacagtcaaaaagttaaagatttttaagtttatatatgtgtatatgcagggtataaagaataaaaaatgattattattgtattccttacaattaacatgaagaacttctgttcatcaaaagatactattaagagagtgaaaatacaagccacaggatgggatatattatgtgatacatatctccaaaatttttttttactaaggatgtgtaaagaacaccaaaaatcaacataaagaagacaaacaaattaacagaaaaaatggcaaaagtgtagaacaggcactgcacaaaatattccaaatcactaaaaaatatgtgacagcatggtttacatcattaggcatcaggaaattaaacctatacattgccactgtgtgtcaacttgagtggctaaaagggaaaaaaatgccaaattttagtgaatgtggagaaacaaactgtgatacacagctgattggagtgtaaatttatatggccattttgagacttacatgccactttggtagcatataagaaagctggatgtatgcaatgtcctatgatctagtagttccacatacaggtaaatacttagggaaatccacacacgagtataattatcaccaaaaaatatgtgcaagattgttcatacagcacaatatataatattgcagacacaatgagtagaattaataaatgaattttcctacattcatatgatgaaatacgttgtagcaatacaatgactgaaaaactaccatatccaagagcataaataaaacatgggaaaattatgttgagctaaaggagctaaacacaaaagactgcatatcatatgattctacttacataaatttaaaatcagacaaaaaaaggccattggaggtaaggatagtagttacttttgtgggagagggatcaagataactgagaactgtgaagggaaacaaaggggacttgtagggaattatgcattatactaacttttaatttgagtggtcattacataggtatgttcactgtgcaatttcatagagcaatatacttataatttctatacttttacatatgtcatactgtaatgactaaatgtatgtgaaaaattagaaggcagaggacagtgtggcagaaagtacaaggagcttatcctcctgaaatttcatcttccaaagcaaggaatttcctgtttttttgcataaattcttaaaggtcattaaaaataattgtggttccaaactggtgttgtttttgaaattcttttagcttaaccctgaaggaaactttcaggaatgaatatcttttcagttagagaaattattaactaaagattcacctctttcttgttctccttccctttattttatcgtagtctagtaaaataaaatctagtactttaaaaacttgaatagcacatatagtataagctcatcattgtaaaatttatttctgtaaaattatctctctttctggctatctactagtctatccatttatttcatagtgaataaaaagatatttgtaatgattttgacccagtgtccgaactagctaattctggaggttgcaatttgatttaatttaatttatctgccttcatattttcttgcagtacttgatgttttttgctacaagctcttaaaacaattccagtgcttgatttttaaaacaataaaaatgttctaataaatttatgaagtcattgttctgtttttaaatttatgtataactcaccctgttatatattgtaagtgtaacaatatattgtcaatcaaagcatgtagcttattaacactatgattaaaaaccttaaaatcttgggcatgtatatgcaagattttgttcctttttaattttctattgaaaatttccttttgtgaatttacctttggttttgtcaactgacccacattttaagttttcagatttgatatatttgagattttaatagcaaaatcaattttttacacacatcctactttctctatgttcagaccagtttctatctatagttccaggtcactggaggtaggggcaggtttctcttttcagtattcctaatcttacagaaaacagcttttctcccaagcccttttgtcactcctcccttggacaagggaagactgatgtgatgggtcagattcaggagcactatcagcagtaccaccttccaatgtgacacccatgcgtgtaggacatggccatgctcttccctctcacaataccaaagtgataagctgagccagtgcctactatgaaggctgggctctgccacattactccctattcctttcttcttactggagatttgggactctgttttccacacactaggggtcaactggttataagatgcagagttagagagttggagagaccctgcttccttcttgagtctgggcctgtgcttcaacccagcttggcctgagatctctgcattgagggtcatgggaattggccccgtgaattatattcagggtccttgtgtgcgtgtctccttcagagaaaaccctgggaagagacagagcagcagtgtagggtaaaagtggggcatttttgtgtcctctggacaaatactagccccacactgtcagattctcaccagtatatacatttggatgtctctcactccattatagatggtatagatggtgacccgaatgtcacaactcacattgaagcatcacatgaaaccattccctaatcatgctaccatctagaggtcagtacttggtgttttcaggcatggttggtggattccatgcatgaagggataaggtaaatatctgttgatgtgaagatggtcaaggcctcctgaattccagtggttcccccacccttgtctctttcctcaggggctcatgcatcaacctcagataacaggaagccagtattctggtttttaaattgatctcacaaaaacaggttgtcttcatttgggcctcatttaagccctcagaactttgaacttgacatttatatgatccaaattgcaaatacatcccatggctgactcactcactggcttctgttggaattggccacttacggtcctcttcagtaattacttccccatatctaaataatcatcatctttccttgcatacaatgttattttatgtacttcattcacattttacaattgccttcacatagaaaacatatatcactcacttttaagacatgccttccagctatcactaagtcttgtatttcaaattttctccttacttagaggtagcccagatgtcctgcattatcactaccacttaccaatatagatagatgattaattgatagatagatagagataggtatgtaagtaggtagatagatagattagataaatagataattttttccttgtcacaaaatctcatgcaggtcaatgtcaactgtgaatagagtcaaaataggatgagataagcttctctttggtgatcagtttccaaatatgcttccacatgaacaggtggtgtcttctctacagtctctataatccatcctaagctgcctgttctataacagtttgttcactactggaaaatcagttctctgttcccataggctctgttcatgcccacattcatctgccatcccaaaataaaatcactactgagatcacactcatatcacatggtgccatcactcaaattgaaccctagagaaatggtaatgcactaagtattccctaaaacatgctcagaaaatgagaatgaaagacctcacgacaaacttaagatagatgtggtaaaatggtttctggatgggatgcatttttctatttaagttcatctgagcactacaagaaagacttggctaaaagactcagtatcggactgtgttaacaatactgactcacggtgaattataacacaacatataacttgagaaacattcacaacatattgcagcttattttattaacacacaccttggtgtttaatggttatagttgataatatttacctgtgccaggggactaatacattcatggctcctaaatgtaaggttacctatttagtagattttttatccaacaaattaaaaatatgagcatgagtaattttgctaaagagaaaggatctgataacattccagtgtcccagataaaggcatgaatacttcatcatgaaatattcaaaagattcccaagataaacattttaacaatgacaaatgaagcaggttatgatattccctacctgaaagaggaggtctccataattcttgtctgttccttacagagtgatattagggattttctaaaaacatactcccatcagaattctttcaaacctcacttacatgataaacttaaaacttattggtatgtgactttttttaaccagctttattttttagaacagtttcaggtacacaacgaaactgaacaggaagaactctgtatacacactcacagcctccctgactattaatatccgccccccccccagagtagtacatttgttacaaccaatgaatctactttgacacattatcacccaaagtccataatttacattaggttttacatatggcgttgtacattctataggtttggacaaatgtataaagacatgtgtccaccattatagtatcatacagaataatttcactgctctaaaaatatgtgttctgcctatttatcatcccttccttctaacttctggcaaccactgacctttttatagtctccttcgttttgtcttttccagactatcaaatatttaaactaatacagtatgtagtcttttcagattgacttctttcacttagttatatgcattttaagcttccttcatcatgtcttttcatggcctgatagctcatttttggtactgaatagtatttcattgtctggatgtaccacagtttatctattcacgtactgaaacacatctttgttgattccaacttttggcaattatgaataaaactgctataaacatccatgtgcaggtttttgcgtgggcataagttttcatcttattgagtaaataccaaggagtctgactgctagatcatacagtaagaatatgtttaattttgtaagaaactgccaaactgccttacaaggctataccaacaacaatgaatgagagttcccattactccacatccttgtcagcatttggtgttaatgttctggattttggtggttctaataagtatataatgacgtctcattgttgttttaagttttattttcctgatgacatacgatgttgagcagtttttcatatgctcatttgccatctatgtatcttctttggtgaggtgtctgccaaagtctttcgcccattttttaatagagttgtcttttttctgaatgtttagttttaagagttattcattcttagcaaactatcgcaaggacaaaaaaccaaacaccgcatgttcttactcataggtgggaattgaacaatgagaacacatggacacaggaaggggaacatcacacaccccgggcctgttgtggggtgggagcaggggggagggatagcattaggagatatacctaatgttaaatgacaagttaatgggtgcagcataccaacatggcacatgtatacatatgtaactaacctgcacgttgtgcacatgtaccctaaaacttaaagtataatttaaaaaaaagaaaaaaaaagaactacaaaaaaagagttattcatatattttggataacgttactttatcagatgtgtcttttgctaatactttcttccagtctgtggcttatcttttcattctactaaaagtgtctttcacagagcagaaattttaaattttaatgaagtccagcttacccatactttttaaatagaatgtacctttggcattatatctaaaaagtcatcaccaaacccaaggttatctagattttcttcgatgttattttctagtagtttcataattttgcattttacatttaggttggtgattcactttgagttaatttttgtggagggtgtaggttctgtatatagattcattttttacatgtggatgtccagttgtttcaatatcgtttgctgaaaacactaccttactccattgtattgcctttgctcctttgtcaaagctcaattgaatatacttgtattggaactactgctgggctctctattctattccatcgacctaagtgtctgttctcttaccaataccacactgtcctgattactgcagctttatagtaagtcttaaagttgggcagtcttccaacattttttttctcagcagaaacttcagaattaatttgtaaatttccatggaaatccagcaaaatcgccctgttgggattttgattggaattgcactgaatctatagattaaggtgaaaagaattggcatcttgacaatattgtcttcctacccatgaatatggaatctctctacatttatttagttctttgatttctttcatctgagacttgtacatttcctcatataaatcttttacatattttgctagatctatatgtaagcatttcatttttctggatactaatgtaaattatattgtgctcttattttcaaattccacttgttcactgctgatatatatgacagtgattgatttttcttgtatcttgcaacttgctataattgcttagctgtcccagaagtttttctgtcagttcttttaaattttttacagagacagtcacgtcatctgtgaacaaaaagtttttatttttctctcctgttatgcaaaccttttattccttttccttgtcatattacattagctaggacttccagtatgatgttgaaaagcagtgatgagggggaactatttgccttaatcctgatctagtgggaaaacttgtagtttctcaccactcagtataatgttagctgcaggtttttgtgaatgttctttaccaagttgagtaaattcctctctattcctagtttactgagagttttttttttatcataaatgggtgttggacattgttaaatgctttttctttgtctattgatatgattatgtggtttttcttttttagcctgttgatgtgatgaattacattaattgatttttgaacgttgaatcagtctcgcatacctgggatgaatctcacttggtcatgatgtataatgcttttgatacattgtaggatttaatttgaaaaatttcagaatttttgcatctatgtttatgagacatattggtctataattttctgtcatgtctttgtctggctttggtattaggtttatgatggcctcatagaatgaattatcaagtattccctgtgcttttattttctaaaagatactctaaataattggtaaaatttcttcaatgtttggcagaattcactgctgaactcaatttgacctaatgctttagttttagaaggttgttattgattcaatttctaaaatagatatgggcctattcagattgtctatttcttctgtaagttttggcaaattgtatctttcaaggaattggtccattttctctagattatcaaatttgtgggcatggagttgttcatagtatttctttattattcttctaaggtccatggcatctatagcaatgtcccctctttcatttctgattttagtaatttgtttcctctctttttttttcttagcctagctggagtcttgtcagttttattgatcttttcaaagaaccagcttttggcttcatggattttctccactgattttctattttcactttcattgatttctgcattactttttatttttttaatgctcactttggatttaatttactcttctttttctagtttcctacagtgaaagcctatagattttagatctttcttcttttctaatacatgcattcaatactacaaatttcccctgagcactgctttcactgcatcccacaaattttaatacactgtattttcatttaaaatatttttaaatttctttgatgcttcttcattgatacatgtgttattcggaattatgttatttattctccaagtacttgaagattttccagcttttttgttactaatttctaatttaattccatttggtctaagagcatacttgtatgatttctattcttttatatttgttgaggtatgttttatggtccataatggagtctagcttggtgaatgtttcataaaaatttgagaaggtatattctgctaatgttgcattaagtagtctatagatatccaccataccaggtgatttatggtgttatcgacttcaactacatacttattggttttctgcctgctgaatgtgtcagttgtgatacagagatgttgatgtctgttactataatggtggattcatccatttttccttgcaattctatcagttttcacctcacatatgttgatgctctcttgttaggcacatacatgttaatgattgttacgtcctctggaaaaattgacccttcatcatttggaataccccttttattcctgataactttccttgcactgaagtctactctctgaaattaatacagctattcttttcttttgattggtgttagcatggcatataattctccatctatttaatctgtatgtgtcatcatattcattgtgcatttcttgagacaatatatatttgggtcttgttttttgatccactttgtcaatctctgtcttttaattggtgcatttcgaaggctgatgttcacagggattatttatatagttgaattaacagctaccatatttgctactgttttctattcattgcccttgttctttgttctgatttttgtcttccactctttttctacctttcgtggctttgagcattttatatgattttattttctctcctttcctaatatatcagttatacctcttttttgtaactgtttttactggttgccagagagtttgcaatatgtacttacaactaatctaagtccactttcaaataacactatactgcttcatgggtagtctgaataccttgtaataataaaatattctaattatttcctctggtcccttctataatagctatcactcatttcagttatacataagcacacataagcatatgtgcttacacataagcatacataactggatatactgttgctattattattttgaacaaactgttatctgttcgaccaattaataaggaaaataaagttattttaccttcactatttcttctctgatgcttttcccttctttatatgtatcttagtttgcaaacctgagagaaatatgagggaacttcagtgatgccttgaagcatcatagtccaagcgtattgtttattctatgtgaaaaaaagacagtgggagtaaggaaaaggggatactaaaaaaggctaaagagagacctactactatgttcaatttggaggcagaaaagctaggataatatttgtgttggggaccaagggaaatgtgtacattatgtaatttatatcccttaaatctttattcatagagttattcacattcatttggacttcttatctggagatggggtgctgcagagactagtacaaggaatgagtaagcccttagctatgaaatctgcaacaatgggctgtattccctccaacacttacagttttaggagatactgggacaatttaggcagaagcattatggtgtcagtattgacttgtatggctttaatattacttatttaccccatgtctgcagatgatgtggaccagaaaatatggggtactgaaaaaaacaaatcagaaaattaaggttattctagggataagagagttggaaacagtgcaggatagaaaagggaagccaccataagatggtacattgggtcatcccattcagggagatcaagaaaaaatctttcagatatgcacctaatcatgactcctcattgagccaaaacatcctatcctgataggttggactgggtggaaagactgaggagaaaggcaagttaagatgtgaagttacctaaagaggtgggcaaaggggtaaagagaaagaatatattcaactggtaagtcacaccactgaaatctctttattacttcaaggtaagttggaaagaaattgggaggaactattggtgaagactgtggctccaatgtctataaaaaagtagatgaccgtgatggttaattttatgtcaacttagctaggccatagaaacactactttagatgcttctataatgatatttttaaaatgagattacaatagactgaataaagcagattaccttgcataatgtaggtggtgtgtttcatccaatcagatgaagatcttaatagaaaaaagactgatgttacccaaggaagagggaattctgccaggagatagctttcagacacaagctgcaaggtcaacccttgggtctccaggctgctggcctacctgcaattttggacttgacagcctcacaatcatgtatcagttccttaaaatacacacacacacacacacacacacacacacacacacttgttctggttctctggagaaccgtgattaatacaatggccatttactaacagagttctttctctttgctaaatcaaaagcaattggagacactaaggacagattccttgggaatcatattgtttccaatcgagcagctttttgggctgcttgtgtcctggtcaaagcaataaaattgtaggcatagtaacatcctcctcccaatatatgcaagtattcttgcctatctgttttgtatttgtggagggtcttttgtttccctcaagttaagctgtagtgttgcaagtttttgcatgtagttttatctttgtttttcagggtatcctcaaaatgctggactaattgttgtaactcatgaatgggtattgtctgccagcctattttctgcttctgaacagcagctgatatttcaggcttagggctattaacaaaaaaggtggtaatttcaatgctgatgttagcattaattcccaaccctgagcattctttaaagtgatttacaataaagattcattccatctctgtcaatagggttagactgttccccagtaactgtgagagggataaacttcaatataccatttaaaagaccttcttgtatctatagggcatcaaggttagcctaaatcctcatttatggtaacccatttggccttgtcacaccaggttctagcacctccaggttctactaaaaggtgtgttaactaatgtaaatctggaagccatttcagtcagcctcttagtcagtaggaaatcctctcagattttgccaagtagttggcagccaaccgtaacttaggaaactgaaatcacaaagaatggggataaaaataagtaacaggacaggtggttagggagccttttcagccttctattaagaatagagtgaagttacacaaaaaaagattgagaagactacataaaagtaaaattatctatgcctctgaaaactacacatttaggaagcaaaaaccaggaaaagtatttgcaatgtatgtgacagaatggaagatcagtatcttgacatataacttacaatcattaagataattatctttaaaacattgataaatactggttagggtataaaaaaaacaagaattctcacataatgtcagtggcaatataaatgggtattgtgtttcttgcaatgcaccaagagagttaaaagcgatcatgcctttcaaaccagtaaatctatttttggaaatctattataaataatcagagatggtaaaaaatatatgtgtgcaaaagtattcttttcatttaatgaagggataaactttaagaaatctatcaatgtgctttcctcctacacatttccttgactgaatggccctaaaaactagtagtatgaattttctactagaaggcagaaatgggaaattgaaggaaaggtgtcagctctatgtaaatctgaagagtacattttatcaaactcggtctcatggattgcaaatcctaatacacacattgttgtgaatactggagataacaacaacaataattatatgtctacaattgccaggaactaagaacctgttgtgctatttatggtgaccaccatcctccatgaagcacgtgctattataaccttcattttgctcacgtggaaactgtgatacaggaagaagcagtaaattgccaaggttcttggggttcctcaaagagggcactggcgttcagatcaccggtctatcatacacaagattatacgctggtttacagaacgttttcctgcctccagtgcaagaatgaaataaaagacaaactgggtagagtgtaaaacagccagcaaaacttttttcaaaatggtaataatttaatgctcacaataaagtgctaagtggaagggtgagggggaagccacgttgtttcatccagtatcatccaaacattatttaaaaatacaccgtatttacaaagataaacatctggaagaaataaggtacttgttcatgtattcaaaactgtatgttaagaacactcctctacactcttgtcagtttgccgaaaaggcaatggtgagcaaaaacaaagcagaacaatcacagtttctgttcttagaaaggttacatgatcacatttaccaatgagatagggggtcaggggttatttttgctttccatttcagttattaagtattttttcgacgcttctagactgtgtattgttttagaatgggaaatgaataaaaattttcaagcatttttcaaatgatttttaggacacggtaactcacactgaaaatctgagtttaaaaaagatgaactaacgatggaatatgaactcgtgtttaaaatgcacctttgggaatgaaaaactctaaggaaacaacaaatattatcagtggtcattgctgggtgatgggactgagggtaagactggctttctttattacactgtatttgtcctccaaattttctacagtgaggttgagtcacttccataataaaagagtgcgtgcatttatcaatataaaaccaggtccacaaagcccagtacaacctggggacagtgaatgacaagaccattgagagaagtcaaaatacaagttactaaggaacctaggcatcatctcaagaggaatgccaatttcaaaagcaaaaagattttgttcatcagctctgagttttcttaagagacactacccgctccgcttcaccccctaaaaaacaggcagccccagcagcaggacttggcaggtttaagaaccaacctcttctctcaaaaaagattccgcggcatttttttcaagcaagaagggcggggggagaggcgagttgggcgtatccatggagcaatattgccacctgcaggccacaagaatgaagcgccaccaaccgcggaagaaaattcatcctttctactgcttctcggcaaagagccggtagagctaacctgaggaagctacgcagaatgaagatgaggaccagagaatagactagtaccggtcagacaggccccgacgaaccggccgtacaaggcagcctcccatagtcccgccctcggaaccatagcaacccagcaggaagttcctgcgccaccggaaaaagcagctctcggggcggggctggcctaggattgacgggctctgggcctgcgcatcggagtccggggaggtaggcgctagtctcctcagggtcagccgcaggactccttccctgctattgagagttgatggctcaggctcgcgaccgctgaaggccaggctctactgcatggctgcaccagccgcctcacgttcgagacctgtgccaatcccatggacactctcccagccagcccctggacacgcttctcatgtgacgcacgccctgtcctcctctcagccctcacagcacggatcctccccggcgacctcagcgcccccggggctgaccaggccgcggccggctctcctccgtcttgagggggcctcctcctccccacctaagtctcctccgcgcgcggtaatgctctgggcctcaggaaagaccgcgccccttcacgatgtctatttcttgcatcccgcactctcatcatgggcagcaccccatccagtcctaacagctccctctctccaatgtcccagcatccacagccttcagcctcaaggaggcctgtccactgaccccaaccgcgttcctcaccattcaccttccttacccagcttactcaaagctattaactctcgctcctcaaacgcatctcttcattttccttcctccctactcgcctggcaaccccctgccttcccccgcccccctgtaaccaagtagacaaacaatgtgcaccctccacaagtgtaccttctctctcctctccctacaatagcccccacaaggactagcaccaactcttctcatgatattccttgatattcccctgaaaaaacaggagcgattggagagaaactctcaccacttcccaacagcagtgggcctgcacttgtaatctcagctgccccactggaggaagtgacaggatcctacttgaggccgggccttcacctgaatcccatgccctctaccttctcaaggtagagacttttgtagtgattatcccttattcctgaattgtcacattctttctttattctggattcttctgtcatctataaacatgctcttgtttctgacattttatacaaaatgtaataaaacagaaatcagttccttatcccatatttctccaaggtaatgacacatttccctgatgctccaagcagcaaatctgtcttcccttgttctataatcattatcattacaaacctcttcaatgcagcttctacctgctcacctctcaacagaaaaatgcttttgttaaaggcaccgatggccttcatattgcctaacactatgatcacgtcctcatccttttacactatatgtccagatgccttcagtacatctgacacctccctccttctcaaagctactctcctccctccttctttatttccctccctgtcttctctcctctttgccctgccttgtttttcttcttaatcataaaattattttattgatattttaagtggcataaatacaataaatttgagggagaatgaggaagatgttagctaatgaataggtcatgtaggcctccacaaagcttcaggactaatacagacatgaacagacacctgagcttgcccttgtaactccgcgaacacaccacaagcttcaggatagtttgtctctgatgctcaagtagtctcaggagttaccagacaatggtggggagagatagcttagaagtgacgctctctgtacacacatataaaaaccgctgatgcagcaccttgtaggccccttttaaagcgtgatgattcctgtgatggttaatactgagtgtcaacttgactgcattgaaggatgcaaagtattgatcctgggtgtgtctgtgagggtgttgccaaaggagattaacatatgagttagtgggctgggaaaggcaaacccacccttaatctgggtgggcaccatctaatcagcagccagtgcggccagaatgtaaggcaggcagaaaaacgtgaagagactaggctggctcagcctcgcagcctacatctttctctcatactggatgcttcctgccctcgaacatcagactccaagatcttcagctttggacccagactggcttccttgctcctcagcttacagatggcctattgtgggaccttgtgatcgtgtgagttaatactacttaataaactcccatatagatatatatatattacttttgtccctctagagaaccctgactaatacaactccctttgaactccaagtttatttttacagagagcttgtcctgctactgacagtgtattgacttgtatttggtaatcccttccattttgtgtttctttatctgttagtcaatctccttcaaacattccaaataaatttgaattctacaagagaaagtacaaatcctaaagccttccctttatgatctggatttaatatgggaatccttatgtcaacatgaaagataaggaaaacaaaagaatgttctgttccagtcatgggggagtagaaggcatggagacagtgtctcatcccagtctctcttctaagggccttatcttacatgtgacaggtgtgtcagagaagtggaagggagttccaaataaagagatttttgcccaactgaaatttaggactcagaagtttacttttgcaggatgaaatagtgagctccttggttagaataatggctggagttcaggaatttctatttttggagctgatcttggttcctgcagggagctaacattctctgagagggggactgtggaagtggctgattcaagagccaggggtgctaccatgaaacaagcataagccagataggggctaggtgaccctgcagctgaggctgtggtgtggacagccctgcccagatgtgggagggagatgaggcccagattcagaggggtctgctgatgccagcacgggtgggccaaggccgagtcagcctgggagcaccagattccctcacaagccaccgagaacactgcaatcaacataagatgtcaccgaccccttcccattatcaccatgaagactggaaagccatacgcaccattaatcatcttggaaaggagtagggaggtggggcagaaaactgggagactgatcattttcagcaaaacagggtgagcatttatacaaatggaccattcacatgatagcatcagctgacaccagattaaacataactccagtattttctcaccttcttgtccagtacagaggttatacattcataatgaagatcagatcagtcttagcaagtaaatgcatcaaagcccccaatcaggtctgagaagcacgaattaatttgtggtctctgcacaccatctcttccagctccccctctgcccactgtcttatcagtccgtggaagagggcattgagacatccttgcctcctcttctcctttaaccgaggacaattttaacctgttataaattgaccctgacaacagagcacagaaagaggagaggaccagaagagagacacacagagtggagtaacagatgagagttattgctgaggtgagcagggcctcctcaaggcttacagctgccctccacaagtgataccaggctccactgccctttatgaacacagaaattctttctcagggtctatgccctggagcttagagtcagaaaatattcgtagctctgtgtactgctggagaaaatcacagaaccacatgttagaaccactgcattttcatagtcatcattgtctcctgggatctcagtgcccagcagcaggctttcttggtgactcttgtcccccctccagtcccttctgaggggatcccaagatttctcctctctcctggaaccctctaccacacatctatcccctcgcttttagccatagcaaattcccattctcacctgagatccaagcaggtagtgagagggaggaaggcctcagtgctggaaaggggtatggattccgttgtcttggcaacattcttcttcacatcggcactgggtcactcagctcagatccatggttggttacctgggaaactgaagctttatccatctgactccagagaatagcaaacaaaagagtggaaactaagaggattatcatgggaggccacccacagacatggaatcgtgactctcaatagatgtgtttgtcacaagggtccttgcacatgcagagacaatgtacatgtgtttactcagtagcactcattgctccctagaggagcacagtgactatggcaaaaggtacacattggggaggcagaggatgaggtgggaatgtaggcacgtgacagatcatgaaaagcatggaacatataatatcaacgacaacctcttcactgaacgtaaccaagatgctgtctcacagtcccttgcagccatgagtgagcacctcactgtgagggtatgggcaactgcttctccataatgtacaaggcccctcttcaacggttgaatttgggggctacatttagaactcataaaggcaaactattcccaatatggtagaaaaacaagtccccagagctccaaccttccaaatctattaaggaagcccaacatgtggtaggaaactttggattctggcaccatgacattcctcacatccaatatttgctggatgctatctatggagtctcccttaagtcttctgctttccagtggggacctgagcaacagacactagagaaactaaaggaagctattacttctcttctctcatctgctccaaaggcatgacttacaatgagaattttctgccatgccaaatttgcttccaggcgcctctggaccaaatggataggcaaacacctacccatcagcttttgctgtaagtggctcccagcctaagcccaaagatattcaccatgagcgaggcaccacctggcagtgtactgggcacttcttaaaactaaagcccttactggggtagagccaattaccctgttatgccctgcacagtggaagaagctctccttaaaactgaatctgcaacagagactcccttataaaatggtcttcccagaatccagctaaaatcaaccctactggagtgtcacatcccatgagcaaatagccacatgccctgcccataaggctaacttgccaaacctcagaaatggcttcatcccttgctcaaggggagccagagggaggaaggccagcaccctaaaaacaagagaagcaatgctttttttcctctcccaagtatattacctagacaatggagatataattagcaaatccctgtagttattttttatataataacctacgacaggatataaacttaaaaccacatttatcctgagtaggatccactatagttacaggtttggtgattataggaaatgtcaagacattagggaaattgaattttccttgcaggatccatgaacatcttcaaccaaagcagaaatagcctaatcagaagagaggtgagggttcaggtcaccaagtaaggttcagttgatttggggttggaggagcttcaaatcttctaaatctttgcataatatagccctgataatttaaatgaggcagtgcttcataaacttggttgaaataagaatttcaatggagtcatagtttatttaaaaagaaaaatttacctccaaggggcagatgaaagagtcagtgttcctcttctgactgaaggagaaaactcacaaatgtgagtttaatgtacatcttaaaagaaaacagaagctgtgatcggtggttcacatgtataatctcaacactttggaaagcagaggcaggaggatcgctttaactcaggagttcgagacatgttgtctgtcatatgtgggagctaaaaattttgatctaatggagtagaattttggtgaccagaggctgggaacagggggtgggtgggatgaagcgaagttggttaatgggtacatacaattaagtaaaaggaataacttctatttgatagcacagtagggtgactaatggtaacaataaattatcatatatttcaaaatggctagaagggaagatttgaaatgttcccagcacaaataaatgataaatgtttgaggtgatggatatcctaaataccctgatttagtcattgtcctttgtatacatatatcaaagtgtcacatgtaccccataaatatgtacaacaatgtatcaataaaaaagaaataagtaaacaaaatacaatctaatttacattggtgtatgtatacacaatggaatactattcagtcatataaaagaatgaaatcccatcatttgaggcaacatgtatgggcttcagatgtgtgagcctggaggacattaagtgaaataatccagacacagaaagataaataccgaatgttctcattgatatgtggaagcttaaagcttttatttcatagaagtagagagtggaatcgagattagtagagtctgggaagggtgggggatgaacaggtagagtttagctaatggatacaaaattaagactaaataagaggaataatctctagtcgtctatttagcactgtagggtgactatagttaacaataatctattgtatattttcaaatagctataaaagaggattttgaacgtttccaacacaaagaaatgctaaatgtttgaggtggtggatatgctgattatcctgatttgatcattacaagttgtgtatgtgtatcaaaatatcacactgtaccctgtaaatatgtacaattattatgtatgaataggatatatgtacacacacacacacacacacacacacacacatatgtcctaatttactaacagaaagctactagctcatcaaggcccccttcctctccttccctttcctatatgacctaccacactcataagttatctaaaagtaagtaatgagaactgaaaccatgcacacagcttactgcctatatgaacaagagtttactattccactggcttcattaacataacattattactacaataatctcttgcctgcgaagataaaagttgaacataactttattattgattctaggaactgcataaaaggcctatccactgttcagtaaaaagtgccaaatggcattttacaacctcaagactctttgaaccacttgccttaaaatccttgacttgctgtgtccaccaaacctaaaaccagcatatcactattcccacccaatcacatccttcccctacattgaaagacctgctttatgccagatttcaaaatatgaataagtgtcccccaaatccttctacctctgagactctgctaagaccctgttcaggaagtactcttccttacagccttatgcaataaagttagctttgcttatcaacaagttatttggctgatatttggggagtacagcatatgatgagtatagtcaccactgctgtacttcatgtcagagtagactgagcctaaatcctaggtccagtatctatggatatttctgaaccatgcactgtgaccacaggcatattcagggaaatcagttaccagtcaggagatttaaatgtaaaagaacgtaaccaaaaaaaggaaacaggtcttaatgtatttattctacgatgccgctatggtcttgctgttgtggcgccccctggacagggtaggaaggtgggccatagaggggaggtggatcagctcagaaaagggtgagttgtgaaaggagacactatctgaagtatttgagtcctggaggcatatgaaactgcccacagataactgattctggagtttttagtggggacctgggaaggggcagggtggagtaggatggggcggggcactgcagtctaagaggcaagagccggcctcagtgcacatgtttgctgggtgtcttcccgtctgccccttcgcactgcgtggtgaatgccgccaagctgcgcgggtgctggttacattcctaccgtctggactctttctggatgactgagacacagctgataggtccataggtcagtcctcccaggagtttaagtgtcagtgaagtgtcaggtggagttagcaggctttgggcaggtcaggcagtgtggtaggtggcttcacagcgggaagggcctggaggtcattgttcttttaagaggtggctattctgccgccagccttgtcgttgtgggacaggggaggaaagtgggtcatggaggggaggaaggtcagcagaagatgaggtgagttttggaggaggacattatttgaggcatctgagcctttgaggctatgaaaccgcacacagaggatggattccggagtctttagtggggaactgggagagagggtgggacagactggtgcaccacagctgccatgaatggtgacaagttggacataaccaggtccacatgtgcttgtgcctttccacaatatcaggcttttattgatgctaattcagtcgtaaaagccacaagctacacggagttcctaaggaggcagttctccttagcacttatcgttcacctggtagttagagcagcaggcacacaaactcaagccactccacaagtcagtcagtattgcaaaccatacataacagtatgctaaatcaatttataagtgttataagttaaacattccacaacaaagtaacacttttcatcaaagtaaaactttttcattgagaggaaaaagaggacaaagggttaaggaaccagtccagggggggtgaagaagacaaaaagagtcctggtctgggctgagtggtccatgggtcttgcaaggaagtctttgacgtggcagagcctttggcagcaaatgccaagttcttgtcatgattgattgcaagaaggtgtcagttaagacagatgtttgaaactgctgaaggcctaatcttttatagtcacagggtcctctggtaagagctgatcgtggaagagtgcttgtttgtgtccttatctggttggatgcagtcttcatgttttatttgtttattaaacaaaacatgctattattgttggcaaagtgccctatgaaatataaaatggagtatttttctaagatggtgttagttatgtcaagggtgctctatacaatctactccaagattttagtaatcataatgcaaacaatgtttgaggaaggggttacaaaaataaaaaatgacaagtcaccatgggaattaatttcctcttggtaacttgtttacaattttgtgttacaaaggctgaaaacgcagatcttaagtatatggtaagcaaagaggatgtttacaatgaagatgacaacgttctgtaaatgttcacagatatatttagaccaattccagagtccagtttttaatatattgattgggttccagtctgaccatgagccttcataaggggtatggctaaaagtcttcttaatcatttggaagaagatgcatcttctgtgtaagccatctagtttgaatgctattttatttgtgtttagtattgctagtccatgtgttactacctcagtggtgtgttttaattgtgctaattctgtttggaatgtgtcatgaacttgttgaagttccttagagcttccttgtgaaagaggaaaagttcccttatcccctcacagggcatgtgatgtgggtgtggcttgcttcttcagtgcctgctgctcaaacctctagggggagcatgcagacaggcatgttgtggggctctgaccccaaggcagtgtctaggggtgaatgcttacagctcctgaagccccagtgggagtgtgttacaaggtgctcttttagtttagccatctgtaggcagcttgtgttagctcaattagactccctaccttatcgcgaggacagagggctttctgtatgccaggatttcttgccttggtgtactggaagaatcagatcacatgtgggtttggagaatgaatgcaatgttttattgagtggaagttctcagcagatggatgttgcaggaagtcagggaccccaaacggagggactggctgaagccacggcagaagaacgtaaattgtgaagatttcatggatatttattggttccccaaattaatacttttataatttcttatgcctgtctttactgcaatctctgaacataaattgtgaagatttcatggacatttattacttctccaatcaataatcttataatttcctatgcctgtctttactttaatctcttaatcctgtcatctttgtaagctgaagatgtatgtcacctcaggaccctgtgatgattgcgttatctgcacacattgtttgaaaagcacgtgtgtttgaacaatatgaaatctgggcaccttgaaaagaacaggataacagcgattttcagggaacaaggaagataaccataaagtctgactgcctgtgaggccgggcagaacagagtcatatttctcttctttcagaaagtgaataggagaaatatcgctgaattattttctcagcaaggaataaccctggtaaatgcatatctgattgccttctttagagaggctcatcagaaactcaaaagaatgcaaccatttatttgtctcttatctacctatgacctggaagtctcctccctgcttcgagttgtccagcctttgcttcgagttgtcccgccttttccagactgaaccaatgttcatcttacatatgttgattgatgttgcatgtccccctaaaatatataaaaccaaactgtgctctgaccaccttggggacatgtcatcaggacctcctgaggctgtgtcacaggcatgtgtgctcagccttggcaaaataaactttctaaattaactgagacctgtctcagatattcagggttcacagttataataggtcagtgtgttgttcctctctaagcttattatctaattgaagtttcataagtctagagtcattgtggggattttcgtgatgctgatagttgagtaatctagtttaggaactttgtcctgacaggtagagtatatagtgtttgatcattggaatattaattctttttgtataaaataaccatcaataaatagtggtctttctaaggcagttatatgtagattatgtcttatctttctgtgtaattgccattgtgtcttatgccattgagtctcctcctcttaattcaagtagatttaatatacattgccctgaatcctgatgctttggatgtatccaatttaactatagacattttgtcccaattttctgtgaataattttcctgatgtgtataatgttccttatgtcattccaagtctgagttagtaaaatacttagcctaatacactgtgtttgcagcaagtttttcaccataaagtttcttaatgtaaataggttagtttttaggtgtttaacttgtgatcaatattgtaattgaattccttttgggattctgggaggtcgtgtgtatgagtcatcattgactatatctcgttaattgcctatgagatagatgaaagtatagatgtggtagttgtttgcaggagttacgtttatgttcataggtctgtattaacttcctaaatttttgcttcttgtattcctgaaatgactgagtttgaaataattccaattgctgcaaatagttgtggtggttttcttagatgatatttatctagtgaaggtaaatttggtaaaatgaactgcttgtcatatccttgtccctcaaattacataacttgtggtttgatgtatgtgactttaagttcttttttgaaaaatattttgactctcctaggtgctggtttgtaaattaatcttaatgggttaattaggataggttcaactaaatttggttttcataatttagatagagggtttgttattcctttggtacactgtggtgtccagtggtgtgttcctaagcaatgtgtcagtccagcatcctctgcgaattatgcatggcccaaggttctggggtttaacatagcattttgcaaaagagatatctctagctacaaatacaggtaagtgggagtctagtttggctatattttgataaataggatgttggactgaccatataactttattctatgatccatcaaatggctgaatcatgaagaaaaagtaatttgacatacctgagtctatttttgtgactttatccatatttattttggttcctagtgtttcccaccagttaattgacttaaattgtgtattgtttctatctacatcttcaaaattaaagtttacatcatcctgaattaccagtggatacattgtaaaaataacttgattttgtatatacttagttttcctggtaaatttgtctaatatagttatgtctcttggttcatttcctgtaaagaatgtgccaataacctctgctgttttgtaggtcagtgtgaatggtccaagtactaagagtgagttagataatagcagattgtatatatctggtctgtgagtagatgtgaatattaattgttcccattttgtttgttgtaatttatcaaaaataactgtttctaatgtccagtttctaatgtccatgggtttctagaagatgtcgacatccagcaatcagtaaatttagtagggattttctatgtcattgtatctattgtgatgactgggaactagtgtggtttttgtggttgtgtccaacataagcctgctttggtttctgtcacattccaccatagagtggactttccagttatgataacatatctgtctacattctctataaactctttgcttattgtgtaaaggtagttttgatatattgtagccaagtttgccatttaatgttgtaaatttagcatgtgttttattatgccaaagtctgaattgtgctgtgtctgttggtttgttttgttttgtaaagcctgttgatcttggaacgtgtaaccatgttagtaagcaacttatagtgtagaatgggcaaggataaggttttcatccgtgggataatgaaatgtagctttaatatatgtaaagttaaggttaaagcatattaatgttggttgtccctcaaaatgtatatcttgttgggtagtgttgattctattttttatctttataagttccttatttgtggagggcaagtataagtatacttgtattcaagacaagctttatctacatacattgttttagtgtgtgtttcaaaggtagtgtgtgtaaagtgatagtcagcattagttaagattactgggtgtcatctatgttttcaatataattctgccagtgagaattttttagccttattaaagaattgttactccagctctcttttgtctaataaaaagaaaaaagaagaattgtgagactgtcaaataattttggctttttgcgtaataatcataagatgaacagggtgggtgaaggcaaaatttccaaaaaacagcaagttaggaaagttaattagatgatagttatagtatgtcttatcctcttctgttgttattatatcataatctaatggatatcctagtggcattgacactttttcctgtgggggtctgatatatgggtgtaagatgaagtggttggttttgtagctatatttagtcttgtgtcatcccttgaatctacttcataatcataatgttcatttccttcaagtccagattggtaccagaattcataccaactattaacaaatgacttgtaggagtgtcgtatcatatccaagcatgtcatgtgagatcttccaacatatggttctatctgtggtactatgattggggattggtatgatatagcgcttcttatgtaatgaactgttttgattggcatgtctgtttctattagcatttctctacctattatgtgagccatccatggtttgagatgttattgaatgcttcattgtagctgcataagttggggtgtcacatttagtcatgtcatttatgcattcttctaaagtatgtttaggaatatgcgcaaagattctataaagatacaatgattggaagtgtgtgtaaaagctaaaagctcttcaggcattgctttgggtcaaatgaatatgaacaaaatagtctaattgaagctctaagtattcttttatcagtcccttgactttctaacaattgttcaaaaatgatatattttcatgaagtatatattgcggaatttgttctggtaatcgtgtgattttaggtgctgtatgagttggcactgttggatatgtatgtgtttgaggctcagaaattttaatggttactttaggaataaacagtagtagcagtagtagtagtagtagtagtagtagtagtagtagtagtatctgttatttcccttctatatctcctaacatattttaagctatttgcatcaatcttatgtttgctattaattatcagatgtataggcattaaatatagcactgaaaacaaactaagatataataatctatgtcatcctaatatttctctaagtagtatagtcaaagattgcttccagtagtagtattgctgctgggttaggttggggtagaacaaagtaaggtagttctatggggtctgtcctctcttattaagcagtttagcaatgcaacttatataataggttagtagccaagcaagacttatgcagtcattggggtgtacactttcaactaaaccttcaatagctcctaatgctgcagttagttcataaacgtaaggagcaggaaggtggcagtggcgcctagattctacaaagtctggtctgaaattccagtccatgcctgcctgtatgggccagtctgcttgagctaattcctgaaggaaatctggtgaaggggctctgaaagctataggtggcgaacatgaggctgaagcttaaaaggaaggagggcaaggcgggatatacatggatgatggagatcctggagaggctaagtccatatgctggggatgcattatagctgtcagtctgcaaattattaatcaaataatatacttaacaagcagatagtgaaatttgtaatttttctgctgtgaggggtgtgtgtgcttgtgttagtttgatttatctggttacagtctccctggtggcaatataagtaataacaaggcagtaaagttactatgatggctaatatgaggtgaatgagaaagttgataagaccagttgagaagctacacaaatttgtagccatcttgatgtcctaagtgagtaaagtatttaattattccagtgatagctaggagtgatgttgaagttaaaaatattagattagtggtaagcaaaattggattgaagtacaccttcacttattctcgtggataatattaatgcaatgactagaataaagcattgtaaagagagattggagattttgtctaattctaactctcctgtttcctgtagtctaacatgtgtttccgtgtccatgggccacagtgtcctgttgggagatagtgttgttatttagtctagtgctcaccttgtaaggtataatatttgtatcatattcttccttatcttttgtgacagttaagtttgggtgattaagataagaatggaggctgctcttatagtctttctctttgatttaagttgaaacatgccaggttaagagcttgttgaaatgtactcatttggtctaaggctttccattctctttttattagccattaaatctttctatatatcccactgctgtaagattgcaaggtaggtaaaaatttaattatatatcccattggtccaccaatgcttgtgtggtccttgatgtaaaatgagttgcttgatcactttcaatcattttgggggctccatagtgagccgcccaaatttctaaggctgagatattatatttggcaaatgagtggctagctgctgttgctatgccaatccctttatatatatccaccattgtaactgcatatttttgttagtaggagcgatttaatggttctataaaatttacctgtaagcagaaattaaagatgtcagatttgtatgtatattggtttagtatatttatatttgtccagattagttttacattattcacaattacctgtagcctttttaatttgatgtcatgtcaccttttgatttctgacagccacttgtacagtgagtgtgtgcctaaatgtcctttctgcttacgtaattgtaggagcatttgtggaatgtaagctgcttctggtgtctgtttaatttttttttttcaggtggagtctcggtctgttgcccaggctggcgtgcagtggcacgatctcagctcactgcaacctctgcctcccgggttcaagcgattctcgtctcagcctcctgagtagctaggattacaggcaagtgccaccacgcctggctaatttttttgtgtgttcttagtagagacagggtttcaccatgttggtcaagctgatctcgaactcctgacctcgtgatccacctgcctcgtcctcacaaaatgctgggattataggcttgagccaccacactcagctgtctgtttaattttcaagtcatacccctgtttcattatagttattggggggtacttgtactatctcacattcattgtctgattatctcctgagttgtagaagtggtaatgaatgtctccatgggttgtctggatttctgtgtagttttaatttgggtatgttttgagtgtcaatgtttatattccctgttaatgcatctacttggttattaaattttgtggtctctgaattgtctttttggtgtgctgattcatgcatcacaaatatctaaattcagtttgataattcatatagttccttccagtaagatgtggactgtatgtctttaccattaattgtaaaattattttgttttcatttatgtgactataggactatgccatttgcaactgcccatgagtctgtaaaaatataaattttctttcaattttctgatagtgtctgactggtaggacagctgcactcagttctgcatgttgtgtggggagagatttacctgcttccttcaggattgtttatttctggggtctgagtgctgttgctgtccgttgggtctggctttgggtcatggaggctgatccctctgtaaaccaggtgttggacagtacatcagactacactgggccccatttacctacatttgcatggattgtccctgtcctcagaataaattccagcaagtttatttcagtcttgtggatctccttggtgaggaggcctggttgacccttaaagcctgtatctcgaccctggatgtaccatttccatgcaatcaatttggatacctatttattcttcaggactcaattttatccagtgaaggagaggtatatggtatctaatggtaatggtgttgttaccagtcagaggctcaatgtttgtgagggcttcatgtgtaagccatatatatttttcaaatgggctatatttgttgtttagagcatgggaattttgttgtccaaaatccgaccagtaggaaggatttagaatctggtttctttgtccataatgacaatgttccatattcattgctcattaaaattttcaacctaagttgtgtatctggagatggctaatgttgtgtttggaatgtggtaatgtagtctttgagtgtttcgagtgcttgtgtttgttcttgtcccgatgtgaagtcaggatttcctagtcatcttacatattggttttaggatgatgtttaaatgaagtatatgttgtctccagtatccaaatacatctgcaagtctttgtgcttcctgtgtattctttggtgccttaaggctttttattttatctaccactgtggtggggatttttctcccttttaatgaccactgtactcctaaaaatttgcaattggtgtttggacctgtgtttttatctctattaatagtccatcccagtgatcttaagtgtgttattgagattttttttcttgtttaagtgtttcatggtcattgtttaccattataatgtcacctatatatgatattgttagtgatgtgtattttgactggtctatgtgtgatgataaaatggagtgagctattactggacaacttaaatatccccgtggtaatattttatattggaattgtttgccttcccaggcaaaagcggtatattcctgactttcttggtctattggtatggcaaagaacatgtccaacatgtctatagttacacagtatttgtcattacagttagtgatcttattaatgacttcttcatctggtaatactcctggcattttaggtatgactttatttaaatttctatagttaatagttattctatagctcccatttgggttcaggacaggccatgctagaccattaaagttatttgaaatgccaattgtaataagttcttccttaagaagttctagaatctttgcttttatttctttgtgtcctccctttaatggatattgtttactgtacgcaacctggtatggtgtagacagtcttatgcgcttcattttaatttgtgctatgtaagagaattttagttcctaagtttcttaatagaccaccatgggttaaaaagtttcacaactcgatccattcctataatgttttctagttcaggtgaatagtaaatagtgcaatgtataagtttagagttacagaaccatatagaagcagagatagggaagcctcaagttagttttcctccaagtccttctatgaggatgtttgtgttaaggtttgttgcattatatctaagacagcttgtgattcagtttctaaataaatgtataagtatgtgtatatttgtcaatttgtatagttaattgtatgtatggtctattatccccaggattgagtgttacagttcatacccagggggtttctcatttgttgagaaacattttcttgcaacatttttctgttgttgttgctgtttttgacattgtgagtttggccctggacctcgggaggtccattattttggaccttattttggtatctggctggtggccttagatggccctgttgccagtgttggaaataagaacttggagtcacaaagaaaacgagcactcgaacaaaggatttctcagcaaggtaaatttacttctgcagaagggtgctgcttgcacctctggccactacgagagcacactgaacaaaggagggaaggggtttttatccctaacacactccctacctctgtgtcactcccccatgggctggggtcagaccgcacaatctaagctgacttgattggctatttgtgaatattttcccaaataagggaagggaagggggatgtgagttacaggctgggactggtggttttggcgggaagaatagttgcagttgcagagtgggtaaccaagggaacaggtgtgaattattgattagaactggctggaaggttgtttactgtaactaggggcaaggaggcacaaagaatgaggaagttaggctttgaaaatagagaacaaagaacaaagaagttgaccaagctgactttttgaagaggaacttactgtacctaacaccagtttggtccttgtggccttagttgccagttattttgcctgggttgccaacttgtctgccttggtttatttttccaaggtcctccaggtctgttttgaataaacattcagacttatgtattaaatgtaaagaattttggtgccttcctgagattatctcttggtgtttttttaaatcaggtttgccataaatgttaccttgtgagttcctgataattcggcagaaagttgaaaattttctagtatactttctatggttcttcatgctgagagagaattaatgtaggagacttttaggttaggtggtgctcctgtaagtgctctttcaatttcatttgtagctggaatttcagatggaatggtatattgattatatccatcatttataattcctaagatagataattttcttgtatccttttgtgcctgtgttagatcagtccatttaagtccatcaccaaattttgttgggtttaaatattgggtagatagatatcaggctaatgtaatccagtcccagatggataggacacatgttggataatttgttgttagttctaataatttctgatttagtgatgggttttctgctaatgttttgatctgatgcatttctgtgcctgatagtgctgtggtgtttgcttcattattgcataatggaaggagtcagtctgcatctgtggtctgtctttggcaaaaatttattcttagtttttgtaattctgctgtggtgtattctctgtcctcactgatgtcctgaggtctgccatttccactgttataatctataactctttttgtagttattataggtcttgctgcatatatcccacccacctctgggatcattatattctcctaggtccactagttgggggtccttaggacccaggggttcctccttaaaagttacatctgaaagggatttacttttccttaaaattctgtgagctagctctttggctttctgaggacccctgtatatctgtgagctactttgcattaaaagtgcaggaatttcttcaaaagcctagctcttgggagcattgaaatgtaagctcagagttacattttcgaatcttgggaagaggcttgtcagacacattgtttgctttctgctgagataaggaatgtatcactctgccagagtatgactttttacagattattaaataaagttgtgtatgtctcaaaaaaagtgcagggatttcttctctgggggctctggtaattaaaggcttaacattttgtcaggtccctcaagtctgaccatacatccttgggggatcctacagggactctttctgacttccaactctgttgggtaccaaggactctcaacactaagtactgtatttgggcgatgagccctctggcatgcctgcttaattttcttaactagaacccacattatgccatattagtagctactttatatagtttcttaataatatttcaatttcccaccttaaccgactgtctgagtggaggttatgtaataattgactttcttttggccaaattaaaaatttgttttgccagtcagcatcccataaattgagacctgcttgatgtgagcattcctggctcccccagcttcctagcttggcatcaaccaagaccttgtcagccgttggatcttcacaacttgagcaagttgtcttatcacccaaggttttcctcaagtagccaggctttcaaggtgaggcgagattatgtctgctgtcagagagcatggcagtttgttttgtcaaatggcgtgatttccaatggaagttttagtgggggctttggccttaaaattgagtacaccaattatgccaagtaagccaactgtgccagttgtgcccagtaagctgactatgccagcttatcatgagaagtactggattagaaataaccaggtccatgcatgcttgtgtctttcaacaatatcaggtttttattgatgctatccaatcacaaaagccatgaactacatggagttcccaaggagacgcttccccttagttcttcctgttcacttagtagtcagagccacaggcacacaagcttaagccactccacaagtcagtcagtattgcaaaccatacataacagtatgccaaatcaatatgcaagtgttataggttaaacactccacaacaaacaaagtaaaatttaccatcaagaagaaaaagagataagataaaggattaaggaatctgtctaggtggaatgaagaagacaaaaggaatcctggtctgggccagccagtcaattggtcttgcaaggaagagtgtttgtggtggcagagcctttggcagcagatgccaagttcttatcataaatgactgcaagaaggtatcagtgaagatggctgttttgagctgctgaaggtgtaaacttttatagtcacagagtcctctggtgagaactgatttgagtgtgaaatgtgagtgggtgaggaagattagcatacaggccttaaccaagaagaaatggacaagaatcttctcagcctgataggcctgtggttgtgcgtactttaacatttgatattttctattagctgaaatttctttttgtaatagtgttgttgaactagtatagatacactgataaagatcttccatgctgataaaaaatgatcatggcatctcatgaaggaaagactaatctaagaggattatgttctggctttgcctagatgaatgatcttgtgtttcccagattttgcccatgactccctcctcatgcttattgataacagattgcacacatctatcccaacagaggttaaaatgacttctaaaacccttgagggtgtctctgtcttagagtaacctctccatgggaagagtaactttatgaagaataagtatatgttttgtgggatctatggggtgttgcttttctggccagaaacctctgcggctggtggcatctttgcccaagttcttgtcttgtgtccaggaagaaggaggtaggcagacaagtggagagtgagcaagatgaaaaagagctttattgagtgttagaacagctcagaggagacctgcagtgtgtagctcctctctgtacgtagttcctcctatcatacagtgttcagctctcagcaaagaggaggcctggagtgagtggctcctctctgcagacaggtcgtcctgatgagtgttcacctctcagcatagagggtggctcctttctgcagcttgtcatcctgttgtctgcagctctcagcagagagaaggctctgaagagggtagctcccctctgcaactggtcgtcctgaagtctgctgctctggcagaatctggggtttgtatgggcttcagggagaaagtgcatgctgattggtccatgggcagccgtgggcaggcctggtaaaaagcaccatgagttccccctccagtccgcaggaatggcagcctggatcccaggcttcaggcctttccgggcctaaaggtggcgtttcaccagggaccccccttctgcccagaagcctgtcggactcctaccaccattcatggctcccagactgtttgtgccaagggctgcctgcaggccagtgctgaacttccttccgccccccgactccatttccctcctgtgttcattggtgcccaaagcctgggggactcaggcaaaaggtgtctggcaggtcagcactaccctgagcgtgcatccacccagccgggctgtgacagtgcccaggcggccccaaccttgctccacaatcagagcgggcactgggagtagggagaggccaggcagtgggaacaggcacttctgagcgggggaacaggggccgtccagggctcccaagagcacagatatgcctaggtccaaagccgagctcggcaggctgcagctgcacctgggcagctcccgtcccaccaacttggaagaggcgaggctcctgcttgtccctggctcccacttgtccttggctcccaccagtttcatgcagtgtgcagccccggccatgcctctgagatcggagtggacgctgacagtgcggagaaaccaggcagtgggagcaggcacttccaaacctgccggggaggcacttccaaacctgccggggggcgcctttccttggccccctagagcccagagacacccagatctggagccacagtagagcagctgcagccatacagggggcagggctcctgcctgctctgtggaacaggaggccgggccgtgctgcagccagtatgatggcagctgctgctccagatgggccacccctgcccctgccatcatatggaatcatgttggagaaatgtctttagacttacttaggattagaaatatctatatattctgtatacttatattattgacatgtattaataacaaaactttttatttgcgcacacacgcgtgcgggcacacatacatacaacgctagtcccaggagccaagtgagagagaagatcagggtgcagctgagatttaaggtgctgggaaggaaaagaaggaatgtctgtggtggagagagaggaggcctatatgttcatcatgcattatgccataactagtaacaggaggaaagaaaacattaagaaaggatctcaaacatttcctgaaagttggctggaaaagtgaagagtatagtatgcagttttgtgcagtccctcactataaagaatttccctttttccttgagacttattttctgtgtttgaaaatacctttctcatcagtgttctatattagcaaatccaagaaaacaatgtttaatattagtcataaaattgtgcactatctcttagttattgcatcaaaaacataagcatcttttaataaaacgtatagcgtgccaagtcaacacacttataacacctaggataaggcctgtttacatggcgtttttaactcctttctaaatgagacaactcagactctgagatcgtgtcttactaaagagcacttgactggttgggatagattggtacttcattccctaaatagtatttttcccctctctgtttttgtaagtaaaaagtgaatggttttgcttaaaatgcttaatgatcaaatgtgtctgcactgtaaggtagctcagtactggctcaggaaaagacacagttcaatgaagagactccagaaaagagctcagtgaatgatggccattgtcctttggttgatattttttgcagtaaatttggtaaaagctggacaattcaagatactgacctataagtagttatatcactatgactttaagaggctttttaaaagttgtttaaatactttcataattagaaaaatcaaaagtatcataagattatcatgaaacagagattatttcctcaaaatatagtatttccaaactaaacatttacataatttggtccatggattattttagcaattcactgttaaggagtttccaaaacatgactgacaacaatgcccattaatttcttcccaccctacttccttattctcacttcaagacagtaaattcactgttagtcacaattaattttgctattatttctggtactttgtttcacataggattcatttatgaaatgttacttatagggcttttggacctaaatatgactttttaaaatttttaatttttgtgggtacatagtaggtgcatatatttggggggtatatagaatattttgatacaggcatacaatatgtaataatcacatcaggataaatggggtatccatcaccttaagcatttatcctttgtgttacaaacaatctggttatactcttttagttatttttaaaatgccattacattattattgactatagtcaccctgttgtaatgtcaaatactagatcctttttattctttctaacttattttatttaacataatgacctccagctccatctatgttactgcaaatgacaggatttcatttatttttatggctgaatagtattccattgtgtatatataccatattttctttatccatttgtccattgatggacacttagtttgactccatatcttggccattgtgaatactgctgcaataaacatcgacatgcaggtatctcttctatatactgatttccttccttttggatatatacccagtattcagaatgctggatcatatggtagatctattttttctattttgagtaacctccatactgttttccgtagtggaaatttgcatgcccaccagcagtgtaccagcattccccttagtctgtatcctctctagcatctgctattttgtgtctttttgataatagccattttaactgggatgagatgatatctcactgtggttttaatatgcatttctctgaagattgtgatggcagtggcagcccatctggagtggctgctgtgaaaacactggctgcaacagggaaggctcagcaatggctgtgcactccctggagctggttggtgctgggaatgggcaggagccttgctccctcaggcccctctggactttgggcactgatgagagtgggagggaggccaggggtgctgagggtggcttggtgcaggcctgcagcaccaaacagtcccctctgcacaaacagcctgggaagcattgatggcatgttgatggcagtaggaggcagacaggttcctgggcagaaaggggcaggtctgttgtgaagtcccactttcaagccatgggtggcctgaatgaagcctgcgggccaagctgcctgttctgggtggagtctgtggcctggaatgaaaacttatggagctttttctgggcctgcccatgactgcccatgaaccagtctgcacatgcttcctcccttctaagcccataaaaaccccagactcagccagactcatacagacatcaggactacctgcctgcggaaaggagctacccactatagaactcctctccactgagagctggacactcattgggacaacctgtgtgcagataggagctaccactccagatcttctctctggtgagggctgcacttgtcaggtctacctacctgcagaaaggagctacccactatgggtctcctctcttctgacagctggacacttgttgggatgacctgcctgtagaaaggagctgcccaccctgggtctccttgctgctagctagacacttgttggacttgttgggacaacctgcctgcggataggagctacccactccaggtctcctctctgctgagggctgcactcatcaggactacctgcctgtggaaagaagctacccactatgggtctcccctccactgaaagctggaaactcgttgggatgacctgcctgtagaaaggagctgcccaccctgggtctccttgctgctagctagactagacacttgttgggacaacctgcctgcggataagagctacccactccaggtctcctctctgctgagggttgcactcatcaggactacctgcctgtggaaagaagctacccactatgggtctcctctccactgaaagctggaaactcgtcaggatgacctgcttgcagaaaggagctacctactttgggtctcctgaaagctgctctgtggctcaataaaactcctctctgccttgctcaccctctagttgtctgtgtaccttgttattcctggacatgggacaagaactcaggatccacccactgaatggcaggactgaaaaagttgtaacacaaacagggctaaaacacgcccttccacttgccacattgtgggtgacaagaatgagggaagagttgtggctcttcggggagcccagacctaggtgctttccaagccagggctatgacaccctctttggggcttgcagtttctggtatctccaaacttccaggtggcactgtgttcccctcatgcagacacaggtgcctgcagcagaagccacttctggtgcatctgatccagttgcaggcttgcatggagctagcacctgtgccagtgactggcactgcctcccctgctgcagcagctggcatgcctggctgtgaacagtggccggaccctgtgttcacttgctcatgcacccctcactgctctatgcctgtcttgcccttggcaggcctggaatctggactggtagtgtgagctgaacacagcctcccaggccgaatgggcagagtgagccccagcagacccaagcaaaactcggacaaaagcgccattggccacagaggtttccatctggaaatgtgacacctgatgatcctgtgacattttgtaatattgagcattttttcatattcctgttggctgttggtgtgtcttttttttgagaaatttctattcagatctttgccatttttaattggattacttggttttgttgctattgagttgtttgagtttcttatatattctggttattaattatttgtcaggtggatagtttgcaaatattttctccaattctgtaggttgccttttcactctgttgactgtttcctttgctgtgcagaaggtttttagcttgatataatcccatttgtctatttgtgctttggttttgcttttaaggtcttaagcaaaaaatgtttgcccagaccaatgtcttgaagcattttcccagtgttttcttctagtattttcttagtttcaagtcttatattaaattctttaatccaacttgagttggcttttttatatggtaagagataggggtctagtttcatttttctgcactggaatatctagtgttccctgcaccacttattgaagaaactttcctttccccaccgaatgtttttgctgctttcatgaaaaatcacttggctttaaatatgtggatgtaaatccagattctctattctgttccactggtctgtgtgtggcatggtgttatgcaagcaccatgatgttttggttactctggctttgtggaatattttgaagtcaggtagtgtgatgtttccagcttttttctttttgcccaggatggctttggctatttggggtcttctttggttccatatgaattttaggatgtttttttcatttctgtgaagaatgtaattgacatttcaataaaaattgccttgaactgtagatcacttttggtagtttggtcactgataatcttttcatttttaaggaactgacctggaagccaatcttgaggaactgtctcaaatgatgaatggaggtaaacatggatatggtactgatataaagggggagtttgtgtcaaatatagagcctgcttgagtgccaggagcaggcacattgttcattaagatgcaaaattatgtgaatttgttttctacaagattatatataataatatactgataatgacactgctacttcgataacagagttcaattacaaatggtctttgaaaggtaattctgatcccaaatgcctggttacctgactaatacactgtcatatacagaaacaaattggatcaaagccatattgagtcataaaatatgcaaccattttcttacctttgagtataacagttaacaattttcagattcttttcttatttctacttttaacaaacacagaatgcatttgtaataccagtttgtgtgaaatatgctgagccctgaaggagattgtagtactagctctgctataatttgtgagattctggatgaatcccataaattatacacctatctttgtgctttttgaaaataatgaattcaaaccagatgttttaaaatcagtttcgatactgatttctgtattctctggttcttttggatagaatacaaagatattctgttttccatggttggtttatcataaaatatcagcttgagtcaaggtatactatctgaattgagatttgattgctcctaagaaaatgagtgtgcactctgcttaatgtttgtttttgtttatggagacctgaatgactgttcttggatcttatcaacttttgaattctctggctcttaaagaataattgctctttaagttcttcccccagtgaagcttcaaatgaccaaataatcaaatggcaagagatagtctagtttctagtttctgtcactgatgagttagggagagtgcatggaggtcagtaaggcccaaggtaggtgtaagatatctgtactaagcactctccctactctactctctgtctttatgagctactatttctaattagactatagacgtgtatatgatataatcacctctatatatcatatgttacatattacaagtttctgccttgagacatccattgataggatctgagattcaaagaccataacatagtaattcacgagtagtcaacataagtatgtgttgcatgttttccaaattgctgactgttcattacagaagattctgcatttaaaggaagcatttgatgtttagggaaaaaattaccttgcattagtcttctaaatgtttttgctctacactgctgaaccattccatcagatgacttaaattaaaagatagttttcagaccacttcaagcagccatctgaatatggctaaaatgcactcttaggaagatcatagcctttaaatgtgtatgttattaaaacagataaattacatgaacatccaatataaaaataatgatacagtagcaacagaacaaacctaaggggaaaggaaagaggtacttaataaaagacatgtatgaattattagtaaaaagaaaagtaatccaactagtaaattttaaaaagattactctttttagaaatagctatgaggtggaggcaagatggccaaataggaacagctccagtctagagctcccagcgtgagtgatgcagaagacagggatttctgcatttccaactgaggtaccgggatcatctcactggggattgtcagacagtgggtgcaggacagcgggtgcagtgcacccagcttgagccaaagcagggtgaggcatcgcctcaactgggaagcgcaaggggccagggaattccctttcctagtcaaagaaaggggtgacagacggcacctggaaaatcgggtcactcccaccctaatactgcgcttttccaatggtcgtagcaaacggcacaccaggagattatatcctgcacatggctcggagggtcctatgcccacggagcctcactcattgccagcacagcagtctgagatcaaaccacaaggcagcagtgaggctgggggaggggcaccaaccatttccgaagcttgagtaggtaaacaaagcggccaggaaggtcaaactgggtggagcccaccacagctcaaggaggcctgcctgcctctgtagactccacctctgggggcagggcatagccaaacaaaaggcagcagaatcctctgcaaacttaaatgtccctatctgacagctttgaagagagtagtggttctcccaacatgcactaggagatctgagaacggacagactgcctcctcaagtggatccctgacccccgagtagccctactgggaggcaccccccagtaggggcagactgacacctcacacggccgggtactcttctgagacaaagctcccacaggaacaatcaggcagctacatttgctgctcaccggtattcactgttctgcagcctctgctgctgatacccaggcaaacggggcctggagtggacctccagcaaactccaacagacctgcagctgagggtcctgactgttagaaggaaaactaacaaacagaaaggacatccacaccaaaaccccatctgtacgtcaccatcatcaaagaccaaaggtagataaaaccacaaagatggcgagaaaaacagagcagaaaaactggaaactctaaaaatctgagtgcctctcctcctccaaaggaacgcagctcctcaccagcaacagaacaaagctggacggagaatgactttgatgagttgagagaagaaggcttcagatgatcaaactactctgagctaaaggaggaagttcgaacccatggcaaagaagttaaaaaccttgaaaaaaaattagacgaatggctaactagaataaccaatgcagagaagtccgtaaagcagctgatggagctgaaaaccaaggctcaagaactacgtgacgaatgcacaaacctcagtagacgattcgatcaactggaagaaagggtatcagtgatggaagatcaaatgaatgaaatgaagcaagaagagaagtttagagaaaaaagaataaaaagaaacgacaaagcctccaagaaatatgggactatgtgaaaagaccaaatctatgtctgattggtgtacctgaaagtgatggggagaaaggaaccaagatggaaaacactctgcaggatattatccaggagaacttccgcaatctagcaaggcaggccaacattcaaattcaggaaatacagagaacgccacaaagatactccttgagaagagcaactccaagacacataattgtcagattcaccaaagttgaaatgcaggaaaaaaatgttaagggcagccagagagaaaggtcgggttacacacaaagggaagcccatcagactaacagctgctctctcggcagaaactctacaagccagaagagagtgggggccaatatacaacattcttaaagaaaagaattttcaacccagaatttcatatccagccaaactaagcttcataagtgaaggagaaataaaatcctttacagacaagcaaatgctgagagattttatcaccaccaggcctgccctaaaagagctcctaaaggaagcattaaacatggaaaggaacaaccagtaccagccactgcaaaaacatgccaaattataaaaaccatcgaggctaggaagaaactgcatcaactaaagagcaaaataaccagctaatatcataatgacaggatcaaattcacacataacaatataaaccttaaatgtaaatggactaaatgctccaattaaaacacacagactggcaaattggataaggagtcaagacccatcagtgtgctgtattcaggaaacccatctcacatgcagaaacacacataggctcaaaataaagggatggaggaagatctaccaagcaaatggaaaactgaaaaaggcagggctttcaatcctagtctctgataaaacacattttaaaccaacaaagatcaaaagagacaaagaaggccattacataatggtaaagggatcaattcaacaagaagagctagctatcctaaatatatatgcacacaatacaggagcacccagattcataaagcaagtacttagagacctacaaagagacttagactcccacataataataatgggagactttaacaccccactgtcaacattagacagatcaatgagacagaaagttaacaaggatatccacgaattgaactcagctctgcatcaagcagacctaatagacatctacagaactctccaccccaaatcaatagaatatacattcttctcagcaccacaccacacttattccaaaattgaccacacagttggaagtaaagcactcctcagcaaatgtaaaagaacagaaattataacaaactgtctctcagaacacagtgcaatcaaactagaactcaggattaagaaactcactcaaaactgctcaactacatggaaactgaacaacctgctcctgaatgactactgggtacataacgaaatgaaggcagaaataaagatgttctttgaaaccaatgagaacaaagacacaacatcccagcatctctgggacacattcaaagcagtgtatagagggaaatttatagcactaaatgcccacaagagaaagcaggaaagatccaagattgacaccctaacatcacaattaaaagaactagagaagcaagagcaaacacattcaaaagctagcagaaggcaagaaataatgtaagatcagagcagaactgaaggaaatagagacacacaaaacccttcaaaaatcaatgaatccaggagctgcttttttggaaagatcaacaaaattgatagaccactagcaagactaatagaaaagagagaagaatcaaatagatgcaataaaaaatgataaaggggatatcaccaccgatcccacagaaatacaaactacgatgaaagaatactatatacacatctatgcaaataaactagaaaatctagaagaaatggataaattcctggacacatacaccctcccaagacgaaaccaggaagaagttgaatctctgaatagaccaataacaggctctgaaattgtggcaataattaacggcttaccaaccaaaaaaagtccaggaccagatggattcacagctgaattcttccagaggtacaaagaggagctggtaccattccttctgaaactattccaatcaatagaaaaagagggaatcttctctaactcattttttgaggccagcatcaacctgataccaaagcctggcagagacacaacaaaaaaaagagaattttagaccaatatccctgatgaacattgatgcaaaaattctcaataaaatactggcaaaccgaatccagcagcacatcaaaaagcttatccacaatgatcaagtgggcttcatccctgggatgcaagggtggttcaacatacacaaatcaataaatgtaatccagcatataaacagaaccaaacacaaaaaccatatgattatctcaatagatgcagaaaaggcctttgacaaaattcaacagcccttcatgctaaaaactctcaataaattaggtattgatgggacgtatcttaaaataataagagctatctatgacaaacccacagccaatatcatactgaatgggcaaaaactggaagcattccctttgaaaattggcaaaagacagggatgccctctctcaccactcctattcaacatagtgttggaagttctggccagggcaatcaggcaggagaaagaaataaaaggtattcaattaggaaaagaggaagtcaaattgtccctgtttgcagatgatatgattgtatatctagaaaaccccatcatctcagcccaaaatctccttaaactgataagcaactttagcaaagtctcaggatagaaaatcaatgtgcaaaaatcacaagcattcctatacaccaataacagacaaacagagagccaaatcatgagtgaactcccattcacaattgcttcaaagagaatcaaatacctaggaatccaacttacaagggacgtgaagaacctcttcaaggagaactacaaaccactgctcaatgaagtaaaagaggatataaacaaatggaagaacattccatgctcatgggtaggaagaatcaatatcatgaaaatggccatactgtcaaaggtaatttatagattcaatgccatccccatcaagctaccaatgactttcttcacagaataggaaaaaagtactttaaagttcacgtggaactgaaaaagagcccacattgccaagtcaatcctaagccaaaagaacaaagctggaggcatcacgctacctgacttcaaactatagtacaaagctacagtaaccaaaacagcatggtactggtaccaaaacagagatatagatcaagggaacagaacagagccctcagaaataatgccgcgtatctacaactatctgatctttgacaaacctgacaaaaacaagaaatggggaaaggattccctgtttaataaatggtactgggaaaactggctagccatatgtagaaagctgaaactggatcccttccttacaccttgtacaaaaattaattcaagatggattaaagacttacatgttagatctgaaaccataaaaaccctagaagaaaacctaggcaataccattcaggccataggcatgtgcaaggagttcatgtctaaaacaccaaaagcaatggcaacaaaagccaaaattgacaaatgggatctaattaaactaaagagcttctgcacagcaaaagaaactatcatcagagtgaacaggcaccctacagaatgggagaaaatttttgcaatctactcatctgacaaagggctaatatccagaatctacaatgaactccatcaaatttacaagaaaaaaacaaacaaccccatcaaaaagtgggcaaaggatatgaacagacacttctcaaaagaagacatttatgcaaccaaaacacacatgaaaaaatgctcatcatcactggccatcagagaaatgcaaatcaaaaccacaatgagataccatctcacaccagttagaatggctatcattaaaaagtcaggaaacaacaggtgctggagaggatgtggagaaataggaacacttttacactgttggtgagactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattctggcactattcacaatagcaaagacttggaaccaacccaaatgtccatcgatgatagactggattaagaaaatgtagcacatatccaccatggaatactatgcagccataaaaaggatgagttcatgtcctttgtagggacatggatgaagctggaaaccatcattctcagcaaactcttgcaaggacaaaaagccaaacaccacatgttctcactcataggtgggaattgaacaattggaacacatggacccaggtaggggtccatcacacaccagggccttttgtggggtgggggcaggggggagggatagcattaggagatatacctaatgctaaatgacgagttaatgggtgcagcacaccgacatggcacatgtatacatatgtaactaacctgcacgttgtgcacatgtaccctaaaacttaaagtataataataataataaacaaataaatagataaataaaaataaaaaataaaagacctattacaatttctggcaaaaaaaaatagctatgagtagagtattaagtcatttacataatcttgaaaaaagtggaaaaaactcaacatggaatatgaacaagatgctgacagatattgaatatatggtataatccaaagtgaatacattcttgaactctaatattttcaaaatatggatgaaatggttgatatgctaggaaagcatatagtctttaacatatcccagtaatacctgaatatctaagcatcacaagtaccatggaagaacttctgaaatttgtcagttgttcttcaaaaatactgacttttagaaacaaatacttggcttttgcaggtatcgtactctctctatccatttccctctccctctctccattcattcattcatttaatttgtttatttttctttttttttctttttcttttcgttttttttttggccgtactgtgagatatggtatatatctccacattttttttatgttgaaaatgatggtagtaaccatatgatgtattatattaactggaatgctttcaagtgtgaaaagaagcactcctcgtaattgcaacaggactataggtgaaaactcgggacaaatggttatcctactttaacaactccaaaagggttatactagcccagagaaatatttttgcacttctgcaaaatagagaaaagaagaaatgcagtgctgacctttctgtgttttttcacttatataattccaaatgtaacattaaccagttttggttttctgttccaaaatggccaaataggaacagctccagtttgcagctcccagcgagattgaaccagaagatgggtgatttctgcatttccaactgaggtacctggttcatctcattgggactggttgaacagtgggtgcagctcatggagggccagctgaagtagggcggggtgtcgcctcacccaggaagcacaaggggtcgggggatttccctttcatagccaaggaaagccatgacatactgtacctggaaaaacgggatactcctgcccagatactgcacttttcccatggtcttagcaaccggcagaccaggagattctctcctgtgcctggctcagtgagtcccacgcccatggagccttgctcactgctagtgcagcagtctgaggtgaaactgtgaggctgcagcctggctgggggagggacgtctgccattgctgaggcttgagtaggtaaacaaagtggccaggaagctcaaactgggcagagccgaccgcagctcagcaaggcctactgcctctatagactccacctctgtgggcagggcatagctgaacaaaaggcagtagaaacttctgcagagttaaatgtccctgacagctctgaagagagcagtggttctcccagcatggcatttgagctctgagaacacacagactgcctcctcaagtgggcccctgacctctgtgtagcctaactgggagacacctcccagtagggactgacagacacctcatgcagttgggtgcccctctgggatgaagcttccagaggaaggatcaggcagcaatatttgctgttcttcagcctctgctggtgatacccagacaaacagcatctgtagcggacctccagcaaactccaacagacctgtagctgagggacctgtctgttggaaggaaaactaacaaacagaaaggaatagcatcaacatcaacaaaaaggacatctacaccaaaaccccatctgtaggtcaccaacatcaaagaccaaaggtagataaaaccacaaagacggggagaaaccagagcagaaaagctgaatgttctaaaaaccagagtgcctcttctcctccaaaggatcgcagctccttgctagcaatggaacaaagctggacggagaataactttgatgagttgacagaagtaggcttcagaaggtcggtactaacaaacttctccgagctaaaggagcatgttctaacccattgcaaggaagctaaaaaccttgaaaaaaggttagacgaatggctagctagacatcttctactgtgctacagaaaaatataactagaatacactaaagccatttggaacagtttgtgaggactcggaaaaaacaactgatatcagaatcttcacatggaaaaatgacacatctgcaaatatgtctgacctttctttaaaaattatgaggtggagaaggagaagcaccaaacctctttttccatctacgtaattccatcagcctgaaagtcaccacatctcattcagaagctcctgcagctgcctgattgcagcctgatatccctcttactagagataatatatgagttacaactctgagctctgttcatatcatcaccctccaaaagataattctgctgcaaagggccctactcagaatctgcactgcttagggaggggaaggggattataatcagcaattatttctcccttttacagaaattttaaaatgttttctgatccaaaaggactgaaaagctagggttcaaataaaaagtaagactaaatgtaggggatcctatttgccacaaaatatgtgagaagtccctaggctatggagctggatgaaagaattagggcctaggtagaagaaaggggaaagcaaccagggcaacttgctaaagcgaaatgacttgggtcctacctacactgtctccttataggctatggcatgaaatacccatgggattccatcctgcctcttacacactgaccttgagatggtgggaaagttacactcatttggtctgtttccctaattttaaagtagaaattagaatatttacactaaatgattactatgaagaataaatgagataacatttgaagtaggaactactttgcagatggatttggtttattccatttttctttttttaaaagttttaattgacatataattgtacatatttatggggtacaccaagcttgtttaacttgtggcctgagggccacatgcaccccaggacagctctgaatgcagcccaacacaaattcgtaaactttcttaaaacattatgagattttttttgtgatttttttttagctcatcagctattgttagtgttcatatattttatgtgtggcccaagacaattctccttcctccttctagctatttgaaactatatgttattgttaactatagttatcctacagtggtataggacactagaacttattcctcttatctagctgttattttatatcctttaacaaatctctcctatctttcccttccctctacccttcacatcctttagttttctttatttttttcatttaaattttcagatgagatcagtaaggtggtaagaccgtagacttcatttacattttgaaaaatttttatgtcatttactttcacagttagatctctaataggtcatactgcttttgaattttgagtaggaatatgaggttaccttttttaaatgaatttgagttcataaactttaaataaatcatttaatagcaatgtagctggtgtaggacatggcatctattctaataaccgaagtctggcaaagtctgccctaagtcatgatatgtgctgagaacttcttgttctgtgtgatgtcaagggaaataaaatattctggctgccaagtgatcagtcagtttctaagcagcattgcagtggctaacagggccacaaggatcactactgcaattgtcaggttggcttgtcacacttccatagattcggccagtaagaaaataattgagcccagatggatccaaacagtatattacagacacagcaaaagcaagatcagcattgtgtcagctccctggttccctggttccacagtttgacactgaatcaaaggtgctcggtgacagcatagatagtaggttgctcttccagtgtcaaaggtgctcggtgacagcatagatagtaggttgctcttccagtgaggagcccacagctataccgtaaggtggtaagcagttttatatctcacagctgtaccttaaaatggggcaaggaggaatgtcctgtgcttatgattaatgactttgtgtcagcttctagcaaaatagggaggcaggtggaaaagttccttgtggcagctcctcactaggttgcttattcccccttgccccaagaggaaccactgcatgtttgacaagattctagtcagagtacagttaatccttgctgatgtggcctgtgtgacatgcaaggtcaccagggcaccaaggcaaagccactcttctacatctggcacaaagtgaaaagctgtatgtatggtacctgcaaacataatatctacaataatgactcctaaatggaggagatgcttttactgccaagatcattacaacagcatgttcaggaaatatctgggatactagaaatgaaaagaccaaagatgtacagtgtttgccatgggggtcatatcacactatggtggagcagacagacatataaacagaaaaggaatttaagtacaaagtagaaaaaaatggatgagactcagcaggaaaattaaaactccgtgagcagggtatccaagaatctggatatagaatagttatataagatatagaatagttatatcactcccccaaatttcctccttccttttttattcaaccactccaccaagctccagtccctggagaccaccaatctgttctctatccctttagctttgccttttgcagaatgttatataaatcaagttataaaatgcataaccttttgggtcttttttctctttgcataatacatttcagattcacctatgctattgcacatatcagtatttcattccttttattgctgagtcgtatttccttgtatggatataatacagtatgtttatccattcatcagttgaaatatttgaaactgttttcagttttgggctactatgaataaggccatcataaatgtccatctgcaggtcctgtgtgaacataacttttcatttgtcttgcatgaatatctaggagtggaattgctggttcatatagtaagtatatgtttaacttcataagaaattgccaaactgttttccaaagtgggtgtatcattttgcatccctaccagcaatgtgagagttccagttgcactgtatcctaactagcaattaatattgtcagagttctttttaaatttttcttctcattttagcttttagaataggtaattgtgattttgatttgcatttccttcatgatttatgatatcaatatcttttcctgtgcttacttgccatccatatatcttctttggtgaagtgttcaaatctttggttcatttcaattgggttgtttattattattgatatttgagtattctttatatactctgaaagcaagtagtttatcagatatgtgttttgcacatattttcttcttctatgtggcttgtcttgtttttctcttaattttgtctttttaatgttgaactccaaagattttaatgttgaagttcaatgtatcagtatttttcatatagatggtgtttttggtgtcttatgtaacaaatctttgcctaactttattaattttctagggttgtcataacaaattaccataaaattggtggcttaaagcaacagaaatgtattctctatacttccagacaccaaaggtccaaaatcaaggtgttagcaaggttggttccttttggaggctctgagggagaatatgttccatttctctctcctagcttctggtggaaattcttgctccaatttctgcctccattttcagatagtgttttgtgtttctctgtgttctattcttttattataagagcaccactcattggatttagggcccatcttaatctagcgtgacctcatcttaacataactaattacttctacaaagatcctatttccaaataaggtcacattctgaggattcaggtgaacacgaatttatactaactaaaggccacaagtatcttatatattttgttctagaagttttgttacttttggtgacaactttcactccatgttccaaattaggttcactgttgtatgtggtatggattataagtaaaggttcatttcttgttcttgtgaaatccaataccccaaaagtatatgttgaaaagattgtctttccccattgcctttacacctttgttgaaaatcatttgattaaatgagtctattgctagactctagtcactgatttttttttgtcaatactacattctttttttttttttttttttaagagatgggagtcctactctgtcacccaggctggagtgcagtggcatgatcatagctcattgcagcctcgaattcctgggctcaagcgatactcctgcttcagtttcctaagtagctgggactacatgcaggcaccaccacgcctggcgaattgcacatcctcttgattactgtaggattatagttgagtcttaaaatcaggtagagtgaattcttcatcattggccttcttcagaattgtttttggtattttagttcctttgcctttcaatacaattttgagaatcagctttattgaagtaggttgaagacagaatggtctaagcacagtgaagcagtttttgctttgaagggaaacaaataaatgtgttagtagctgcaggaggacatgtgagaaggggatgaggtttttcctccttagcttggggaatgatccaatatagagggggccattgatggttcaggagccggagtgatcattgcaggagcaaagctcctgtgaaggtgggaggcatgggatcctgagctgaggtgagggcactggcttcagttaggagcattgtatgcagaagggcggcagagaatgccagatcaggcatgggtagactaggtttgggaagctctgagaattcccagcagatttcttctgtcctctcaatgaattattagaggaagccattcaaatggagaagagattctagcattatcggggagtattgtagtggtggaggtaggatgagagtgaaagtgaaaagctatgctcttatggtcatggatttaaggtaaaataatttagaaggttttctattttattattattatactttaagttttagggtacatgtgcacaatgtgcaggtttgttacatatgtatacgtgtgccatgttggtgtgctgcacccattaactcgtcatttagcattaggtgtatctcctaatgctatccctcccccctccccccaccccacaacagtccccggagtgtgatgttccccttcctgtgtccttgtgttctcgttgtttaattcccacctgtgagtgagaacatgcggtgtttggttttttgtccttgtgacagtttgctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccgcaataaacatgcgtgtgcatgtgtctttatagcagtatgatttatagtcctttgggtgtatacccagtaatgggatggctgggtcaaatggtatttctagttctagatctttgaggaattgccacactgacttccacaatggttgagctagtttccagtcccatcaacagtgtgaaagtgttcctatttctccacatcctctccagcacctgttgtttcctgactttttaatgattgccattctaaatggtgtgagatggtatctcattgtggttttgatttgcatttctctgatggccagtgatgaagagcattttttcatgtgtgttttggctgcataaatgtcttcttttgagaagtgtctgttcatatccttcgcccacttttttatgggaatttagaaggttttaaggttttctcatcactgctcagttgctcagatacaggcatcattatatggtcattatattagtaggaggaagaggagtgctagcacacaaaatagatatgataatacctcctgaagaccactaaaagcatttctatttgtttgttaaggctgccatcaaaaactaccaccgactgggtggcttaaacaacagaaatgtattttctcacaattctagaggcgaaaagtctgagatcaaggtgttgacagaattcgtttcttctaaggcctctctccttgccttgtagatggctgtcttctccctgtgtcttaatcatagttttccccacatacatgtctgtgtcccaatttcttcttgtacggacaccaggcatattgcattatgacccactctaattaccccatttgacttaattacctcttcaaagacagtcacattctgaggtactaggggttaagacttcaaatgtgaattttgagcatacacaactcatccaaacaacagtattattttattattagttttactcctattgttactataatttatttcatttttaaaattaccctgcaaggtaggaggtagtcactaaagctcaggagctatatctcttgctgaacctcaccaggaatgaaagtactagtcaaacagacaaaactcatgtgttttgtagtatatgtagctgagatagaaagtcaacctagttgttatcatgaattcatttgttatcattaaattataaatattcagcatcggtaaagaaaataatgaaaaataatcagtctcatcaaatctacaagtataatggaagtcatactgaatttagagtccaatgagatgcgcttggtcaggcaactgcaggaaaatgctgccaagtgtcctcacccctgcatcctcgaggcaggtgattaataggggaatcctgagaccactgcaaacattctcacattcacacctgttcaaacctacacatctgtaacgatttatgaagggaacaaaaaaatggctctacttcccaagttttaggagtggggatatcattagcaacacctgagaaattgtggcacaccactgcttgtacagggtccttggacatttaggtgtcaagatttggtcaccagaaacactagagaatgtatcagaatttgatctatgtcctttgtgacagaagctttctaaatgatgaggttcacgtgtatttgctgttctatggatccccttgaataagtatattgcactggacatttttaagaggcacatattattttcaagttttttgacttggggaataaaccatctgtaaaatttacacagaaattcaatggactacaaacagccaagctgaagaagaacacaggtgaagaacttacagtacgaaaatcaacactcattataaaatacgagtaattaatacagtgatgtattgacactaggatagtaaaaataaaccagtggaacagaatagactcaagaaatagttccagtcatagaaaatcacctgacttactacaaaggagccattgcaactaagggaagaaagaatgattcttgatcactggataccacatggaaattaaatcttgggcctttggtcatatcggccacaaaaatcaattcctgatggatcttttgaccaaaattggtcaaaatatgaaagttaaaacaagctagaagtagcataggaaaatattcttatgacttcagaataggcatagtttaaaaaaaaacaggacatgatgagcactaagaataaaagatcgacaatatataattgattaaaattaagatcatctgttcatctccaaggcaccactgagaagatgaaaaaactagccattgaatgggaatatgttagttctaatacatatatccaaaaaaggactcatggagaatatctaaggaacttccacaaatgaccaagaaaaaggcagacaatctagtaagaataggcaaaaggcttggaaagccatttcacaaaaaaacaataaccaagtagaaaataaatatgaatatgtgctcaataagtgttcaaaatctttagtcatcagggaaatacaattaaaaccacaataagatactactacatgctcactataaaggttaaattgagagagagggagagggagaaaaatccactgttgacagggatctgaagcaactgcagctggagggcactcccacactgcttctggaacatagtttgtttcaaccacttttgccatctgttttcttgtaacacttaaagctaagcatggtactggtaccaaaacagagatatagaccaatggaacagagcagagccctcagaaataataccacacatctacaaccatctgatctttgacaaacctgacaaaaactagaaatggggaaaggattccctattgaataaatggtgccgggaaaacgggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagcctaaattgacaaatgcgatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaacttacaagaaaaaaataaacaatgccatcaacaagtgggcaaaggatatgaacagacacttctcaaaagaagacatttatgcagccaatagacacatgaaaaaatgctcatcatcactggccatcagagaaatgcaaatcaaaaccacaatgagataccatctcacacctgttagaatggcgataatgaaaaagtcaggaaacaacaggtgctggagaggatgtggagaaataggaacacttttacactgttggtgggactgtaaactagttcagccattgtggaagacagtgtggcaattcctcaaagatctagaactagaaataccatttgatccagccgtcccattactgggtatgtacgcaaaggattataaatcatgctgctataaaacatgcacacgtatgtttattgcgacactattcacaatagcaaagacttggaaccaagccaaatgtccaacaatgatagactggattaagaaaatgtggcacatatccaccatggaatactatgcagccataaaaaaggatgagttcatgtcctttgtagggacatggatgaagttggaaaccatcattctcagcaaactgtcacaaggacaaaaaaccaaacaccacatgttctcactcataggtgggaattgaacaatgaaaacacatggacataggaaggggaacatcacacaccggggcctgttgtgaggtgggggaaggggggagggatagcattaggagatatacctaatgtaaatgacgagttaatgggtgcagcacaccaacatggcacacgtatacatacgtaactaacctgcacattgtgcacatataccctagaacttaaagtaaaagaaaaaagagaaaaaaaaagaacaaaaaaagctaagcatttaaagctgcatcccctattacagcaatgccactccttagcttatacagcccaagtcttcacttaatgtagttggataggttcttggaaatttcgactttatgcaaaaatgtacagtaggtccccaaataacgtcatttccttcaacatcattttgttatagcatttataagaaaaaaatggttttgttatatgttgcttcacttacagtcacagtttccaagaacctgttcatgacattaagttactgtacctaacgggtatgtgcccataggtttacatgaaacatgtacaggaatattaatagcattgattaataacatcaaaaatgggaaataatccaaatgtccatcaactttagaatgagtaataaaattgttgagtattcaagcaatgaattattagacagaaatgaaaaatcttaaactacttctatgtgtaacaggatagatgaatttcacaaacataagaaagaatgaaagaagccaggcatgaaaagcttacatatagtgctattccattcacagaatgttacaaaaaaacaagcaaaactattcttttaagttggattaatgattgggaaaggattgctatggaggcttctttggtgatgtaaatggagcacaggggatatttaagattgtgaaactcctctgtatgatactgtaatggtagatacattatgcatttattaaaactcatagaactgtacaacacaaatagtgaactctaatgtaaattatggaccttggtcaataataatgtcaatgttggtttattaattgtagtaaatgtactaaattaataataggggaaattgaggggaagggcttaagggaactatctgtgcttcctatgcaatttttctgtaaacctaaaacttctctaaaaatacagtctattaatttttaaaaagtcaaaatagtgataatttttgctggattaatgattgggaaaggattatgatgggagcttcggtggtgctggtaatgctgtatattatgttgtgaatattggtgatgtgcatggttcattgtgtaaaattcatccagttgtattactaaaatttaggggtgtatgtaatgaaaaaaaacataccctccaaaaaaagaagtcccagaaaaaccaaactgaactttagaagctaaaggccttgttagaacactcctgtagtttgagaaatctataaacacaacagctgattgctaaaattagttctgagataaatagcctgaaataaattgtaaaaagaagccatttttcttccaaacttgattcttcagaatatgatacccatttctgagtccatggttgtaatgactctactatattgcttagtaagggtgtatctgtccaaaacatgttcattgtacagatgttacttgaggcttttactgtgggacaggaaatacaggcactttcctgaccccagactttgaaggcaaaatatacagtcgtatgtgatttgtcatcttcatctcagaaacctgtgaactttgtggagcttcttgctgaccatggaaagcctatcacctgtctttggggattgccctgtggtgccaggtctttaaagcacaccatcagctaccaagtaaattattttctcccccagactgatgatgtgtttggaagaagggaaggatatcctaccatcctctgtcactttggggaaagctgcaaggttgattaagtgaactagtggccatattatatggagctccaactatgtagcaggcacttccctttgtgcccccacatcctgttcccattatcttctcaaccttgcagtgtaactcttatgatgccttttgaaaatagttatgaaagttaagacacagattagatttttaccaagttaaagaacactattcacactcttccatgtcatgtgttacattgcaatgttaaacattaatttttcatttgtttctcagaatcaatattcacaccatgatatagaacattaccagcaccacagaagctcccatcataatcctttcccaaccattaacccagcacaattttccactatttttacttttaaaaaattaatggagctaggtccacattgcaatattttgatgaataacaatatgaaaatagctgtcattgctcttagatggtaagtgcaatttggctgttcattgatggaatcagctatcatcttgagcttgtgtttcatactagatgctgggtacctagaaaccttaatcctcattattgttgttaatctaaaccttaattgagcacatgtgttccaggcactgagttatgtgctaccccagtaaaagtccagaccatttcaggcacatagataatatttttctcactttacatagaagaagctgagggaatgagacattgacttgccacaaattgaatgcaaattctaggttttccaggttctgtctatatgatgttgtgttggtggcttacccttttatgaacttcaatttcctcatctataaattgggattagttacaatatgcactgcctctgtttttggtgggttcaatagaatacactgcctcagtgtctgggtggagtagatgaaatcgcatatgaggtacttagcccagttgtttgcaaagagtaaatgctcaacacatcataataattttggtcaatactattactactattactactatagaaaattccagactgtgatctatcactggagaaagacatagtgcaatctgtggaagatgtttataaggactaatttgccaactcttgtcacaacgattttctttaagaaggatcttgaaagtataccactagtcaatcccccttttcttggggtatgtcattaaaagctaaataagataataaaaaattgcaagtttaaagcaggctgaaggccttcttacagaagtggtggagatgctaggcaatgatggcttcttgtcttatcccttattttccatagctgctgccaaaaatcatgttctctggacaagatctttatatttcatattatatatattttttaagacactgagatgatgcccaagatgagcattacttgtttttttggtgttgtgtaagtttttttgaatgcagatacatgcagttatttacaagataacactggaataaagaaagtaaagttcctgaagttgaaaacacttggtttaccattatctccattcccccacaataaccctggcagtacataaaagaatccatgttttataggactgaggctcagagatgttaagtgacttgtcctcaatcacagtgtggtctccctgaatccaaaagcatccctggctgctctgacacatggtcatgacccaagccagccttttctcgtatctgcagcttatcagaagattttaggacagaagataattctataaagtgaccatatactgatcttagctgccatctcactctttgtagggacacagcttcttcctgtgggccactcatttacatagtttgcttcagattctatgatttggggagctatggcctggaacatgattatgtgaggtttaagaactctgtatatgtactgggtcagtcctgtggttgctctagggtcttattctagggaaccacactgctctgccattgtaaaatttctactctagaatccaggaattcctcaaaactttttctttggggcacaaacaaccagaggtaacatcctaatctctgccattttcagtgtgtgtgacctgtggcaagacatttactcactctgaaacaattttcttatctgtcatgtgaggtaactgcctttcagattggctctgaagatttcatggaataacacatgtaaattatctgacacagtagagggagagtgccagagaccactagttctcttacttcatcctcttactgcccattctattccttggcttcagttaccagcccattatactttagaccaaatatctgcttaaatcacccctgcctcaagtttccttcatctagctactcagcttctgaaaacagaggaaagatttctgtgaacccagagggaaatttcttggtcacagtttcagtcgggaaggaaatttccttattatatggattcccacaatttaccatatcttttggttagatcctaagaacatttcatggttgcccaccataagcctggccctgtaacctctctttttttcccatgtttcctgctgatcaacaggtcagtctcagctccttccctccacagcaacctctaggtcctccatgcttcagcccctcctctgccctttgcacgaggaggacaatttccatttctccctaaggttcctgtccgaattcttacttccaaaaaacagctctgtaactaagagccctcttcaggatgctcactccttcatagtccttaggaaagtgtacacaattgttttatgctctcaaaatatttaaaaattatcttccctccattctagtaggcctcagcatcagatgtataggcaacgggccagaggatctgcagaatgttctctaggatgagaagttgctgaaagtgttaagagcagatggtctgagaaccaaggagagctagatcagtgagaaaaggaggaaggaaccaggggaatcaactgggaataataaagttggggactgcctgcagtgcactctacgtgggctttagtatcagatagacttgggttagagtcctggtcctcccatactagctgtctgaccctgagaaagttaactaacttctctgggtctctgtattctagtctgtgatgatagaccataaagtgcataaaattatgcaacatttttcttcggaaatttttaaatttttcttattttcgtttttaattctggcaaaatacacataacaaaatttaccatcttaaccattttaaagtgtacggttcagtagtgttacatacatttacattgttgtacgaccaatttccagaactctttttatcctgcataacaaacccattaaacctatactcatcaaaaaacaacttcccattgcttcctcctcccaggctctgagagccgctactctaccttctgtccctatgaatttgtaaaaatcataaaattctactattacttattgttttgttctatttgggatgctataacaaaataccataaactgggtggtttataaacaacggaaatgtatttctcacagttctggatgctggaaagttgaagatttggtgtttgatgagggctcactggttcacagatgacacctcactgtgtcctcacatggtagaaggggaaaatgtgctccctgagtcttactttatgaaggcacacctttttggggaggtgattaggtcacaagggcaaagccctcatgcatgagatttcataatctaatcacctccccaaagtccccatatgctaatgctatcaccctggggattaggatttcaacatataaatttggagagagagacagaaacattcagaccacagcacttatatccaatctgagccttattttttttaaatgttattatataattttgattttgctgtacttaattttaattagatttttgttgttctttgggagtttgttgtttttattgtttctttttgccaagtgacatttttatttaagtaaagttatcaagtcacaggtagaaagcagagaaagtagtaactctgaaggtagtacttaatgattgaagttgggaattaattaaatgattaattcaacattcagtggtatgtagtaagatttgggaagtgtcctgaatgatcagcttccaaagaccagggtccttgtcctagaggggctcacagctctgtggcagagacagacccattcatctaatctacatgaatttattaagtgcctatgacatgccagacaatgttctgaatatttaagatacagcagttcacaaaacagacaaagattcctgtcctacaaaagcttatattacctcaggggtggtgatggttgaaatataatttatggttcatttgatacagtcatgtgcccggtctctgccaatagtgttcgggaataaggataccctcttaactccctctcatgtactataatttaattctccaccctgcggatgccaagcagaagcattgggattgaagaggcatgatctgatgtggtcctgatgcagtaccacatggcacccatgatgtagcatggcaacacagccttgtaattgtgagagatagatccatgatgtcagtgcgtactgggggatttataactgtggagggccatggtgactgtgatctcttatccccatcccagccaatcaccagcctcaccacaagctatcctgaaagtctcttgattcatttaaattgtttttcagagtggtgagtaaagttttatcatgctctgctattaagcactacagatttcactttatagtttctcagtattttattctaagaaatttcccactagttctcttgattttctgggcaaataatcacaccgatacacaaaaatcatgtcttttcaaacagcgagcacctctgtttacttcacatagatttcaacgtgagatttatattgccagatttttttcttactgttttctagatgtcttctgctcaatatttgcttttaacgttgtttcattttaagagaaaagcaatttaacaaaatatgctggcaaaaattgtatataaagtatgattttaatgttgtaaactatgcatatatatgcccactcccacacatacagaaaaatgactggacagagatatgccaaaatgttaatagtgtttgtctctaggttatttccttttgtgtgcctttgaaattgtatgccaccctaaatagtctacctttataacaaaaaatggccataaaatgacatttaagattatctaagcaaaattttatatgatacaataaataccatttggcagaaaattaaatattcatgtattatctcttagactgcatactgcatatatcaataatgtaaaaatatatttctaattatctttaaataagccaaaattagatcttgctccattcggagaatttatagtgaaactccatgatattctattgagtaaagttaatgggtgcagcacaccaacatggcacatgtatacatatgtaacaaacctgcacgttgtgcacatgtaccctaaaacttaaaatgtaataaaaaaactttgtcatttcacttgtgaattcttaagcagctttagcctccctttgttgaacagggaacctggccactaattcatatctacctgtgagtcccatcctaatatttgagtttcagctgtaatactgcttttctcacaattgtcaatattttcctgtaattgtgtgaaagaaagttcacaggctgagatgctaaatcagtgctttgtcatttatcggctacattaactttggtccagttactctcctttgctgatcctcagtttcctcagataaagagacctaataattcttattcgaatttctcatgatcaacacatggcgaatggaaataataatcattgtcattactcttgatagtcatttaatagaatggaatgatcagattgcagtggaattgcattcatatttagtggggtaatatatcagttattattaacagacaactgaacatgggatgactgggaatttgaagcacttaaaaagtaaacttgaggcttgatgaggtggcatggagtaagctacaaaggactccagctcccacttcctgcctcatctccatgctgggtgtggaccaggtggcacctgctcaatcaagaatgactgctagggttctagtctaggcaactaggtagacggtggtgaccacatccaagcaactccttcctcagtgattcagcaacttgcactgttctgtgattgactatctcctctcctctccagtttcattcaaccaggaaatcagcaataataaaggctgtaattccctcagcacccactctgtgccagacacttcattcattccagatataaacattaattgagggccatctgtgtgccaggcagtgtcctaggagctggggattctccagtgcactaagcggtcttaaatgcctgcctttgttcagtttatattcttgtgggggagacagtcataaataataaatttaaataagtcaacaaataatgcagtgcagtagttggcaattcatgctacaggaaaagtagagcaggaaagggggattgggagtgctggttggtgggtatgccattttaaatgggatgttcatggtccgcctcattgagaagatgacatgtgagcagatacttgaagactgtgaagagtaagggaacagtggtatctagaggaacaatgctgtaggcaccgagtacagctcatgcacacaaagaggagtttgtatgctctgagttccaagcacactgagctgggcacttgtgtcacaattttaaaatcacagtctaggggacgtgggaaggatagagaattgcacaagcaattacaagaaacgtgtaagcactacctatgtcagaatgaagagtactttgtcagcatttggcttttgggcaagtcagatgagctcccctgaggaagtgccacgaatctcagaactaaaaggataggaggagttagccaggatgtggagaagagttttctaaacaagatgcaaaggtatgaccttccattaggaagtgcagcttagaattctgcctacagggaatgtaattgtcagagggcaccagctgctacattctaaaatgcatctccatgtttttactagaccacgaatcttgcaggctgctctttgcctgtgactgagtgtagcagagacactaaggtaggactgttcccaaggggcaagggactcttgtgatggctgactttattgtctgttcattccatctgccctttgttcccttttcccttattctgctttttttttttttgtttatttttgtggattcattttatttcctttgtaagcttattggcaataactttgttatttcagtgtttgctcttgggtttaaaatatacttttaacctgtcattgtatacatttaagtaatattatataacttaatttatactattagaatgttacagtatactccatctctttcctcccaatctttgtgttacttttcatacattttacttttacatatgtgaaaatccctacactacattgttttttcatgaacaaatatctttcaaagagtttaaatagtaatgaaatcatataccttaacccatacagttaatatttccagtgctcttcattcgtttgtctagatccatattttcatctggtgtcattttcctcctgcttgaaggacttcctttaatattacttgtaatgcagttctgctggtgatgaattctctgattttgtatgtctgaaaaagactttattttgccactgttcttaaaagttatttgtactgtgtatagaattctaggctgacagggatttttttttcactcagtactttaagatatccctgtatgtcttcacttgcattgttcagaaaagaaatttcctctttgtaattaacgtgtcttgtttatctggctggttttaggacttttctctgtatcactggttttgagctattttattatcatgtgctttggtataattttctttgctgggtgcggtggctcacacctgtaatcccagcactttgggaggccaaggtgggcggatcacctgaggccaggagtttgagaccagcctgaccaacatggagaaaccccatctctactaaaaaatacgaaattagccgggtgtggtggcacatgcctgtaatcccagctactcgggaggctgaggcaggagaattgcttgaacccaggaggtggagcttgtggtgagccgagatggcatgccattgcactccagcctgggcaacaagagcgaaactccgtctcaaaaaaaaaaaaaaaaaaagaaaaagaaaaaaagaaattttcttcatgttacttgtgctcaggcttgttgagcttcttgtacctgtgcatttatagttctcataaaatgtggaaaaaaatttggccattttttcttcaaatattttctctgtcctcaccccttgctctactacttcaggaactccaattgcaaatgtatgagaccacctgaagttgtcctctggctcactgatactctgttagtttctttaaattattgtcttttcttggtggtttcattttggatcatttgtattgctgtcatcaagtttggtattttttttctgcgatatctaatataccattaatctcatccagtgtatttttaatctttcacattgccgtttttatctataggtcatttgtgtcttgttgatatttttcacgactcaacttaattttttgaacatacggaatacaggtatagtaactgttttaatatcctaatatgctatttctaatgtttgggtcagtttcaattgattgacttatcttctaattatgggttgaattttaatgactattttcatgcctgctaggttttatagcctgactggtgggaacagatgctattcccatttctgcaagagcactgggtattatcccctctaatcctgtgagatggttcttttctaggcctcaggaagttacctcacagtgaggtgctgagggagaccctattaagaccttatagattttatatttaaatcttgatgcatattcctagcttgccttccagtgtcaccaggagtatatagaagtaaccattatccttcatattctccaatattatttatgtgtttgctctttcattcattcatttacttacttatatttcatgtgaattgttaggcaggactgaaatagtgctcagtctagggctaagttacaccacactactgagaaaaaagatccttatgagtactctaccgaatgtcttatgaatcttgaggttttctagtgtgactggtgagaacaggcactatttccagtcctgtacctgtgctagctactcttctctctaatcctatgagatggttctttccctggcctcaggaagttacctaacatgcatgttcagaacagtaatctgctgaatacctgagagagactcttttaagatccctggggttctctccctttgcaactttctcttctctggtactctctgagctccaattgtcttgatctcctcagacactcagctcagggagtccattgggctccacctggtttccctctacatgtgcagaagcctgaaagctctctcaaggcaataagttgaggcaatctttggtcccaccttttttgtttcctttctctccaggatcactgtcctttgctgcctgatgtacagtgactttccagtcgttgttttatctatcttgtctgtttttttatgggggtgggggagggttgtttcaggtgggaggttaaatctggttactgttactccattttgtctagaaacaagttgatgaccaactttggctcaaggattccccaacgacctttccaaactctacttagaactggtgtgcaatctaaaatgctttcatcccacctgattccttatttctctctcttcctcactcaagttcagacctgagggacccaagttcagacccagctccccctagtctgccattcactctcacccaataaatgtattatttgtttcccctcataaattttgtgcaggttgaatcctacttcagtatcagcttctcaaaggcttggactaacacaaaaagcatgtgtgagatactttgactccaaaacaacacattggagtcttatgttctttgtgatcttaacacctactctaacggaggccaagttttatttactggatgtagcctgaatatttcaagacatacttagaatgtaaaatgtatataactccatgcatggaagtagcctatttattgcagttaaacccttacgggtgtatatttgtttccacttttccacagtttcaaatataggtagtgtaaatacctttgtttagaaatgtttgtatatttcaaacaaatggaagaacattccatgctcataggtaggaagaatcaatattgtgaaaatggccatactgcccaaggtaatttatatattcaatgccatccccatcaagctaccaatgactttcttcacagaattggaaaaaactactttaaagttcgtatggaaccaaaaaagagcctgcattgccaagtcaatcctaagccaaaagaacaaagctggaggcatcacgctacctgacttcaaactatactacaaggctacagtaaccaaaacagcatggtactggtactaaaacagaaatatagaccaatagaacagaacagagccctcagaaataatgccacatatctacaactatctgatctttgacaaacctgagaaaaacaagaaatggggaaaggattccctatttaataaatggtgctgggaaaactggctagccatatgtagaaagctgaaactggatcccttccttacaccttatacaaaaattaattcaagttggatgaaagacttaaatgttagacctaaaaccataaaaaccctagaagaaaacctaggcaataccattcaggacataggcatgggcaaggagttcatgtctaaaacaccaaaagcaatggcaacaaaagccaaaattgacaaatgcgatctaattaaactaaagagcttctgcacagcaaaagaaactaccatcagagtgaacaggcaacctacagaatgggagaaaatttttgcaatctactcatctgacaaagggctaatatccagaatctacaatgaactccatcaaatttacaagaaaaaaacaaacaacaccatcaaaaagtgggcaaagtatatgaacagacacttctcaaaagaaaacatttatgcaggcaacagacatgaaaaaatgcttatcatcactggccatcagggaaatgcaaatcaaaaccacaatgagataccatctcacaccagttagaatggcaatcattaaaaagtcaggaaacaacaggtgctggagaggatgtggagaaataggaacacttttacactgttggtgagactgtaaactagttcaaccattgtggaagttggtgtggtgattcctcagggatctagaactagaaataccatttgacccagccatcccattactgggtatataggcaaaggattataaatcatcctgctataaagacacatgtacatgtatgtttattgcggcactattcacaatagcaaagacttggaaccaacccaaatgtccaacaatgatagactggattaagaaaatgtggcacatatccaccatggaatgctatgcagccataaaaaaggatgagttcatgtcctttgtagggacatagatgaaactggaaaccatcattctcagcaaactatcacaaagacaaaaaaaccaaacaccacatgttctcactcataggtgggaattgaacaatgagaacacatgaacacaggaaggggaacataacacaccggggcctgttgtggagtgggggaaggggggagggatagcattaggagatatacctaatgttaaatgacgagttaatgggtgcagcacaccaacatggcacatgtatacatatgtaacaaacccgcatgttgtgcacatgtaccctaaaacttaaagtataataataaaaaatacaataaaaaaagactttagaggatttgaacaactcaaaaaaagagaaacttttgtatatctgtccaatcatttcatgaaaagttttttataagtaatatgtctggatcgtatagattttacactgaaattgtgatgcaatgcatattcttagcctggattccaatctcgccagaagtgtatgaaggtaactgatatcccttatcctctccaacattatttgattatttgcttaattagttttagtatcttttccaggggtaggattaaaaaggaagtaaagcaagtctcaacctttatatgacaatcttgctctggataataattttctcttgttaaataaaagaactataactgaagctttctttctcttcagtctttatatcatgatatatcactaaatcaaacatgcctttgtcctgatcctccagaacaagccagtaaaatgttctgattttttgtacctgttccctaagaaaggcctcatggcacagatatgaagagttctggctttggggataggaagatctgaagcagaatttccagctccatcacttactaactgttttttaggcaagttactgtagctctgggtgcctcagttttgctgtacacatctgaggggtaagaggagtgagagacatagacaaattttgagccctggtcagagacttgaacatggctcctatgacttcatccattctgtgaagatgagaccacaagacccatccctactgcccctgctctcttcagtatgggaaatggaaggatacagacagcctagttacaggctaggaggtaccattaaccacgggcctgcataagtcacacatcagtgaggagatgaagggtgccaggacccctgaaaatctcatttagcttagcagcactcagtggtgttctggacccagatcatatcaagtcacaaaagctgatctctaaataccccaggaatttttcaaaccatttatgaaattgtcaacaacttgaaatctgcgatgatggaagtatttacaccacagacattagctagcaaatgctacacatcagtgtcatccttccacaccccattacctcaccagtacttttctttttgtttatactttcaatgtacatgcttcactttatccttagttaagttgtactaagaagaggtaaaataatatgctgcaaagttatggagctaatcctcatagcttattttgtagtcatccgtaccaacagtggagtcccagcttttcaatgaacattgtaggaacaggcacaaccctgagtgggtttaacaaatctattgaggagccaaaggggatggatgaggcttgtcaaattctctgagatggtccccagggtcagcagacaactgatccatatctccctggtgatgagaaaggaccagaaatgaaccccttgacagagctagggtaacttagttaagatacattttttatatagcagaaaacatgactaaataggtttaatctatgatgaaaaattatctcatataacaaaaagtccataagtatgatggtttcaggcatgattaatttcatagttctatgacactgtaaagtaacaaactctgtatttttgggcttctgtccttactggataggcttctcctcagccaggatctcctcgtgttaccaaaattgtggctacaattccaggcaccatattcagacacaatgacattcagtggaaaacaagggcctgacacttgctatgtggattctattatgagcaaggaaacctcctgaaatgccagaaattagattgcacttccagtcagctcattctgaacctgaataaaatattgttctatttgtggaatttattacgaattcccatgttccacccagtaaaaatataaagattattagctacgctcttccatccagatttaacctttgttggatgagtaggaatttttgatgtgtggtttcatacttgattattaccccttactaatgtctgatatttaactatcactctagatacataaaatagtatcctaaattatgttaggtcctgggattcaaggggggaaaagatacatatgacccctgccctcaaggaactcctactctgttaggaaagattccataaaataagcactgacaagaaactgtgataagtgctttgtattaaggagaaggcaattgtatggattttgtctgcacatgacaggaaataatctaacttcaagaaggcagacaaagcctcctagagaaatataagtgtaacttgaaagatggagattaagtagcaattagccagatggagagggaaagcatcctacacagagggaacaacatgggtgaggttatgaaaatcagagagaaaatgggccatctgatgaacagaaagttgttcagattggctggaacatagcatgtaggatactgtttcatgatactgcctgaaatatagtaggcttctttgaatatatattgggttaattaatctttttaatgaccctgattggaaaaacatccccttaagtcttggatgagtactgaagggttatttgtgtaggcaccagtctgtaacaattcctcagtctttccagcatgccacattatatttagatgtcatgtcgcctcagtcttctagaatcagccatttatcccagaagccctggttctttttattagagaatggtataaagaaaccaagacctgggtgtcaggtgtgctcattgcagctaatggtataaaattcacaagatacagcataataattagaaaactagtagacctttggcttccatgctttcaggaggggagcaagcctggaccaaggaagccactttaatatgactttcactgtatgttcaattattaacatgcttcactgttgttggtataatttctatttggggtagaaagatgttttctaccataaaaaaatacaaagcgtttttgtgaccctccctgttctttcttttacctccaccacttttttttgcagtttaacaacttttggctgcggtcttttcctcactaatttcaagtaatttgagaacgtcaagcttcaatttcctgtccagccctgaagatccaataagagcttcaagctgggactgtaacttcatggatccaccacagagagtcactccaactttgaattctgattcatctctgattccaaccaaagaaatgccccagaaagttacatcaacctcccaaacatccttccctgaaatgcaaaacctgggcccaattaacttcaaccatggtccttgtagcaactacgtcaaccctcagccagaggggctgctccaactgcagtatgaagatgagatgacccaacaagagaggcaatgggaaaggtcagcattccctgagaagaaaaagatattcatggagaacataagacagaaaatcctcaatcccatggcaccttactgggctgaagggaaagtaaaaatctcttcctcatatgataaagataaaaataaatgtaaatatctttactgccagatctatagggaggataattctaggagccctagtgggtagaatccatcctcttggaaaacgctagtgcagggccttaaccacttgaccttcagccctggtaccatacagacctgtcatctaccagaggagctgctcaagagaagtaaagagagaagagccatcatgagagccagaagaaaggcaaaagagcctaggctcctaaaatgacagtcgaaataaatccaagactctaatcctcgtgattagatcagaattgattcagatgtgtgaatattgattttagccagttgcttgggtggaaatttttgggaactatacaattaggaatggtcattagaagcagcaagaaccagtattttgacaaaaaaaaattgtatcagtatgagatttgatctagttctaggaaagcaacgatcattttcccagtaattttagagttaatctgggaaatactgggatgatctactctgcggcaaggaagatgggtaaacaatggttctttttattattattattatactttaagttctagggcacatgtgcacaatgtgcaggtttgttacataggtatacatgtgccatgttggtttgctgcacccatcaactcatcatttacattaggtatttctcctaatgctatccctcccccagaccccaccccccgacaggccccagtgtgtgatgttccccgctctgtgtccaagtgttctcataaacaatgcttcttaacttattatttagtttttatgataggacctgtctttcttctccttagatctctttttccccatcctgtttccagtaaggtataaaggatatgtgtagtgtaaatgtcttgctggttttgaaatgtttttgttcagtctcatggattgaccaaaaggaaaaaaaaagcaaaaacacaatgtctgatgaaatttatttgtgttttggaattctgaggttaataaaaagatgagatccacttttaaagttttgaatcaaaagaatgtgtgacaaaaggatgtgtgaatagaatttgtgggcttcacattgaattgtttggataaactacttttcatgaggcacgtataggaaaaaattttttttttgaaacggagtttcactcttgttgcccaggctggagtgcagtggcacgatctcggctcactgtaacctctgcctcccgagttcaagagattgtcctgcctcagtctcccgagtagctgggattacaggcacctgccaccatgcccagctaattttagcattttttagtagagacggggtttcaccatgttggccaagctggtcttgaactcatgagctcaggttatccaccattacaaagtgctgggattacaggcatgagccactgcacccccggccaggaaaatatttttatgctcctttataattgttaaacacctccctgaagaaatttccaatgtgttgtctcaattgtcaacaacaatacctgtgtatttttatttaatattacttggatggtagtttgtcaaggggaactacttgcagattagaatagggatgtaggaaagggacctttgaaaacatttgcattactctttatggtaccataatcagggcagcatgtgaagtagccattggatggtccaactcccgctttgtgatagcagtgggaagcagtaccctgcccaccatgtaagcatatgcgtgttgtgcagctgccacggatttaggtgttccacaatagattcttccctctcaggtgccccagcactctcatgcttgctattggcgcgggggcccagagcattattatgttgtttttacttctgccagttgtgtgaccaacagtatatatgcgttttcttttcataatatgaaattgattgtgctaatttctttcctatagagccctctgagagttatcccaccacaggtcataatattctgctgatgggaaaataagtttggctctggggaaatctgctttcttaggcaatcttcagtggtgcaatagagcaaaaactccataatgttttcacacataaacacttgaggacatacaaattaatatggactggatcctaggcttgtgatttcatcagagtatgagagttaaagtaatcctgtattgtttataccacaattcaagaggacagtgtaaaaaattgcatattttatacatttgaaaggtcatggcctaatttcattatgtaaaatgtgatatgttttcagagaaatataatagttttcttatgactctggcaatattccaaatacatataggtgcatgtacatttaaagatacaaccagcttggaactgattaaaatcaaggcaggtttttgggggagaaaacattgacaaacaatacaaccttattcttcaagattgagtttgctattctaggttctttgcatttatatataagttttagaagaagtatggctggatgtcttaaaatattagggtcccccagagaaacagaacaaatgtgcatatatatatatatacacacacacacactcatatatgtatatatacacacactatctatctatacacacacacacacaaacatatagaaagagagaaaagacaaaggaagacttttatttttaaggaattggctcacatgattgtagaggctaccaagtccaaaatctgtggcatccaaaatctgcgggataggctggtactctggagactcagggaagagtttatattgcagatcaagcttgaagacagtctgggggcaaaattctctcttcctcaggggactccagcctatttactcccaaggtcttcaactgattggatgaggcctgcattacggagagtagtatgcttttctcaatatctactgatttaaacattaatctgatctaaaaaaatagtgtcccagcaacacctagattggtatttgatcaaatatctagataccatggcttagccaacttgacacgtaaaattaagtattacaagtccaccttttgtcaatttggcacccaaatacatatctttaaaccattcctaatctccaagtaaatataataatgaggttgtgcttccacctaacaagatacaagtatcctatgtaaaaccaaaagcgcactaaccctttccccagataaggatgcacttgggtgatgttgactcttctccatgatatcctgtaacttaaatactacaatgtaaagtcaataaatctcatatgataaggggataaaagatagaaaaaaagctatttgtttaacgtgtatataggcacaacctccatccctgtgcatatacacacatacatttcatgacaaaataaagaagaaatactcaattgtagtccttgtttgtaaaactggtcacatgatcatacctggtatttataactaccttcttccactatccattccttaagtcctttcgccctctgcaagcacttcagctaattgtatttcttacctggtggggtgacccaaaccttcattcctaaattctcccggccattagtagtcctacctgcattactgggttgttgttgtgtcccattgatcttaatcacaaggcatggtaatattaagagacaccctaagaaatctcctattttctggacattctgttccttacctccattgtggaggagcagtccagtttcccccttggtagtcaggatcaatcacctcggccagcacagaaactcccttatttgcttgttgattcagagacatgaggaaaccaaaatggctagttggcaattttaacttccagttcaatggaatcattgtggtgtctcctggtagaaacattcctccctttggaactaagacctctaggccagcatagcataaagacatagaaacgagaagcaaaaagtttgctagtggatcactaggagtaatagtgagtagtgtcactctcatttccatcccttgattcctggacttgtgaatcctggctatgggagaaacaacaccacatgctggacactgattcagagcatatacagccttgtggagaactttgccacagccttgcaagtattgccacctagctggcactgtaactgagtctttaaaagggcattccacagtcttaccaagccagctacttcaggatggtcaggaacatggtaagaccaataaattttaagagcatgggccctttgccactgctgtaaattgagttccttgatcagaagcaatgtcatatggaatagcacaatggtggattaagcattctgtaaattcatagatggtagttttgacagagcattacctgcagggaaggtaaatccttgttcagagtgtctaatacaataagaacaaaacattacactttccatgatggaagcagtcgaatctaatcaacctgctaccaggtagctggatgatcaccctagagaatggtgctatatcctggactgaatgttggtctctgctgcttgtaggttgggcactcagcagtggccgtggccaggttgaccttggtgagtggaagtccatgttgctgagcccgtgcataacctgcatccctgcaaccatgggcactttactcataggcacattgagcaatgatggggtggctgcggaaggaggctgagtggtgtccatagaacagataatcttatccccttgattattaaaatcctcctctgctgaggtcaccctttggtgagcattcacatgagaagcaaatattttcacatttttcacctattcagagaggtctatccacatacctcttccccatacttccttgtcaccaattttccaatcatattttttccaagcgcctgaccactcagctaaaccattgtccacagcccatcaactggtacctagtcacatgtccagccatttctctttctaagcaaaataagcaaccaggtgcactgcttgaagttctgcccactgggaagatttcccttcaccactgcccttcagagatgtctcagaaagggacgataattctgcagctcttcactttcaggtggttcctgcatatcatgcagaaccatccgtaaagcagggccaagttttctcttcctctgtcaaccgcctgtgccactggtctgcacagatccacgaagagacttgtttccagatcaaagctgaaagagaaaagagtaaaagaaaagttataattcaacctgtaccagtcacttttccatgggttcactctctggtataaggcatctgcttctgcttacttttcagattcctcaggtaagtgtttttgtttttgattttgtttttttgttttgttttgtttatgttttgttttgtttttttggtgtttttttttttcatttggtctagaatctttagttataatcagtgggagagataggcagtactatgccaactccatggtggccaaaagtggaactcctgattgggttgcttttatagactttagtttttagagcagttttaggtccacagtaaaattgaacagaagacacagagattttccatatgcctctgccccgacacatgcatagccttcccaattatcaatatccctcaccagaatagtgcatttgttacaattgatgaacctacattgatatatcactatcatccaaagcccatagtgtacattagggttcactcttggtgtcatgcattatatgggtttggacaaatgtataatgacatgtttccaccattatagtatcacatacagtagtctcgttgccctaaataattcctctgtgcgttgtgtatttattcctgcctccctccaacccctagcaaccaccaatccttttactatcttcatagttttgccttttccagaatgtcacgtcgttggaatcacacagtatgtggtcttttcagattggctttttttcacttagtaatatgcatttaaggttcatctgtgtcttttcatgtcctgatagcttgtttctttttggctctgaataataaataattgtctgggtgtaccacagtgtacccattcacctacagaaagacatattgattgcttccatgctttggcaattattaataaagctgctttatacatccatgtgcaagtttttgtgtggacataagttttaactcattcaggtaaatagcaaggagtgtgattgctggatcatatggtaagagtatgtttagtcttgtgaaaaaaacaaaacaaaacaaaacctgccaaactgctttccaacattgctataccattttgcattcccatcaacaataaatgggagttcttattgctccacacccacatcttcctcagtatttaatgttgtacatgttttggattttggccattctatgtaaaagtatattattgttgttttaacttacaacctcctagtgatgttaagtatcttttcatatacttatttgccatttgtattacttctttgtgaggtgtctcttcaggtttttgcccatttattattgggttgttcatttttatattgttgaattttaagagttctgtgtgtgtatatatatatatatatagagagagagagagagagagagagagatggagttttgctcttgttgcccaggctgggcatacatatatatatatatatatatatatatatatgtatgtatgtataattaattttaattaagtttaattaattaaagtcttaattttaattaagttcagttgatcaattctttctttcatagatcatgtctttggtgttatatctaaaaagtcatcaccatacccaatgtcatatagattttctcctatgttttcttcagggcgttttatagtttttatagtttttcattttacatttatgtctatgatatattttgagttaatttttgtgtctggattctttttttttcatatgtcaatgtagagtctttcaccaccatttgttgagaagactatcttttctccactatattgcctttgctcctttgtcaaagatcagttgactatatttatatgagtctatttctgggctctatattctgttctattgctctacttatctattctttcaccagtaccatgccatgttgattactgtagctttatagtaagtcttgaagtagaatagtgtcagttctccaattttgttcttctccttcaatattgatttggatattcatggtgttttgtttctccatataaactttagaatcagttttttggtatccacaaaataacctgttgggattttcattacgattgtgttgaatctatacattaagtttggaagaactaacatcttgacaatatagacccttcctatccataaacataaagtatctctttatttatttcttctgtgatttattctatcagatatttgtactttttcccatatagatcttgtacatatttggttagatttataccactttcacctgtttattgctggtatataggacagtgattaaattttgtatattaaccttgtatcctgcaaccttgttacttattaatagttccaggatggtttattgtctattgtttttcgaattttctacatagacagtcatgtaatctgcaaacatagacagttttatttcttcctccccactctgtataccttttatttcattttcttgtcttattgcattagcttgtacttccaatatgatgttgaaaatgagtggtgagaggggacttgcttgctttttttcctgatattagcaggaaagcttctagtgtctcaccattaagaataatgtaagctgtagggtttctacagatgttctttatcaagctgaagaagttcccctctgtttctagctgtattagagttttaatcataagtagatgttggattttgtctacactttttctgcatctattgatatgatcttgtgatttttctttagcctgtttcctcactgtattttatggagtgtacaattgaattggaagttataacaagttggtggtctgagtgcaatagattctgcttggagttataagtcactcaaatgatgattttattgaaaattaatgtgttattaaaaagcggcagtggagggcttcactgaagaccagaaattatgagcaacaattgaaacatggaaaaaaatatataatctgctacaatactaatatctgtagatgtaatgagcatggtcatgtgactactgacactcctactcatcttaataggtacaaatccttggtcttctaaggcaccacaaaaagtaacactggaaatgaacattactgagtatttagtatgtgctgggcacactttaataccttgatttgtttaatctcccaacagtatcttgtgaggtagatgactccaaagcaaaagaccacttacttgtgctgcctgcctattttatacagatccctctgtaacattgtcattaccaagggaagaccaggggtctgaatcctagctgaatctatcatccctgcagtggttgttaccattaaaaagtctgcactgaaagatctcaggcttccctctattatgccaatcacacaaatacctttatatcagcaaagaaactctcacagacactgcacaatcttgtttaagtccatccatccatctctccatccagccatgcatgcaatcatgactctatccatctatccatccaagaaatatactttaagagcttcaataggccatactccattaaaaagcctcagcatcattctataaggcagatcaacggactctctaaagggaccttcttcctaattttaacactatggttctctgtgacctcctccgggcccgaatgccacctttaggcattgtgtgacatgtttatcaccagctcataaataaaagcttgcagttgcatgatgcttttaatgcatctatttggctgccgaatcactggaattctcctcactgaccaacatccgagcactagaaaatatacaaatgatgtaaatgccacatacccacttgagtagtgcttcttaactcaatatgcatcacacagcaggaagaataataactaaagttttgcttgaaaaagtacaatttggggatgaattctcatatgtaggttaagacttccgtgtattggaccaccatctctccatctattcattcatttcctaatatcagtgagtacatttccgtccctatttatctaggtctatcttcttttttggacctaagctactataaatgaaaagcaacatgttcaacccacctcttactctggtgttcaagagttgtcatttcagcatccgctgaactcaagagcaactacacaagataacaaaatcagaagagccagcaatgtaatattacagtttttagttttcattttatttttttaattttcatttttattttaagttctggggtacatgtacaggatgtgcaggttcgttacataggtaaacgtgtgacacggtggtttgctgcacctatcaacccatcacctaggtattaagcctatggtgattcctcactgatctagaaccagaaataccatatgacccagcaatcccattactgggtatataccaaaaggaatataaatcattctattacaaagatacatgcacgcgtatgttcactgcagcactattatgactttttaaaagaaatggggcttcatctctcaggtgagacagatttagtatagagtttactctaaataaatagttgtgcatgaggctctaactgtaatgcaaatgtcaaaatcagccttgaaagaaagggtaggtaataatttttaaaagacaaatcttgcctcttcatctttcatgatctaccatgtgcctacattcccgcctcatcccaggcgtccccaatgtacacatttgggacttatgccacagtcactgtgatcctctagggagcaatgagtgctcctgagtacacatgtgtacacgtgtctctgcatgttcaaggacccttgtgacaaacacatctattgagagtcacgattccatgtctgtgggtggcctcccttgatacatcctgtcttagtttccactcctttgtttgttattctctggagtcagatggattaggcttcagattctcaggtaaccaactatggatctgagctgagtgacccagtgccgataagaagaatgttgccaaaacaacagaatccatacccctttccagtaccgaggccctcctccctccccctgcctgcttggatctcaggtgagaatgggaatgtgatgtggctaagagtgaggggatagatatgtggtagagggttcgaggagagaggtgaaatcttggggtccccacagaagggactaggggagggaccagagatgccaagaaagcctgctcctgggcactgagaccctaggagatgactatgaaagtgcagtggttctaacatgtggttctatgaatttccccagcagtacacagagctgcgaacattttctgactctaagctccagggctcagaccatgggaaatgaggcctgtgttggcaaagggcagtggagcctggaatcactagtggagggcagctgcaagccttgaggaggccctgctcacctcagcaataactctcatcagtaactccactctgtgtgtctctcttctggtcttctctttctgtgctctgttgtcagggtcaatatatagcaggttaaaattgtcctgggttaaaggagaagaagaggcaaggatgtcccaatcccctcttccactgactgataagacagtgggcagagggggagctggaagagatggtatgcagagaccacaaattaattcgtgcttctcagaccagacgggggtctggtgcatttacttgctaaggctgatttgattttcattatgagtgcataacctctgtactggacagtaaggtgagaaaatactggagttatgtctaatctggtgtcagctgatgctatcatgtgaatggtccatttgtataaatgctcagcctgttttgctgaaaatgatcagtctctcagatttccaccccacctccctactcctttccaagacgattaatggtgtgtatggctttcgagtcttcatggtgatatgggaaggggcctatgacatcttatgttgactgcagtgtccttagttgtttatgagggaaggctcaatcttctctctcaggttctgctgacgatgctgatttgctcacccatttctctggctggtgtaacttgcatttttgtctctctcattttggtcaggatctggtgctccctggctgactcagcctcagcccacctgtgctggcatcagcagacccctctgaatcggggcctcatcctccttcccacatctgggcagggctgtccatagcacagcctcagctgcagggtcacctagcacctatctgggttatgcttgcttcatggtaacactcctggctcttgaatcagccacttccacattcccttctcagagaatgtagcgccctgcaggaacaaagatcagctccaaaaactgaaattcttgaactccagccatttctctaaccaaggatcttgctatttatttctgcagaagtaaactgagtcctaaatttcagctgggcaaaaaatctctttatttgggactcccttccacttctctgacacacctgtcacatgtaagataaggcccatagaagagagactgtgatgagagtctcttacctccatctgacactgtctccatgccttctacacccccaaggctggaacagaacactcttttattttctttatctttcatgttgacataaggattcccatagtaaatccagatcataaagggaagtctttaggatttgtactttctcttgtagaattcaaattcatttgaaatgtttgaaggaaattgactaacagataaagaaactcaaaatggaagggattaccaaatacaagtcaatacatcatcagtagcagggcaagctctctgtaaaaataaacttggagttcaaagggagttgtattagtcagggttctctagagggacaaaactaatagaatatatatatatatatatatgtgtgtatatatatatatgtgtatgtatatatatatatatgtgtatatatatatatatatatatacatacacatatatatatgagtttattaagtagtattaactcacacaatcacaaggtcccacaataggccatctgcaagctaaggagcaaggaagccagtccaagtcccaaagctgaagatcttggagtccaatgtttgacggcaggaagcatccagcatgggagaaaggcgtaggttgcgaggctgagacagtctattctctttatgtttttctgcctgctttatatcctagtcatagtggcagctgattagatggtgcccacccagattgagggtggttctgcctttcccagcccactgactcaaatgttaatctcctttggcaacaccctcacagacacacccaggatcgatattttgcatccttcaatccaatcaagttgacactcactattaaccgtcacaggagtcatcatgctttaaaaggggcttacaaggtgtggcatcagcattttcaatatgtgtgtccagagagcgtcacttaagcaagctatccccagcattgtctgataacttctgagactacttgagaatcagagacaaactatcctgaagcttgtggtgtgtttgtggagttacgggggcaagctcaggtgtatgttcatgtctgtattatttctgaaactttatggaggcctacatgaccttttcattagctaacatcttcctctttttccctcaaatttattgtatatgccatgtaaaacatcagtaaaataattttatgattaagaagaaaaacaaggcagggcaaagtattcctatggctttactatacataaccagaaatctacaggagttattgtggggaacatacgcattgcaaaatttcttgcagagttgaagagagattcttcagtcatgcctccaccctggcaaggaagcataaagtcgcaagtgattctttattaagtattaaacagatatttgtgtaatctctcgtaatagctatttggtagtcttatataagttggtaatttagcactgaaccagggagcagcagaagaccaaccaataaatgaataaataagtccagattgcgatcagtgttaggaagcaaatactttaggtgctagtctacaaactcactactttaaacaggacagtcagagaaagcttctctgagcagaaaccctaagatttataaggatactgctgtatgatgggaaaatggaagaaacaacccgggggagagtgtagaatgagaaggggaactggctaaacttcatgccgaaaggaagagcaagcaatgggcaatggctagtgagaaagagtggagtgaccaatatggttggaggtacaccaggagaggtattttcacaaatctaaaatttaaaatatagcataaaaagagagaggagagaaagcagggagggagggaggagagtaggctttgagaaggagggaggtgtcaaatgtactgaaggcatttggacatatagtataaaaggatgaggacgtgatcatagggttaggcaatatgaaggccattggtgcctttaaccaaagcatttttctgttgggaggtgagcagatagaagctgcatttaagtggtttgtgatgataatggttatagaacaagggaagacacatttgctgcttggagcatcagggaaatgtgtcattaccttggagaaatatgggataaggaacgggtttctgttttattacattttgtataaaatgtcagaaacaagagcatgtttgtagatgacagaagaatccagaataaataaagaatgtgacaattcaggaaaaagtgataattactacaaaagcctctaccttgagaaagtagagggcataggattcaggtgaagggctggcctcaagtaggatcctgtcacttcctccagtggggcagctgagattacaagtgcaggcccactgctgttgggaagtggtgagagtttctctccaattgctcctgttttctcaggggaatatcaaggaatatcatgagaagagttggtgctagtccttgtggaggttattgtaggaagaggagagagaagatacacttgtggagggtgcacatcgtttgtctacttgtttggtggcggggggggcgggggttgccaggagagtaggaggagggaaaatgaagagatgcgtttgaggagcgagagttaatagctttgagtaagctgggtaaggaaggtgaatggtaaggaatgccgttggggtcagtggacaggaggcctccttgaggctgaaggctatggatgttgggccattggaaggagggagctgttaggattggattgggtgttgcccatggtgagagtgggggatgcaagaaatggacatcgtggagcagcttggtctttcccgaggcccagggcacgaccacagatagaggagacgtaggtgggcaggagatcccctgaagattggagaggctctggtcatggcctggtcagtctagggggtgctgaggttaccaggaaggatcggcagagtgaggcccttaacaaacaactcacaaaactgtcaaaatagtttcctcaaatcggaatcatttttttttttagacggagtctcactctgtcacccaggctggagtgcagtggtgcgatcttgtctcactgcaacctccacctcccaggttcaagtgatcctcgtgtctcagcctcccaagtatctgggactacaggcatgagccaccacgccaggctaattttttgtatttttagtagggacagggtttcgccattttggccaggctggtctccaactcctgacctcaggtgatcctctcaccttggccttccaaagtgctgggattacaggcgtgaaccaccatgcccagccaagaaacctttggttgtaaggtttctggattttctggacacctatatccaggatgagaaacattgtcacatttcaaaatttaagatgggaagtgattgcagtctggacctgacctgccaatctgatcagtgtccaaagatgcagtaagaaattggtctgatgtgattaacaatgaatttgtccacaccagcctcctgtgaacctagcttccttcttgtctatgaacatagtgtttatgtgaccttcagtctctcccctacagttgcagtcaccccatcctcctgtaaattatacagcctcctttgatgccacttgtggatatctcactgaggagtatttacttcatgacttctgaaaccaaccacagagtgagtcataattaatcacagaatgagagtactgcccatcttgttctcaaatattggagtctatctcccctcagaccaaatcaacactcattattatagtgtccaggacactatgagttttgaagcctggcagacatgcagacatattttcaaagcctagggaaactgtcttctcaagactcaatagaaatcataatcaataaaatgattccaataccctccttggagagaatctatgcatcttagtgatgtgtttaaagtgtctggctcccaatcaccctttaagaaggatttcgtgagctatgttctaggtgtagaggatacaacaggtaacaaaaccgaaagagactctgacacaatagaagttatcagtaaatacatagcatatcacagggcagcaagtgctaggtagaaagttaagacaggagctgggcgcggtggctcatgcctgtaatcccaacactttgggaggccgaggctggtggatcgcctgaggtcaggagttcgagaccagcctgccaatatggtgaaactccatctctactaaaaatacaaaagattggctgggcatggtggtgggcgcttgtaatcccagctgccagggaggctgaggcaggagaactacttgaaccctggaggcgggggttgcagcgtgtcgagattgcgccattgcactcaagccttggtgacaaaagcgaaactccatcttagaaaaaaaaaagttaagacagggtcaggtaaatgggtaaatgggcaggatgttgttattttattcaggatgtgtggggaaggcatccctgaagaggtgatgactgagcagagacctggaggcagtgaggagcaggccttgcaattacctgagggaagagcattccaggcagaaggaacagcaagtgcaacagccctggagcaggggaagcacctggtgggtccgggatctcaaggatgtgtgatggtaaagaaaggctcatccaaggttttgacatgtggcactcattgacaggtgcctggtgtccccatctctatttctcccacaacctgagagggagatggggttctcccatgtcacagatgaaggacctgaggctcagagaagtgccctgagcctgctctcctgctcacacctgaaattcctaaaagagggatgaccttctgttgcaccacaggagacatagggcttgagcccacagctggggggaaggtgccatccacactgaaagtcagccagccagccagtagaaattattaatgataatatgggaaccatggccagcatgacatttctacttccaatgggaaggcaggactttaggaatgagaaaggaactgggatggaagagagaggcagaaaggggaaggtgggggacagtgaggaaaaacacactgattgagaagggaccctggggacttctgggatgatgatcaaccttgaactatgtggttgttacatgaatgtacagcttataaaacatagacttatgtttcatacactctcgggcacagacacacacaaaaaccctcataagtgaagcagagtgcagtgggaagtgggagtagcgtgagtgtccttgactcctgcacacaggctcgcagcgccccggcctcctggtgtggaccacgcagtgtaggcagcctccttcctgcagaacctcccctgggctccaggtcttgccttctatcctggaggctccagaggctccctcaggcctgtttgtggagattgtctggtgggaaatcctctatcctgtgctcctgatgccagccatggagcaggaacaccacctctcaggggatggacaggacctgcccattttgtcctcagatgttgggatccatctcccctcaggcctcatttacacccacaatagcccaggacacgtgggctttggggcctggcaggcttcatagaagcctggaaccccaagccctggtggtgtgactttgggcaagtcacctgtccttgaccagcctcagttccccattcataaaggaggctaatgcccgccaagcagggtaggtgcaggttttggggaaaacatgtgtactgccctcctcccgagcccatgttagatgggtctagtagttgaggcagggtaggagcaggggctggagtgacattggcagggactaaattgccccggatcagacggtgggcaagtggcttcagctctctctgcctccctttgctcgtctgtcatcagggtactaactttccctcctcacagggttatgtgaaggagaggtgagacaactggtcagtcaccgagagcagtgctgggcacagggcaaggctgagtacaggcccactgtcatctccctggctggaataggttctagcaataatgacatggatgtgtttagggggccactattctgcctaccacataccctcttccttggcaagccttgatggtaactgtcattgtccccatactggggccacagaggtagacagatggaccttagcctccaagagagtgagtgcccaccctgtagaggagaacagcatgtcgcaggcagttcacagagtgatgccttttatatcactattgtgatggttagttttaggtgtctgcttgacggggttaagaaaaacccaaatagctggcaaaccattatctctgggtgtgtctgtgagggtgtttctggcctttgaatctgtgaactgatggaggaagatcggcgtgggtgggcattgtccgatccctcgagggcacaggtacaacaagaaggcggaggaaaggggaatttgttgtcttctggagttgggacaccccgtcttctcctgcctttggacataagaactccaggttttcaagccttcagactccacgagttatgcctctggctcttctggttctcgggcctttagactcagactgaatcacaccatccaccttcttggctctccagcttgtagacggagatggcgggacctctcagcctccacagtcatgtgagccaattcccataacaagtctcctcttatatatctatagctaggtatcctattggttctatttctctggagaactctgactaatacaaccatccatacgaatactatcagcattcacctcaccatgattctgtaccagacactggctgaccacctaacatgaatcatgcttttctcacccaactccgcgactgtcaactctacttctatcacccattcacaggtgagggccttctgtattctcatcagccccatctctgagcacagtcctttgcagaggttttcccagttctcctcttccttctcctcctccttgtgaccagggctagcatcttttttctttttttcttttttttttttttgagacagtctcactctgttgcccactctggaatgtagtggtgtgatctcagttcaaacctgcacctcctgggttcaagcgattctcctgcctcagtctcctgagtagctgagattacagacacatgccaccacacctggctaatttttgtatttttagtagagagagggttttgccatgatggccaggctggtcttgaactcctgacctcaagtggtccacctcccttggcttcccaaagtgctgggattacaggcatgagctaccacgcttggccagagctagcatcttagtctcacagtggcccctgctctctaggtcctcagcccttagccctgctgtcacccacccacatcctacaacccctccactccctcttctccgtgtctgttgtccagggtgagaccaagtccaaacctgagcttcctgctaagtcaaagtgaccttttcctttcagtcagggaagcctgactgaagcctgtggtcccacggtgaggtcttggtgtctctaggcacagtgcatccatgttgcagtgatacccacctttgccagcagggggcatctcatctccaagactggaaaaacctcagagaagacagaggaacagtcttaaacattcactcctggccaggctcaggcctgtaatcctaacactttgggaggctgaggtgggtggattacaaggtcagaagatcgagatcaccctggccaacactgtgaaacctcgtctctactaaaaatacaaaaaaaaaaaaaaagtagccagtcgtggtggcctttaatcccagctactcaggaggctgaggcaggagaatcacttgaacccaggaggtggaggttgcagtgagctgagatcacaccactgcactccagcctgggtgacagagtgagactctgtttcaaaacaaacaaacaaacaaaaacattcatgactggtggggtcacaggcctcagggtgcatgaactccaggctgggtgtcccttggagcctccctctctgcatgtggacaggtaggggcagccaagggccaggttttagtgctgttcggggtcatctgcagatggcttttcactccttcctactccctttccttgtaccagaagctcatttccatggctaaaggaaaattctcatataattttatcttccttttcttatttaatgattgcatcatatgctttcttctacaagatgcactggctcagaggcctgtgcccagggcagatcaggctataggttggctagtcctgagggcaccggcctgaatcctgaaggcactggggacaggccccaacagagcctggggctcaggaaaaggccaccaacctcctagccagatcctggccaactgccagctctgcctccacccagtcatctcccagggcctgaactctgggtctagaagctccaggactggtggtctgggggagatacgggctggaaggatccctcggaagaggaggcagcagacaatctctgtacagcttgagagggtgcacagctatagggtgaggcccggcccacccagcacagatccactgacctgctgtgcagctgcaggcccagctgcttccctctaccgacctcagtctcctcacctgtgcaatgggcatcattcagccccaacatgcaggggatgctcgtgaatggaagggagctgaggcattgagaaagcagatttgccccaagagaaggaagagtgggtcaaggttggtggggaaggatggatgaggccacctcggggaaagccaggggctgccttcctggaagtgctcagggcagtcaggtggggcaatttctgaggcagtgagcaagaactgtgggctggggaccaggtgaggttgtctctatagtgttctggggtggccagccgctgtgtcactgtttcttcctgtttgtcctcacccctgcccatggggagcctagagatgagcccagtgagctcactgtgagtcactgtgacccacatgcagtcattagagccatgcatcatcatcacaacagccaccaggttaacacttgggtaatttatccaaataatgactcacctgttctgacctgatttggatgatatgccatcatttagtgtagccatagtttattcagtcattctcctattggatcgttaattagtgtttgatttactttttgaccatccagacctgtaatgagaattcttgtacatgcagtgatgttcatagagtaaccctacttgtaatagctaaaaactggaaacaacccaattacacaccaataagaagtcacataaataaattctgccagattcacactatgaattactgcacagctatgagaaggaatgagctagaccatgcagagacataacattaggtgaaagaagtcaaatacaaaagaggacacgctatgtgattccctttctacatggctcaaaagcaaataacaatagtgtttaggcatacatatgcctatattataacaattttacagacagcaaggattctaatttgcctggtgggcaaattttcttaatttttgaaattatacagtaaaatggacacttgaggtatagttctacgaatctgaacgcatgtatagatagatataaccaccatcacagtcagtatccagaacatatgcatcaccccaaagaacttcctgggttccttgtgctgcccttgtatagtcacttccttctcccacccctaagcgctggcacccacggatctgttctctatcactatactattgtcttttccaggatatcatagaaatggaataatacagcctgtagtcttttgagactggcttcttcactcagcatagtgtctttgagtttaattcaagttgttgaatatatcaatagttctttttttcagaataatattctattgtatgagtgtagcagattttctttatccattcacccattgaaggacatttgggttatttctaatttggtgtaattgtgaacatttgtgccataaacgtttgtgcatgaatttttgtgtgaacataaattttcattcttctatgataaatatcccagatgtccaatctttacaacaccatttgttgaaaagaccatcccctttcttttgaattgcctacaaaaataagatcaattgatttttctttttttacaaaggtgcttttatttttgggctatgtatgaaactgtcaagattgttctagtattataatactttttaaattttgttctttttcaaagttattttgatggttctagttcctttgcctttcctcataaattttagaatcagttagtctgtatctaaaaaaaaatttctgctgggaatttgattggaattgcattaaatctatacatcaatttggggacatcatgcctacattgagtctaccaatctatgagtacagtatgtccctctctttatttagttcttcttttaattctttcattcacttctgatggttttcagcatatgactcctgcacatgttttgtcagattttgaggagcagctattgtaaatcttattgtgtattttttaaaatgtttgttcctggaacttcattactagtctatagaagtgctttgatttctttgttgaacgtgtatcctgcaatgttgcttaactcccttgttcattctagaaatattttttatgaattcagcaagatttccaacaagataatcataacatctgtgagttggagtagttgtagaccctcctttccaatctgtacaccattcatttccttttcttgcctttttaaactggttggaacttctagtacaatactgaatagcaggggtgagagttagcaaccttgcttggttcctgatgttatggagaaagcagttagtctttattaagtataatgtaaggtgtaggatttgcttttagttgctccatatcaagttaagcaagctccttctactcctggtttgctaagtgtttgatactgttgtctgtaatcataaatggctgttgaattttgtcaaaggctttttctgcatcaaagtttgaccatgtggttgggattggggttttttatttttattttttcggcatgttagtatgctgaattgcattgattatttttggaatattgaaccagctttgtattctcaggacaaaccccacttggttgtggtgcattattctttttatatattattggattcaatattaacaaaatatttgtttgctaatattttgttgagaattttctgcatctatgttcataggagagattagattatattttttaagctatctttgtctgattttggtgtcagaataatgctgatcttttaagatgatttggtaaatattccaactgtcaattccatcttttaataggtatacatctattcagattatgtttatttttgagtgagctttggcagtttgtgtctttcaaggaattgttccattgtcatctaagctgctgaatgtatatgtgtagagttattcatagcatccttttcatttttgtgtggcctctaacttgtattaaacttttcaaagaacaaatgcaatcttggctcactgcagcctcaacctcctgggctctagtgatcctcttgcctcagcctcctgagcaactgggactacagacacactatcatgcccagctaacttttgtaccttttgtagagatggggtttcatcatgttgcccaggctggtttcatactcctgagctcaagcgatccgcttgccttggcctttcaaagtgctgggattacaggcatgagccaccgtacccggcctggtgcttccattcctgaagtctggcatcttagcacatgctaatcagagggtacctacatgaccagcatcaagtaaaagtcttggacactgactctctaataagctgccctggtagaaaatatgtcacgtcacacatgtcacaattcattgctgggggaacgaattctgtgactctcctagaaaagaactcctagaaacttgggctgctttcctcaggccattggtccatacaccttttctttgctaagcttgctgtatactttcattgtaataaatcttcatcaccatgagtccagctatatgctgactgtgagtcctgtgagtcctcccagcaaataataaaaaatgggagtggtcttggggacccctgacacagttgtcacaatggttggatttgccagaataagcctgactcactaaaatatggtgaaagccttgtttgagtaaagaaagactgaaggagtagggggtgatgaaggtgctcaggtgattatggccttatgcatactgtgaaacagtagctagcttttgtctcttgtgagaggtaaatgttacttatagattttaaaaagaacacatccaactctgggagacctgaatcactgcattccttggcgtctttcgccatgctggagatggggggtgggaacacagccaggtgaagattttggtgtttttcctttcctccaaatagaagaaaggggctgggaatgcacaaaagtaattttagggtggcgaaaaatgttaaaaatttgggcttctctctcctccaagtggaagggaaaaatattaaatcagttccctgcgctggagcaaagcttagataaaccaagtagagggaaaaggaaaaaatcctccagtcttttcttcagctttgctgctgctactgcagcccctcccagccttccagaaagaatctctcctggcagctatgatgttaaccttataattgcaatgagagccaaaaaaaaaaaggaattaaaagtggctttttaatttatggctgttacatccagatatataataaaagtgatgtgaaatgttatatacttataatgtcataaatgctagagggaccatccccttcagggaaagctggacaggaaaaagattttaatgggatacaacttttttgctttttgactcaggtgaggatattggaatttaaagtcaaatttagctttgaatgttacaaagaaaacgaatctccataataggatttttgctctgatgattgcctttggaacaaggaaggcaacatgaaaagataggcaatgtccaggtggaggtgcacttttagagtttttgaagtggttttcaattgttaatgaactctaatgaaatcagatatctgacccttagagagtgaagatttgtcagccagatgtgcacatttttgagtgggtccattaaattctaaggctgacaagaaaattgggcttaggataattttgcttgttacttcagcttggaacaaggctgtctggttttcagcttcttctttttgctgctgccaaagaaaagtctctttgttttgttttgttttttcatatgctgaattcatagatcctaatggcctggacctcactgtaagctgaaattgatattgtctgctatgggctatttcagcctcagtaggagctgtgcagaacctgaagcaggcacaggctcaatacacaggactctgactctgtaacttttacagaattaaaattttttattttttttttaatcttttgatagagatggggtctccctgtgttgcccaagttggtctcaaactgctgtgctcaagagatcctcctgcttcggcctcccaaaatgctgggattacaggcatgagccaccatgtgtggctgacttttacagattcaagaaacccctctgtaaagacttcaacaatagaaacatcaaggatgcttgctgggccatctgggtcacttgcagttgcccatggaaaagggcttattctctgatgggaccatttacaatctaggggcttatcagctctatttctgatgcaaaggctaattacattcctcatttgttattcctgccgaaactgaagggaaggggagaatatatcacagagagtgactcctccatgcactcctgacagatcagtctctagatctcctctagggaatatgtcactggtattgacttggggttcccctttcttttttgttttctccttcctccttcctcctctctttctttctttctttcctctttccttccttccttccttctccttctccttcttcttcttcttttgacagggcttcactctgtcacccaggctggagtgcagtggtgcaataatagttcactgtggtgtccaccaccctctcaagtgatcctcccacgtcagcctcccaagtagctgggactacaggcacaaaccgccatgcccagctggtgtgtgtgtgtgtgtgtgtgtgtgtgtgtgtgtagacatggggtctcactatgttggccaggctggtctcaaactcctggccacaagggatcatcctgccttggcctcccaaagtgctgggattacaggaatgagccactgcgtcaggacaggttccactttctagactaattgcagtttgcaagtgttgtggctcagaaaacaatatcccagaatggaggcctcagaagcagcctcagaagtaaaagtttttctgtgaccttatcctgccctcttatctctcagtcccattctcccttgaggctagccatagaaactaggatccctcctccccaaactgggtcttagaaaccagaagtccttttctccaagctagtcatcaagcctaaaaatatgattctaattttccctctgtttttctgtgtaaaaaacaggccataaagaaattacctgtcctaccttgttcaactatataagtcataagacacccattccagagagggtcctgccccccatacccagaaggaaggaatgctgctcagaaaggcctagaagaatccagacagacgggtcttgctgggtttccccactcaatctatttgcattagatcataccctttttttccaatcatatttttgcctggctgtccatactttgttgaacctgagcatgaaaatggacaatgtcccctatatttttggatcttaattctgaaggctcccatacatacatattaaataaatttgtatgccttttctcctattaatctgcctcatgtcagggatttccagtgagcctttaaagggccaaggcccatggcccctacataacaaaggactaatagcctgactctgcttccctaacctttctcctggtgcacacactttggtaaggcactttgaccattcaatacagctgtcaccagcaaagcattgaacttttccagcctgctcactaaataaatgatagagacaaaagggataagaagttatgcaaacccatctaaatttgttttaaaatgtgaattttcatcccaatcaatttcagaacatcatgagtattactggttatttattaaattgttttttctgggctgggcacagtggctcatacctgtaattctactgctttgggagctgaggcatgaggatcccttgagcccaggaggtagagactacagagaaccatgattgtaccacagcactccagcctgggtgatgaagcaagaccctgtctcaaaaaaaaaaaaaaaaaaaaaaaaaaacctctatgaaaattattttgttctgcttgcatatgaccatttcagacaaaaggtctagaggagaatcgatgataatagaagaaatggaaagtttcgattacagaatggcacacactgattttctaacaatgaagaaaacacgaaacctgacacctggaaagagtcaagccagagagaggggacgttaatgatctctgtttttcaaaatggtttctgaaaactttccctttttcctgaaaaaacgctccccattcagccatcccaagctactgtaagtatattgaaatcacactgactgctgagcacacaatcacatctgacagagctgcaactagcgaagggacagcaggggcaacccagctcctgaacatcccactcagaacacctacagatgtcatccaggtttgtaaagaggaagaactggtgtcaatggttaacagaacctggactgactgccttctgtcagtccctctgaaaccaaggacacaaatgacttgtttggaatgcacagggaaccctagagggaaaggtcccacagtgggaggccaccctgggggcctttgcaagttcctgcctgactaatgtatgtcctgctgagggtgcacttaaaatggtaaatgttaggtttccagggatataatcatgtacttgcatgtgccccctaactatcctgatactgacttagctatgaaaggccttcacatcagcttcagcttactggccagaggtatgctgagcctgaattggtggcttgggttgggcaaaaaaggttaatgcaaaaatttaagtaggaagtcagctgcctttctaagataaaccttcatggttactgggatttgtattaattggctgtgatggtaaacttgatttgtcaacttgactgggccagagtacacaggtatttgttcaaacaccagactaggtatctctgtgcaggtaattttaaatgagactaacattaaaatcagtagactttgagtaaagcaaattacactccatgatgtgggttggcctcatccaataacttcaaggccttaaagagaaaaaagactgggtttcccccagtgaagaaaatattctgcctgcagactgtctgtgaatttgagctatcttacatgggtctccagaatgatgtcctgccctacataatttggatttgccagcccccacagttgcatgagccagttcctcaacatcaatttcaacaatctctctctctctctttgtctttctctctctctctttctacacacacacacacacacacacacacacacacacacacacacacggaggagcccgaaccaatagggtgcttacatctgggacccttaaagggcataacagagatcagtactgcaggttggtctcactctgctgcatgggttctaaggcagagtgctgtggtgttcccctcccaccctctacagactgacatccgtgtggctcatcactgtgatgcagggtttggccatccaaccattagaaatcactacaattccacaagggttctctgctctccttctgcctgtcatgtactctgttctatccggaagacacagcgatctactggatacgattccaaccttccaggaatgacctgaaaacctggtgagggagatacacttggaaagagaagttcagtgaaataacagcaacaggcatagctggtgtgttcaccaactcatgagagatcacactatcaacatcttccacttgattttccccatcaattaacagcttatcctggaaacaatccctttggtaggtaagttggattcccctcattgtttccccaaggcatgtggagctacaaagcaaactgatactggtatgttgtgtgagagtggagtccaagaatggaatgctctgcagtgatgtgattgccaaagcagtcaattagtctttgtaagttcccagatgaagtaccatttacaagcctctctcagtttacagggagtgacatgtatggaaaatccagtttatttaagactctggaaaaagtcatttgcctcactgtaacactcagtccccaaatgccagtagactccgccaatcattccaacaatcaaagctgccctccaaaatgccccaaagtgggcaatgatattctggccaccactttagaattcataagaagtaccctcaaaactcttatttacatcaaaaggataggaatgttgcagtcggtacaaaggaaataacacagcaccatggagcaggacacaatattcccgagaaaggattgtgggcaccttcctcctctgtgttgctttctgtgattaaaaaaaaagtggttcagggccagctggggtgtgcagtgaagcttcatttcaaaggtcaaccactgccatgggacattgatgctcaggatggttctgtggtagtcataactctggtatcctgagactagtgtccttctcctaggcaagggcagccccaggctggggcacaggagaaaaggcccaggctaggttgtcagtctgctagggacagctgtttgttgtgggatcacagatgagatcaggagaaggacaactgaaaggagaagagaggagaccatctcacactgtccaatatcacactgtcctgattaccatagttaccatacacatcttgaaatcaggtaataagagtcttccaatattctttgtcttttataaaattgttaggctattatattcccttttcttttccatataaattttaaagtcagcttgccaatttctattatagaaacaaaaggctgcaaggattttgattgggtttacattgaatgtatagattatttgagagaaacttatatattgataatcttcagtcttgcaatccattaacatggtatgtctcttcatttatttcagcttgcattaatatttctcagcaatgcttttcagtcaggtcttgcacacattttgttaaattttaccactaaatatttcatggggtttttggtgctatattaagtgatattgatttttaattttcaattgtttgttgctggtatataaaaacagcattgacttttgcatatttatcttgagcatgttactttgctaaactcacatttatgttcaagtcatggaataaattccatttggctatgatgtaaattttttatatattgctagtttttatatattgctaatttttattacacattttgtgtctatgttcatgagttatattggtctgtcatgttattttctcataatgtttggtttcgatatcaggttgacgccagctctgtaaagtgctttggaaagtgtgatctctcaccaattttcatgaagagtttgtgtagaattgacattaattttttttccatctccctttcctggtatggaattgtttcttccacaaacgtttggtggaacgcttggcagaattagccaatgaagtcaccagaaacttgaagtttatttgagaaaaatctttgttttatttatttgttgtttttatgaattccttttatttttatatagatatatatgtcatctatttatttttgaataagttttgttagctagggtcctttgaggaactttcccattaaattaaaaaaatacatttttttgataatatttttcataatgtatcatacatttaatatctgaaggatctgtattgatgtgtcctctagtattctctttctctctatcatcagtctggctaaaagtttattaatttttctgatcttttcaactaaacaacttctggtttcactgatttttttccaattgaagttctcatttctatttaatttatttctcctcatatcttaattaatttttccttcttcttgctttgggtacattttatttttctagtttcctgatgtggaagcttagatagttgatttggaacttttcttcctttttggtgtaagtacttcatgctataagtttccttctatgcactgttttagtttcatcttgcaagttttgatattttgtgtttttatctttaaattttccttgtaatttcttctttgagctctgaattacttaaaagtattgtttaatttctaatatttcatggattccacatatctttctataaataatttctatttcaaatattttgtggtcacagaacatgttttgtaaaatttcgttccttctgaatttgttgaggtttggttttcagcccagaatatcatctgtcttggtgaacattccatttacacttgagaagagtaggtattctactgttgttctgaaaatatcaattaggccaagctggtggatagtgctctctctatatatagatattatatatatatatatatatatatatatatatatatatatatatatatatatgtatatatgtatctatgtctatatatatccatatacatatatatacattattaggctttttctcatttttagggctaaagtgactttctgttgaggctttctgcatcttatgtggaggtagagctctcctttgtcaatattttgactactggtacaaaaatacagcattcaaatatttgaattaaaatataatccagggacaagctgagtatggcttgcaagctaactccagcccatggcttatttctgcacagccttggagataaggatttttttttacattttaaagtatttatatatatatatatctcctgaatttttgtttctaccaattgctaggaggaatgttgaagtcttcaattataactgcagatgtgtctatttcttctttctgatgtatcagtttttctctcatatattttgaagttgcatacatattcatggttttatgccttctcaataaatgcaactctctatgattgttgtgtgatgccccacttcattccttgtaatactctccactataaagtatgctttgtgaggtcttaatttagtacctctagtttttatgtgatttatatttgcaaggtccatcctttacttttaacttatttatttctaactggggttctttttaacagtatataatttgttcttgcttttttttacccagtcttataaactctgactgttttgtttttttttttttgagacaggatctcattctgtctgtgaacatggattccacttgtgtctgagacttccagggattccagctctcccaattgcctgtgtttggcctttatgaatgtgttacattttcagttgtttccttcttacccacttttatggctgtcatttcttccatacatgctgtgccggaggtgacgcagtttgtgtgtctcatctctcctcagaatgacttgtcacccttttatatcatggaacatatatcatgggaacatggctgacttgttagctctctgacgatctaataaaaaactgtaatgtcatacattattaggctttttctcattgttaggggtaaagtgactttctgttgaggctttctgcatcttatgtggaggtagagctctcctttgtcaatattttgactactggtacaaaaatacagtattgaaatatttgaattaaaatataatccagggacaagctgggtatggcttgcaagctaaatccagcccatggcttatttctgcacagccttggagataaggattttttttacactttaaagtattattttttaaaaacacaacaatatgccacagaaacgatgtggcccataaaaactgaagtatttactaccaggccctttaaagaaaaatttggtgaccctgtattcatctaatatctattattctgctttatattattgcatacattttcatccatttatttatttactcacatattgaaaagcatggattactttttgatcttgccctatcccctcaataaagcatccagctttatgatgccatggtctcaatctgggaaacttggcccagggctcaggtgaatacacaaacatatatctgaggtaggagaccggcaggacttgtttctggctataaccctgctgactaaaacaggatctgaattgggaggctgaggtgggaggatcacctcaggtcaggaattcgagaccagcctggccaacatggtgaaaacccatctctactaaaaatacaaaaattagccaggcatagtggcgtgcacctataatcccagctactctggaggctgaggcatgataatcgcttgaacccgtgaggcagaggttgcagtgagccaaaatcgcacggctgcactccagcctgtgtgacagaacgagactctgtctagaaaaaattttaaaaataaaataaaacaggatctgattcagacaggataaagggaagaaactggcagaaactagcagatggccatgagagtgatccctggctgccctccttgcttattagcatgggacgctcccacccagcagcatcatagattacaaatgccttggcaagaacccagaagttacaacagcttgccattgcaatgggctggaagttaccagccctttcctaaagagttcgaaataacctgctcccacccctaaatttgcattaacccgcccttaatatacacgtaattgaaagtgggtataagtgagtagaaatatagttgctaagaccccataggttgctgactcttggtttactgcctatcagttagccctgctctgtaagcagcagtaccattcaataaaagactgctgtctaacaccactagcttacctttgaattctttcctgggtgaagtcaagaatcatcctagattaagccacaatattgaggctcacttgtcctgcagcagtttcataccttggctgttgtaaataatgcttcataaacatgggagtgcagataacttttcaacatactgatttcatgtcctttggatatatatccagtagtgggctagcaattttgagggggaacctccatattcttttcccagtaataatgtacaagtgttccattttctcaccagaactttcatccttttgataataggcactctaacgggtgtgagatgagatctcattggtggtcttcatttggatttccctgatgattagtgatgttgagcattttttcatatacctcttggccctttgtatatcttcttctgagaaatatctattcagatcttttgccttgttttgtcctgcttttgttttgaaataaggtctcaatctatgtcatatgatcaaggctaactgcagtttcgaccttctaaactcaagtgatcttcccacctcagcctcctgagtagctgggactacagaaacgcacctttgctattaaaaacagcaaagtaaaaaggtaattttcacttttttggggagaaagtttctcacaattgttaactgcttggagttgcatagtgtagccaatgccagttttataatgtttttattccaattttaattttagaaatttcttttaaatgtgatattcaatgagtataaggtagaaaaaaataagagggaatttctttcatctcttagctcagtgcccactaagacacatgccacaggtttttggttccttcaggttgttgtaatagttaaaccagagaacccattagtagaagaatcaatgtcattgatgttgctttcacagaaaagggactggctccatagtcatgatagtggagaagtttgggagttagtaaaggagccaacctatgtaagttttgcacaaaaagagttatataaaaatagccaacttctgaaccccatgtacataatgatagatgagaaaatataaatatatttggaagaggctaaggcacatttacagatgacagactcctaagtggctactctgaaaagcagagatatccttgagcattcagagtgatgaacttttgtttcttgtctgctgactgaacaccatgattccttgccttcactgcagtgataaaacgaataaagataaagatgggatagatgtcaggacatgctattacagcaaatatcatagccttctttctggcacaaaaagctacattccattaactttaaccaagcaaaatcagaatccaaggtactctctatcctccacccaccaaatgatacctaaaaaggaaaattgtctttaccaagaaaatgtactcaagatagcacattactatttatttcatcaaagatttgtggttgtatactctgtaaagaaacttaatattaattttcttgatgttaaatattatttcttttctgattaaaaagtagtagatggtttttttagaaaattataaaatatggaatagcagaatcaaaactaacatccacaatttcaccactctgtggtaaacaatttgttgcacttctatccagtcttttataatttactcatctcttaaattgtacacatatatcaaaacatcatattgtaccccataaatatatatataattattatttattaatgaaacatttcttaaaaaagaaaaaaataatgaaagccatcaacaaccttaaaacaatatataaacagaaaaattattctttatataatatgacagtgtaaatattctttgtacacacacacaaaagtcttgaaatgggccgggcgcggtggctcacgcctgtaatcccaacactttgggagggtgaggggcgtggattgctttagctcagtagttcgagaccagtctaggcaacatggtgaaaccctagctatacaaaaattagccgagcgtggtggtgtgcacctgttgtcccagctacttggggagcagagacaggaagattaagccctggaggtataaggtgcagtgagtcatgtttacatggtgagccccagactgggtgataaagtgagatcctgtctcaaaaaagaaaacaaaaaaaaaaacccttgaaatgaaaaaaaaattaaagctcagtggaaataataaaagtaaatataaaaataaagtagaaaattagaacccaaacagttcaaattacaaagatatatgatcacttacacactttctagtaatctgagaataaaaaataaagtaaaaatgacattaaattttctcagtcaaattagaaaacccttaattatttttgaaaaaacaagaaatacccaatggatgtttttcataatgatgcagtaaaatgggtatttttataaatcacccattgctgaaatttttttgtttataattttctgttttataatttttcaacaagcaacatgaaaaactcaagatacaaaagaatgtttttaattatgtttaaaataatttatattaatgtaaagacatatttatgttatcatgcatacattttagaaacattggtccacttaaaaagcacataacattcttccaaatattttcaaactcgcattcgctctcttaatattttatggaactgtcaatctatttcccaactaatcatttgaaacctttttctttgtttctaaacataatattaggagtttttataatcatcattaattatttcagaatgctactctacttatgacaaatatacatttgtactttcacggagtagcagtatagcaacatatttagcatataaatagatttttattcagagttacatctaaaaatattacctatcattgaaagcaaatgctcacatgataaccacaactccaagtgttatggcttgcttatagtactgatgatgtgtcattgattagatatgatggtcacataagaatgataaggatcacacctagtacagggatcccggaaatcttgttggcatcaaatttggctacttggtcttcctaaacatcctaagctgaaagtgaagctgaatagaagatttaggacaagactttgtataaaatgcaaactttgaatgactgtatgcaatgagaaatacgccaataattaaagggatacctgattttaatgagaaagaaaacactacattccctctgtagttttgaagtagaagaaacgcaggacttaattcctggtcccgagaggatgaagtgaagaaacccgcatgaagcagcagatggcgataagagcaatccctagctgcattcattgcttatcagcataaaacagactcatgacagtttacacgacatggcagcattccagaagttaccacccctttccatggcaaccacccagaagttagttactaccactttccatggcaatgacacagaagctggcacccttttcctagaaagttctaaataacccacccctcaatttgcgttaaactgactcataatttaaagtaggtataaacgagtataaatacagttgccaagagcccataggttgctgacttctggctcactgcctgtgacttagccctacttggaaaggagaagtactgttcaataaaagtattgctgtctaacaccaccagctcacacttgaattctctcctgggcaaagccaagaaccctcctgggctaagctccaaatctgggctcacctgtcttgcatcagttataagaggagaacgcttccaaatattccatgattgcatatttctcaagttgatttgttaaaaatctttcatctttgtcatagtcaatgtgtcatttatctaagcattatggcgacataaaagctcaggtgtaacaggaattagtatgattaaaaatttagcaggattattgcccaataagatctaacatcaaatactgatatttaattgcattgaactcctccaattatgtaaggaaaagtttttaagaataaatattcgtgcttgaaaatatctttgaatacatgtaaaatggatcaaaactgaataccacagatgttgctgtcactggatgccaataaagtacataataggaaccataagacacaatcaataataaagggggaaataaaagggaacatatcaaagcaccatcacacgagtgcagaagcacacacatgaacacaccctgcagctgcagaaagacatggtgggaagtaaagccccacaactcatcagccttccttctcaccaactcatgagtccacaagtgagtttgctgagagtcaaatgctcacagtaaaactgacaaatttaaacatcactcagagctatttcaagcattatgtagaaagctacagacaacagtgaacttgctcttagcaagtcttaatctatcatcctcatcaatggctaaagaaattgtccctagacattttgtccaataacttctaaagtaatgaccttcaaactttttaaattacaattcatgggaaatacatagtttgtatataattcagtagggaaataaatatatgtatgtgtatgtgtgtgtgcagtctgtttgaatattctatatgcagtgaatgctatttactaatttattttatctcatttcttcaaaatgctgtttgtggaggacaacgttaatcttatgaaccactatggatgacaaaccagtatggaaaagattaaagccttttcacaagatatcctcaatggttaataagtgttattatagaagtatatgaaaagacacatgagaacccaatgttgtcttcctccttcggaattcagtcttttcagaaaaaaaatggtcgtttttgtttgttttttttttttttgttttgagacagagtctccctctgtcaccccagtcttggctcactgcaacctctgcctcccaggttcaagcgattctcccaccttagcctgccgagtagctgggattacaggactgcactacctcacctggccaacttttgtatttttagtagagatggggtttcacaatgttggccaggctgatctcgaattcctgacctcaagtgatccacccttctcggcctcccaaattgctgggaatacaggtgtgtgcaactgcacttggccaaaaacgtggtctttgatatgggccacaaaggctaccacaaaatatgtaattacagaggaaatgtgtgttccatcagcagataaccatgtctgttttgcacaggtgaagtgttacttggacagacataaaatcacatgcaaaagggacagaaagtacatgtgacctcttgtcctcttggtatcatgaggaggctttgtttgggctgcagcatagctgaatgtcatgaattgcatccattcacgcggacctccctgtgaatgcacagggacctccatttcccttttgtgctcccgctttatgaggcaaataggggagttgcaattaacatggtaggtagtaaataatttgacctcaaccaacaagcaatctgaagagctcaggtgacagtgtttactatggtactctgaaaactgccagctgctcagaatctgtagactttgtcccacccagccacagtcctgtggaaatctcagtttgttcatattccagtgcttggaggatgggaaggtcttgtcatgtggtgaaattgagcccacccacaggtagatgggctgtgttggtcccagctccaacttctcctttagcagccctcagagttgctagcgtcatgtatcaggcaagtcttcttgcctctaaagagtttctcatactttctgctgcttcctgtgagtgtcacaagggctacttcacaacttgctcccatcccaatccaattatgatcctttgaactcatccagctggaccagggtcacctgccatgggaataacaggaggaagctcaaatttgggaggaagttaaaacctgccctttgaagctggagtgtgtccactcaggaatcattaaaatccaggtccttgtgaagcacatccatccagccatctgatggcatgactttgaccatttgctaattcgatgctcacagaaaatctaaacccagatgtcactatctctcattctttgaacatttctgagtgcactatactaaaaaccggagttaataagggaaaaatgcaagtaaaatttagtaatgacaatgtccttgccaagaaaaaacaaaaaagataacagataaactaaataatagtttatgagtgccctcactccttaaataaactttgagaactacaatgactactcaagccactttttggagacagagattgaggaatctcttttttcctactcagggtatttccttaaaaggagtgcagctgtggccaggcacggtggctcacacctgtaatcccagcactttgggaggccgaggtgggcggatcacttgaggtcaggagttcgagaccagcctggcccacatggtgaaactccgtctctactaaaaatacaaaaattagctgggtgtattggcacgtgcctataatcccagctacttgcgaggctgaagcaggagaatcacttgaatctggggggcagatattgcagttagccaaagatcatgccactgcactccagtctggataatagagtgagactccgtctcaaaagaaaaaaaaaaagaagctcaactagatagaatatatagatgtcagttcaacaatatatcctaatttatttataaaaggctacattctgatcagggctcccttcctatccttcccttccatatactattccccacattaactgctaggtaatataaaagtaataagaacaggagtcatggacatagtttactgtctacattaacaagagtttatattccactgtcttcattatcataattttactaatacaggaatctcttaccaaggaaaataaaagtttcaaaaaaactttattgttctttccagcaattgcctgaaagatccatcaactcctcaataaaaagtgtcaaatgacatttttcaatcccaaaactctttgaacccattgcctaaaaagtcttgttgcatccaccaatcctaaatcattgtcattcctacccaattctaaccaaaccatcccccactttaaaatacccactttataccggacatgaaaagcacaacaaatatacccaaagcccttccacatctgacatactagtgcctctgtggaggtagtgctctaccttatagctttatttaaataatgtcagcgctgtcttatgaacaggttatttggctgctatttggggagtagagtatatgatgagcacagtcaccactgctgtacatcatgtcacaataaactaagtttaaatcctaggaccaatgttgtattagtccgttctcatgctgctataaggacatacctgagagtgggtaatttataaaggaaagaggtttaattgactcatagttctgcagggctggggaggcctctggaaacttaacaatcatggaagaagtggaagcaaacacatccttcttcacatggcagcaggagagagaagagtgagcaaaaggggaaaagccccttataaaaccattagatcttgtgaaaacttactcactatcaggggaacagcatgaaggtaaccaccccatgattacattacctcccacagggtcctttccatgacatgtggggattatgggaactacaattcaaggagagatttgggtggggacagagtcaaaccacatcatatgtatggatatttctgaaccatacactgtctgaatgacctacaggtatattcagggaaatcagttaccagtccagagattaaaatgtgcaataataccacctaaaaaaggaagaggtgtgaatttatttagtctacagaagtggttctattcattggtagcatggcagaaaacctcagaccagagaaggaagtgattaatcaaagtatgaataaaaattggccaaggtgggaggatcactcgatcccagaaattgagaccagcctggacaatgtagtgagattctgtctctaagtaaataaataaataaaatagctgggcatggtggcacacacctgtagtcccaactacttcggaggctgcgtcttgagtattgcttatgcccaggagatccaggctgcagtgaggtaaagtcatgccattgccctccatccagggcgacaaagtaacaccctgtctggaaaaaaaaagcatgtataaatataaacattaaaataatttatttctgtcacaaaaggtctttctgagacacatcaaccactaagggtgacatgggactctctgttcccaaagtttctggatgcatgagaatggtaggacaagagagagagaaaaaaaaatatctcttaagtccctttctttctactacaaacatactggggattctggttttgggacagtgggaaaaccctggctggccttgcatgtgcctgactcagtgtgaacgccccttactgcccaagtcccttgttgcccatgcgccttactgtctgccttctgtcccagcagagctgtgcaaagagacatcgtgacttccttctgtcttgccgactaggagtcagccagtaggtctgcagttcagtagtcctagaagtttgagtgtgagtgagtgtgaggaggagcctgcgggcacgatccatggcctcctaggtggaagggctttgaggtccccgtccttctaacacgcagcgatgcagccatggccttgctgtggtgggggtgccggacaagggagggagaaggaccatagatgggaggagggtcaggtaaacaagcagtgagttttgaagggggaaactatttgtggtatttgagtccgcgaggcatatgaaactgcttacagacgatgcattccagagtcctcagtgggaaccagggaggggagggaggactgcatgacgcgggatggggtggggcgaggcggggcactgcagcacacaacgcaggcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatgtgagtgaatgtgaggaggagtgagcgggcttccagagggtcaggcggcgtggtctgtggcctcagagagtaaaaagcttccaggtcataaggaaggtgggccgcggagtgaaggggagccagatgaagatagggtgaatgctcggggtgctgttggaggtatctgagtcccgaaagtgcctggaactcccaatgggacagattccagacttcttggtagggacccaggaatgggctgtgtaagcggtaagaaaggggcctgggaagtgggaatgctatgagctggtgaccgcgaccccgaggtctgtagagctccgggtagaaatgtccagcgaggagcgtccagtgatgtgtcacaacttctcaactccaccctggaggttcgaatgggcgggactgtgctttccaacaaaaccttgattttagggagggaaatcgtccaaacaaatgggtgtgtgacgaaagccgtggtcactgcagttttaattctctagctgtataaacttaaatgtctccactatggagaatccaactgtgaaaccaaatctcatcagaaatatcctgtatcttttgccaggagcattaagacattgctctgctagattgcccaacttaagtggctatgcaagcattcgattcagaagatgtacacacttctagttgccctgggacttactttcaaattatttccaaacttttttaaaaactgaaatttaacatttggccatgaaagtggtcaaatacagctatcctctcaaacacactttcccaatcacagtattctgtttgcagagtgaaatatgagttggcgaggaagatcaacatataggcctaggccaagaagaagtttacagcctcctgagctgattggggctatgcttgtgagtgctttaatattttgatgttttttattagcagaaatttcttttgtgatagtgttgttgaactagtatagatacactgataaaggtcttccatgttgataaaaatgatcatgcatctcatgaaggaaagactaatccaagagtattacaatctgattttgccttcatggataatcttgtgttccccatcatgacttcctcctcatgcttactgataacagattgcacacatccaacccaacatagattaaaatggtttccaaagcctttgagggtaactgtcttagagtaacctctctttgggaagagtaactttgtgaagaataagtatgtggaacagtgttggagaagtgtctttagacttacttgtgattagaaatacctgtgtattctgtatatttgtattattgacatgtattactaacaaaactttttatctgcacacatactgcctcccctttgtcccaggaacccactgatgaagagcctaaagaagagaaaccacccactaaaagtcggaatcctacacctgatcagaagagagaagatgatcagggtgcagctgagattcaaggtgctgggaaaggaaagaaataatgcctatagggggaaggaggcctatgtgtccatcatgccttatgccatgaccagtaataggaggaaagaaaacattaggaaaggatctcaagcacttgctcaaagtaggctggaaaagtgaagagtatagtttgcagcttcatgcagtccctggatataataaatcttctctttttttcaagatttattttgtatgcttgaaaatacatcccttgctaaatcagatgaaactgtttaatttgatgtatcaaaatgtacattatttcacttgattaatttgatcttcttagaatgttgctgtatgattggctcagccatggtgtccacagtgttataagcacccttttatagcatatagagtgccaagtcaccctaccttataacaccctgaataaagcccatttgcatagggatattagccctattttataaaaaggaaatggttgctcagagatagaggcttaccaagaacgcttgagtcatggaggcagaattcatattacgttccaaggtctgtgttcttcctaacatctacgttattagaaaacgtgaattattttgcttaaaacgcttaatactcgaatgtgtctgtactgtaaggtacttgagtattggctcaggagaaaacaaattcagtgaagcaggatagcaaatccggaaaagggctcaatgaatgacagccactgttccctttgatcagtattttttgacagtatgtttggtaaaaggtggatagttcaggacactggcatacaggtaggtatattagtatgctttttaaggaacttttaaaagttgcctaaatacttttataattagaaaactcaaagtatgatacaattatcatgaaacagaaattgtgtcctcaacagatagcattttcaagctaaagttgacggaatttggaccatggattattttagcagttcacggttaagaggtttccagaatatgactgtcaacaacactcattactttctttcactcaatttcctgaattctcatgggaaaactgtgactttttttcctcttatttttggtactatattctcaataggatttatttatgaaaagttacatttagggcctttggacctaagcataattttaattaattttaaccaaataattttcaaattacctcagcaagatatggttgtcacaattgtaagtttttgtcataagcccaggaatacattgatctagtctttcagaaaattatctttgagttattattaaaatgctattcatgcagcaaacttcagatatcttacatagttgatactcactgtttataatgcacactggcaaagtataggaaatgaaggtgtagtgtgatttatccttagattgtcattttatattagatttcaggccaggtacattggctcacacctgtaatcccagcactttggaaggccgaggctggtgggtcccttgagcctgagagttaggaactagcctgggaaacatggggaaacaccagaaaattttctctgccaaaaaaatacaaaaattagccttggtggtggcatgtgcctatagtctcagcctctcacaaggctgagacagggggataacttgagctcaggaggtcagggctgcagtcacctgtgactgcacccctgtactccagcctggatgacagagtgaaaccctgtattaaaaaacaaataaaataggaattcataatacaggaaaacaaaagtgtgacagctttgcatcacatttattatcacactagcctacaggcttttatgtcataactctgtggaatagaatattattacttccttatttatacttcatgtttttgtactcaagttcaataacctttgtattttttagtgcctgacctggaagccgatctccaggagctatgtcagacaaagactggggatggatgtgaaggtggtactgatgtcaaggggaagattctaccaaaagcagagcactttaaaatgccagaagcaggtgtgttattcattaagacacaaagttatgtgatttctattttttacaatattatacttttgatcatagagagataatattactgccactttaataacagtgttcaaatacacactttctttgaaaggtacttcagatcccaatgcctgactgcaagacttaaatgctctcagatacagacacaaattgggtcaaagccatattgaatcatcaaatatgacagcattttcttacttctgagtataaccaacagctaacaattttcagattcttttctaatttctgcttttaacaaatacataatgcatttgtaataccagactgtgtgaaatatgctgagtactgaaggagattctagtagcagctctatgacaatttgtgagaatctggacaaattccataaattctacacccatctttgctgttattgaaaatggtgaatgcagatcaaatgtattaaaatccgtttcaatgctgatttctgcatgctctggttctgttggagagaatagaaagatattctgattcccatgatttgtttttcctaacaatcagcttcagtccaattacaatatctgagctgagatttcattgctcctaagaaaatgagcaggcactctgcttgatgtttgttttccagcatggagacttgaatgagtgttcttggattttgtcaaattctgaattatctggcttttaaagaataattgtattttaaagccttcccaccgtgaagccttgaatgactgaataataaaatggcaagagacagtctactttctgtggccaatgaagtagggagaatgcatgtaggtcagtcatgctcaaggtgggtgtaagatgcctgtgctaagcatgctttttgctctcctgtcagtcttcatgagctactgtgtgtaataaagacacacatgatataatcacctctaaccatatcataggttacatattacaggtttctgccttgagacatcagatgataggacttaaagttcaaagactataatgtactaattcttgagtagtcaacataagtatcttttacacatttttttttataaattgctgactgttaatgagaagagcttctgaatttaaaggaagaactccatgtttagggaagaaattacctaaatgttttactctgcactgctgaaccattccattaaactatttacattaaaagatagttttcaggagccgattgaacaagcctcagttgtattcttaggaagatcacagccttaaatgcacatcttattagaatagatagcaaattacatgataaagtaataatcaatataataataaaagagcaacagaataaacctaatggaaaaggaaagaggtacttaataacagacaggtaggaacctggattttggattaggaaaactaatccaaaagtaatacatttaacacattgtttattttaaaaatagctatgaatagactatctatttgtttctccagtcttgaagaaaatgggaaaagcacaatacagaatatgaagaagacacagatattgaatatgtagtataactgaaagtaaatacattcttttgttttcttttgttttacttttgagacagagtctcgctctgtcacccaggctggagtgcagcagcatgatcttggctgactgcaacctccacttcccaggttcaagtgattctcctgcctcagctgagtagctaggagtacaggcatgcaccaccatgcctggctattttttgtatttttagtagagacgaggtttcgccatgttggacaagctgttctcgaactcctgacctcgggtgatccacttgccttggcctcccaaagtgctgggattacagatgtgagccaccacgcccagctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccaggagcctatttgacatccagaccatagtttcaagccaaaatattaaattgtacattttttataaattcctttgtttcttagtttttttgtgtgtatttgttatatttttagtaaaattatacacaatttttgctttatacattaaatccctttttaagagtttcacttgatttaatgtgttctgacctcggactgtcttttggtttccttgtagcactagaaagcagggtgtgtttaaaaaatattaataatgtatatgtttggaagtttatctccaaagtctccacagaggtctaattgaatgtaagccagagggtgactcttgggtttatggtcttagtccactgtacgaaacaaaaactttggtgtcatttgcatatcttaatgtgatctaaatacagttctgctagtaatgttccacctgttatgtttctattacaggtgaagggaaatcacaggtttaaaggaagataagctgaaacaacacaaactgtttttatattagatattttactttaaaatatcttaataaagttttaagcttttctccaaagaagtcttgcacatcttctgttaatttctttttttctttcttttttttttttttctagatggaattttgctctgtcgccaggctggagtgcagtggcatgatattggctcactgcaacctttgcctcctgggttcaagcaattctcctgcctcagactcctgagtagctgggactacaggcacgttccaccacacctggctaatttttgtatttttagtagagatggggtttcaccatgttggccaggatggtctcaatctcctgacctcgtgatctgcctgccttggtctcccaaagtgctgggattacaggcatgagccaccgtgcccagcctcttctgttaatttcattcccaggtattttgatactattgagaattgtggccaggtgtaatggctcacacctgtaatcccagtaccttgggatgctgaggtaggaggattgctagagctcaggaaagtgacaccagtctggggaatataggaacccctctctactacaatgagtgaatgaatgaatgcaactatagtctcagctactctggaggcataggtgggaggatcccttgagcccaggtggtcgaggatgctggtagtcatgttcacgccacttgcaactccaacctccatgacagagcaagactctgtttcaaaaaaaagtatcatttttgatattttgtattctgagttagctgatacacaagtgtggtatggtgaaatgtatatttggtcattgactgtgcttactggcatacaactcctataaagtgatgtctttttgtatgctagtgagttgaccaatgtctggcagtccctaggagctctaggatgaggaattagagggttgggactttcagccccatgcccaaacttcagggaaggttggggctgaaggttaagttgttcaccaatggcaagccaacattttaatcagtcatgcctacataatgaaaacctccatgaaacccaaaaggacacggttcagagagcttctggctagctgaacacatggagggtagcatgcccgtagaggccatggaaactccctgcccctccctgcatacctcaccctatgtgtcccctcatctgcatcttttctaagggtgttccatttgccacaaaatatgtgagaagtccctaggctatggagctagatgaaagaattagggcctaggtaggagtaagcggcaaggaaccagggcaacttgctgaagcaagatgacgggtcctacctacactgtctccttataggctatggcatgaaatacccatgggattccatcctgcctcttacacactggccttgagggggtgggcaagatattataatctgtgaggcaatgtccccatttctaaagtaggaattagaatatttacactaaatacttgttatgaagaataaatgaaataacatatggattaggcaatacactgtagataaatttggtttattatatttcttcttttaaaatttcaatttttttcattccctttgcctttacaaccacatgtttagtaagtaataactgctcttaaatttcaagtaggggtatcaagttacctttttaaatgaatttgacttctgagacttacttaatttaaataaatatattaattaaaaaccagggtagctggtgtcagacatgacatcaattctaaagttggtttgtgaataaacgcagtctgacaaggccaaccctaagtcaatggaatgtgccgaacactgtgccctttgctgtgtgtgatgccgtgaagaataagtccttctggtcagccaacaccacacaacacaatagtgtgtcaagtgttcaagcagtacacctgtagtggctaacggcagcaaggagccccactgccgttgttagtttggcttgtcacacatccatagatttgaccaataagaagacaatgagcccaaatgggtccaaatggttgattgattgcaggcaaagtaaaagcaaggtcagcattgtgtcagcactgtgtccctagtcccacagtatgacactgaatcggaggtatacaatgacagcacagacggtgggtctctctgcctgtgaggagcccacagctgtaccctaagacagtgagcagttttatactccacagttgtaccctaagatgaggaaaggcccgtgcttaatggaaactaggaaaatggataaagaatggtctcgtgtcaacctccaaccagatagggagctggtgagaaaatacctgtggcagctcccaccacgctgcctatctccccttgcaacaaaaggaatccaggtattcttccaacattcaggttagcctgcagtctggctttgcctacgtgtcctatgtggtgacctgcaagatctccaagacaccatggcagagcctttgccctatagtgtctgacacaaaaccatatgtaaggtgcctagaaacataccatctccaataatgactcctaaatagaggggatgcttttctgttagggtcattacaaaagactgataatttaattcaacagatatgcattgatgactgccatgttataggaaatgtcttggatgctggaaatgagaagaccaaccaacaatatgtggtacttgctgtggaggctgtcacactgttggtggggggaggagggcacctttacagaagacccttaaacagaagagcagctgaagtgcaaaggagaaacacagggaagggacccagggggataaaaacaatgaatgtggtggccaagtagcaggagtaaaacaagacagtttctcgaaaagataatttctccattgcctttgtgccttttctgaaaatcagtttatcatgtctgtgagtccattactggacttcctgctgatctgttgatttttccccaataccacattctcttgattactatagaattaacatgactcttgatattaggtagtgtgagttccccaaagttatacttcagaatggttttggctgttctggctcattttcctttctaggtaactttgaaaatttactccagtgaagttagttgtataagttgaggcagttttcctttgaagggcagcagataaacatgttagtagctacagaaggacatgggagaagaaggtgagttcccccttagctttgggaatgatccaatgtagagggagccattgatggttcaggagaggggagtgatcactgtaggagcaaagcccctgggaaggtggggggtatggatcctgagctgaggtgaggggctggcttcagttaagagcattgtatgtagaagggcaacagagaatgccagggcagacacgggtagactgggtttgggaacctctgataattcccagcagattgcttctgtcctctgaatgaatcactatgtctcaaaaataaacagtgttaatataaaactaacagtcatactgttataggctgagttgtctctgctcaaaattcataccacgcccagccttattttaatactgtctttagtaccatataggctgagttgtgtctgctcaaaattcatatggtgaagtctgaacccctagtgccacagaatgtaactatatttgagataggtgtggtctttaaagaggtaattaagtgaaatggggtcattagagtggtcctaaggcaatttgcctggtgcccttataagaagaggaaatgatgacacacacatgtacagagggaggactaaggcggacaccgggagaaaacagcagactacaaggcaaggagggaggccttagaagaaaccaattctgctgacaccttgatctcagacgtgtagcctccagaattgtgagaaaatacatgtctgttgtttaagccacccagtctgtggtagtttttgatggcagccttaacaaacagatagaaatacttttagtgcccttgtggaggtattattgtatctattttataagctagcactcctgcttcttctactaatgtaataaccatgtaatgatgtctatatctgagcaactgagcagtgatgagagaacttcaaaacctgaattcatgaccaagagagaattacttctcactttcactctcatcctgtttccaataccatattactctcactaaatgccaaaacccctcctcgatttgaatgaggtattttgtgagagtattatagtattggaaatttcttatcatgaagtcacttgttattaaattatatgtgttcagcatcagtaaaaaaatagtatggaagaataatcaagtctcataaaatacacagttatcatggaaatcatactagatttggagtacagtgaaatatgcctgttcaggcaactgcaggagacgtctgccaaacctatctgccccttgaagtcctgagacagatgattagtaggagaatcctgaagccactgcaaacactcacacattcaccattcacacctgccaaaatattccagcattcaccattcacacctgcccaaacgttcccacattcaccattcacacctgcttaagcattctcatgttcgccattcacacctgcccaaacattccatttaccattcacacctcccaagcattttcagattcaccattcacacctgcccaaacattcccgtattgaccatacacacctttgaccattttggggtgaaataagaaaatgacttctacttcccaaatcttttaagaggtgcatattattagcatcacctgggaagctgtggcacaccaccctctgcaagggatcctgggacgggtatttatcaagattctagcagtagccatacaagggagagcagaagagatgggagtgcctgttgttcaaatgcttgtggaaattatacctgccagggttttccatggtctatgttgtgaaagaagcttcctggacagtgaggttcatgtggcgatgtttccatgggccccctgagaatggtttggcaagagagaaaaaaaaagatctcttaagtcattttctttctactagaaatagcctgtggatgtgggtctggggacagcgggaaaaccctggctggccctgcatgtgcctgactctgtgtgtacaccccttgttgcccatgtgccctgctgtcagatcagttgtcccagaagtttcagtgtgagtgagtgtgaggaggagcccgcgggcacagtctatagcctcctaggcagaagggccttgaggttgttgtcctcctaacaggcagcgatgcactgcttgggggtgccggataagggaagaaggagggccatagaggggaggagggcctggtgaacatacagtgagttatgaagggggacactatttgaggtatttgaatccttagagcatatggaactaactgcccaaaaaggatggattccagagtccttagtggataccttggaggaagtggagaatgcagtgaggcagggtaccacagcctacaaggcaggcacccatctcactgcacatgctccttgtacctcagtgggcatgttcactgggcatggtccagtcggccccttcgaccacatggtgaatgccgtggagctgtgagggtgggagggtggcggtcctgtggtctagactctctcctctactgagacacagctggtaggtgcgaaggccagtccccccaggaggtgtagtgtgagtgaatgtgaggagaagccagcagacttcctgagcttcaggcagcctagtccctggcctcagcaggtgaaagccttcgacgtcatgagtaaggtggaccacagagtggaggtagctcaggtgaagatggggcgagtgctgaaggtaatgttggaggtatctgagtcctggaagcccctggaaaccccagtagaagacagattccagactcctcggtggggaaccaggaaggggcagggtgggtgggaaggaacaggcctgggaagtgggaatgctgtgggctggtgacccaggccccgaggtctgtagagtgcccacataggtgtccagtgaggagtggccagtgctgtgtggcaacttcaactcccccatggatgttcgaatgggctgggttgtgcatttcaacaaaacttgattttagagggaaaatgggcctagctaacagatgtgtaacgaaagctgtgttcactccaatttgaattctgtagctgtattttcctatatgtctccactatggaaagtccagttgtgaaactaaacctcatcagaaataccctgtgtcttttgccaggagccttaagacactgctaacttgaccaccttaagtggctttgcaagcattcgattcagaaggcacacacacttaaacttgtcctgggacttactttcaaagtatttccaaattttaataaaattacaagtttacatatggcgatggaagtggtcaaatacagcaatcctctcaagtgcactttcccaatcacagtattctgtttgcagaatgaaatatgagttggcaaggaagatcaacatataagcctagaccaagaggaagtttacagtttcctggactgattgggcttatgctcattagtgccttaacattccatgttttctgttagcagaaatttctatttgtgatagtcttgttgaactagcgtacatatactaataaaggtctgctgctgaaaaatgatcatggcatctcatgaaggaaaggcaagcccaagaggattacattctggttttgtgtggatgaatgatcttgtgttccccagatttcacccatgatttcctccccatgtttattcataacagattacacacattcctcccaacataaattaaaatggcttccaaagcccttgaaggtaactgtcttagagtatgacctccctgtgggaagagtaactttatgaagaataaggatatggaatagtgttggagaaatgtctttagacttatgatgaaaaatatgtattctgtacatttatattattgacatatattgataacagaactttctaatctgcataaacacacacccctcgtcccagcagcccagtgatgaagaacctcaagaagagaaaccacccactgaaagtcaagatcctacacatggtcaggagagagaagaagatcagggtgctgctgagattaaaggtgctgggaagggaaagaaagaatgtctatggtggcggtgggggcagaggaggcctatatgtgcatcatgcattatgccataaacagtaacagaagaaagaaaacattagaaaaggttctcaaacacttgctgaaatgtggctggaaaagtgaagagtgtagtttgcagcttcatgaagtccctggatgcaacgaatcttctctctttttttgaggtttattttgcatgcttaaaaatacagtccttgctaaatcagatgaaaccatttaattttatatatacaaatgtacattatttcactagtttaatttgatgttcttagaatgttgttgtatgattatctcagccatggtgtcaatggtgttgtaagcaccctttaatagcatgtagagtgccaagtaaccctaccctgtaacaccatgaataaagcccatttgcatagggatgttagccccactttataaataagaaaactgaggcttagagattgaggcttaccaagaacccttgactcacggacaaagaattcaaattacatttcaaagtttgtatttgtcctactgtctatgttattagaaaacatgactgattttgcttaaaatgcttaatactcgaatgtgcttctcctgtaaggtacttcagtattggctcaggaaaaggcacagttcagtgatacaggatagcaactccagaaacgagctcaatcaaaagaatactgaccaaaggaaacagccactgttcccttcgatcaatattttttacagtatgtttgggaaaagctggataattcaggatactggcatacaggtatattactatattggctatattagtatggtttttaagggacttttaaaagttgcttcaatacttttataattagacagtttaaagtataataagattgtcatgaaacagaaattatttcctcaaagggtagcattttcaagctaaatactgaccaaatttgggccatggattattttagcaattcactgttaaaaggtttccagaatatgactgtcaacaatgcccattaatttgtttgccctcaggttcccatactctcactgaagacagtgattttgatgttatatttggtacttttggatcccttccttacaccttacacaaaaatcaattcaagatggattaaagacttaaatgttagacctaaaaccataaaaaccctagaagaaaacctaggcattaccattcaggacataggcatgggcaagggcttcatgtctaaaacaccaaaagcaatggcaacaaaagccaaaattgacaaatgcgatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaacgatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaacccttgtggaagtcagtgtggtgattcctcagggatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggataaaaaaccaaacaccgcatattctcactcataggtgggaattgaacaatgagaacacatggacacaggaaggggaacatcacactctggggactgttgttgggtggggaggaggggggagggatagcattgggagatatacctaatgctagatgacgagttagtgggtacagcacaccagcatggcacatgtatacatatgtaacaaacctgcacattgtgcacatgtaccctaaaacttaaagtataataataataaaaaaaaaagtgggaaaaaaagttatatatggggcctttggacctaagcataactttcactaatttttaccccaaaattttcaagttacctaaacaggggatggatgtcagggctataagatttgtcataaacctgccactacattgatctaatccttcagaaagttacatttaatttatgattaaaatgctatccatgcagcaggcttcagatttcctagatatctgatactcactgtttataatacacaatggtaaagtataggaaatggaggtgtagtgtgatttaccctcagattgtcatttaaaataagatttcataatataggaaaacaaagacatgagatctttgcatcacatttattaccacaatagcctacaggattttatttcctaacactgagaaaaacaatattataatttccttatttatcattcttgtttgcctgcttcaattgataccctttaatatttcttagtgcctgacctggaagctgatctcaaggagctgtctcagtcaaagacgggggatgaatggggagatagtccgatgtccaggggaagattctgccaaaatcagatcaatttaaaatgccagaaggcggtatgctgtccattaagatgcaaaattatgtgctttctgttttccacaatattataattttgataatacaaagagagaacattactgcccctttaaaaacagaaagcagagttcaaatgcagacttactttgaaagttagttcagaccacagatgcctaactgcaagatttaaacaccaccagatggagacacaaattgggtcaaagctatattgaatcatcaaatattaaagcattttcttctgagtataaccaagaagcagaatcataagtgggcgccatctgtattctctttgttggactttggtatcaaggttacactagcttcatgaaatgaattgggatataaaacctctttctatgctctggaactgaaatccctgcaagaatgaatcacttggagatagggtttcccatgtgtgtttgtttccagattgcaggtctttttgttttgttttgttttgttttgtttcagctttggacactacttaaaagaaagatagaaggggcagctccaggtttccatgcctttaaactttgtaaggtgcctctcttccctacaaagatgcctctaattatgccgtcactctgaaaactacctgctcctgtttctgtactgacattaacctctgtatacagccagttaaaagttgccactctattaatttgcttacgtaagttttttcggagatacattcttgctaagttgcccaggctgatcttgaactcttggactcaagcaattctccctcctcatcctccaaaagtgctgggattacaggtgacagccaccttgcctggcctgcctacctgattttgatctgtggtgtatgtttttgaatggattgactacactaaagctgtgaatagttaggatgataactgcatttattgagttctttaatggaaataataactcatatttatagattgtctagtatctgttaaccggttatctgagctgtgtttcattatttctgacctcattattaaatccactaaaaaggtgagccagagttttcataaaatttacaataaatgactctagtaagaagcagatatggggattcaaggtctaagttcacagtctttgtgcttcctgaaagtaaatgcttctgaaagtgttgaatgcagaactggtgttgtgtatattgactttagtggtaatctgatgttttcatgtaaatccatggtaatatataaaatacatatattttattgtttaacataaaaggatttgttgttctctcgaagtatttgtcaaaatgtggaacataaacctaacacgggttcccagatgaaatcattgttatgaaagcattttaaaaattaataataacatacctgttttactgtgcaacagaaaaaatataataagaatactaaattcttttgaaatagtttgtgggatggagaaaagaactgatgtctcaatccccatggaaaaatgccacaacatctcctgcaaacatgtcctttctttaaatgatacaaggcagagagggagaaacaccaaacctttctttttcttctgagcctgacagtcaccacatctcaatcagaagcccctgcagctgcctggatccagcctaatatgcctcttcttgtacataatacacgactaacaaccctgagctccatttatatcctcacacccaaaaggataattctccaacaatgggccctactcagaatccacgctgcttagggaggggcagaagaatatacacagcaattatttctccctgttacaaagattttaaaacatttttggatccaaaaggactgaaaagctagggttcaaataaaaagtgagactaaatgtaggggatcccatttgccatggaatatgtgagaagtccctaggctacagagccagatgaagaattaggccctaggtagaagaaaggggaaagcaaccaccacaacttgctgaagcaaaattatttgggtcctagctacattgtccccttatggcacaaaataaccatgggtttccatcatggctctgacatacaggccttgagatggtagacaaggtacttatatcctgtgagatctttactactattgtcactgtcatttatttcattcttgcaattatcttgcaaggtaggaagtagttactgaagctcagaaagttcatctcttgttgaacctcaccaggaatggaagtactagtcaaacatacaaaactcacgtttgtgtttttgagtggagtttaactacgaaagtcagatttgttagatttattatagtgaatttatttgtcattatgttcagcatcaataaataaaatagtaatgaagactcatcaagcccagaaaaaaatccatgcacttacagccaattgatttttgacaaagttatcaaaaacacagagtgagagaagagcagccttcaataagtggtatcaggaaaactgtatatccacatacagaagaatgaaattctaccatcatctcttaccatatgtaaaggtaaacttaagatgaattaaaatcttataatgtaagacccgaatctatgaaactactagaagaaaacacaagaagacaactccatgacattggtctgggcagcgattttttggatatgatcccaaaagcacagggaagaaaaacaaatgtaaacaaatattacaccactacatcctgtacatgtagtggagtaatattatttgaaggcttactgttacttaaagatgcatgtagtaatccatagagcaatccctagaaaacaaagatatgtaactaataagccaatagtggagattaacatggtgtagtataaaatgttcaactcgtctaagagaagggaggaaacagaaaaacctgaataaaaaacagatatgataaataaaaatataaagcaagttggtaatttaaaggtaaactggttccacattaaatttaatttgcttacacttgtctattaaaagtcagagtttggccgggcccagtggctcatgcctctaatcccagcacttcgagaggccaaggccataccagccagggcaacatagtcagaccctgtctctacaaatattaaaaatgaggcaggcatggtggtgcacacctgtagttccagctcctgggggagctgaggtgggaagatagcttgagcccaggaggttgaggctgcagtgagctacgatcacatgactgtactccagcttgggtgacagagcgagaccctgtctcaaatgtaaaacgttagagattgtaagaatggataaaaagagcaagaacaaattatatgctgttaaaaagaaccacagtttaaaaataaagaagttaaaagtaaaggatgttaaaagtaagttcaaagtaaacagttaaaagatataccctgcaaatatgaatcacgtagaaactggaggtgctcaattaatacctcacaaaacacactttatagtggagattattacaatggacaaagtggaacattacataataatcatagagaggtgcattgattcagaagacagaaacaccatgagtatgtatgcaccatcaaaatacatgagggaaaaactgatacatcagaaagaagaaataaatagacacatgtgcatttatagtagaagacttcaacattcatcccagcaatcggtacaaagaatgtagagaaaaatcaggagatatatatatatatatatatatatatatatatatatatatatatatatatatataaaacagggggctttctgtatcctggggaacttgccttagtgaactggaaaaatcgcatcacacgtgggcttggaaaatcagtgcaaggttttattgaatggtggaagtagctctcagattgatggggagctagaaggtggagggagtgggaaggtggtcttcccctggagtcaggccgatcagtggccgaactctcctttgaccactgtggccaaattcctgtcggcaaccacatcactcagccattcaatggcctaccagcatttgctgctgtctgctgttgtgttcttctgccggtgtgttctgccggtgtgttcctctcgatgtccagccacctgtgtctctgcctggtaggatctcggggcttttataggcacaggatgggagcatggtgggccagggtggtcttggaaaatgcaacgttttgacatgaaaatagaaatgcctgtcctcacctaggtccatgggcacaggcccgaggatggagccttcaccagggaccctcctctactcctcccagcacttccctgccccactcttgtatcaacaatatatcaacatttgcaagatgacactagggcagtgtcacagagggaaataatactaataacgccacttctacacaacatcgtagccaaatgggatttactccatgacttgaatatatatatatatatatatatatatatatatatatatatatatatatatgagtttagcaaagtaatatggcacaagataagtatgcaaaagtcaatgctatttttatataccagcaacaaacaattggaaattgaaaatcagtattacttaatatagcagcaaaaaaccccaagaaatatttagtggtaaaatttaacaaaatatgtgcaagaccagtactcagaagcttaaaaatcactgtggagaaatatgtgtgtgtgtatatatatatatatatatatatatatatatatgtagagagagagacagagtctcgctctgtcacccaggctggagtgcagtggcgcaatcttggctcactgcaacctcactgcagagaaatattaaagcaggctgaaacaaatggagcggtatgctacgttaatggattgcaagattgtgaaatgtcagtttctctcaaataatctatacattcagtgtaaacccaaccaaattccatgcagccttttgttttaagaaattggcaagctgacttcaaaatttacgtggaaaagcaaggggactagaatagtctaacaattttataaagaacaaagaatattggaggactcattacctgtttcaagacgttttcacaactatggtaatcaggacagcatgataatggcataagaaaagaaataagggtccaaatctagacctatatattcagattaaattgatttttctatagggtgccaagataattcagtgggaaaaaatgatttattcagggaatggtgctggaacaattggaaattgacatgcaaacaaatgaacctcaacctttgtctcacatcatatacaaaagttgccttaaaatgcatcatagaactaaatgtaaaagccaacgttatcaaactgctagacgaaaacgtaggagaatctgtagcatcatgtaaaactaagataggtaggatatgaaatgcacaaactatgaaatagaaaaatcatgatctttttagtatttatatacttatgtactatccttatccagtcactagttacttttccaagcgctatacaaatcgcatgaagaggtcattagagttctaatttcctagagaaatttccattcaaattttccacacaagttcatgatgatgaaaccccagcattgcatttaggcttcacaataaccctgtgaggagagctgaatattcattacgcttataaaaataagctgtcccccaagctacctagcttcagttcttgagtccctgaagggctaaagtgataatcaaaagatcatccaaagggtcaaatgtactcttgacgttgtctctctggaacatgctccagggaaatgtgggaacaacaacgatataaacagcaaaacaataacagctagaattgattggaaatttatcatatggcaggcgctgtcctgacaactgtacatgtcttaacagtcagtgttctaaactgcccaagaagtagatgactttactagtagtatttccatggtactaatggagaaaggagtcacagagatgttaaggatgtttctcagtgtcacccagcaatgagtggtggagccacaggtcagaggcgtcatgaaaaactctactgtgttgcatatttatgtaaccaagagtaagatccaaaggctattgcaaaatatttagaattttacagtatgagattgcacaggctagagacatttgatttcttcagaaatatttaagagatggagacttgaaaggattggtctgggtatgatttggagacaggccctgagagcatcattagaataacaggcagcatgtcagttttagtctcctcacctgaaggccgtgggttcgtccatcagagaacacaccaaacctgtcccttctataccttcacaaaggagaaagaagctgtgtagcttggaaaggagactattcccctgctccagtagttctcagacaaatttccatgaaaattttaacccaggatcttttaaaaatgcagattccactattcacacccggtgaatctcatgtagtgtggccacagtggtgccttaggatctgggaatttactgcccagcctaggaaacattcagaaaccttattaaatccctttggtttcatgactgcctccaatatacccactcttcccaagactgacgtgaggttgagaagaccgacctgagagcacacaggaacacaagacatgatggacacagtgtaagagtcaccataagggtaaggtagtgcatcttttgagaagaccttataactcctactggtctttcttcccaaaggcctcttcttgtcatgcacagtgaatggaagggtgtcaagaaatgaccttttagatacccaaagggtatgggctcctatcagcaaccattgaacacataggatgggaggtcatgtaatctaccatctccctcccaccagccttgatttctttcttgcactgtcatgtccttccacaggaatctggagcaatgccaggacttagggccaatgtcttctcttcactagcagacacctacctgcacctcacctgaggagatcgtctcccttctcctttcagctatccttctcctgatctcatctgtgatcccacagcaaacagctgtccctagtagcctgatgacctagcctggcccctacctcctgtgtcccagcctggagaaggctgtctttgctgaggagaaaaacaccagtcccaggatcccagagccatgactaccacagaaccatactgagcgtcaatgtcctatggcagtggttgatctttgaaatgaagcttcaccacacaccccagctggcactgaaacactttgtttttaggttgaaagactttgttatttatttatttatttatttttaatgaaaaaatattgggaaactggtggtgtttgttcacatgagtaagttctttcgtggttatttgtgagattttggtgcacccatgacccaagcattatacactgcacccaatttgtagtcttttatccttcacctccttcccatcctttccccctgagtccacaaagtccattctatcattcttatgcatttgcatcctcatagcttagcttccactcatgagtgagaacatatgatatttatttttccattcctgagttacttcacttagaataatagtctccaacctcatccaggtcattatgaattccattaattcattcctttttatgactgagtagtattccatcatatatatatttctttattcatcgattgatgggcatttgggttggttccacatttttttgcaactgcgaatcgtgctgctacaaacaggagtgtgcaagtatctttttcatataacgacttcttttcctctgggtagatacccagtagtgggattgctgaatcaaatggtagttctacttttagttttttaagcaatctgcacactgttttctatagtggttgtattagtttacattcctaccaggagtgtagaagtgttccctgttcactgcatccatgccaacatctactatttttttatttttaaattatggccattcttgcaggagtaaggtggtatcatattgtggttttgatttgcatttccctgatcattagtgatgttgatcattttttcttttttttaattatactttaagttttagggtacatgtgcacaacgtgcaggttagttacatatgtatacatgtgccatgttagtgtgctgcacccattaactcgtcatttaacattaggtatacctcctaatgctatccctcacccctcacccctccccccaccccacaacaggccccggtgtgtgaagctggaaaccatcattctcagcaagctatagcaaggacaaaaaaccaaacaccgcatgttctcactcataggtgggaatcgaacaatgatcattttttcatatgtttgttgaccatttgtatatcttcttttgagaattgtctattcatgtccttagcccactttttgatgggattgttcgattttttcttgctgatttgtttgagattgttgtagattctggatattagtcctttgtcagatgtatagatcatgaagattttctcccactctataggttgtctgtttaatctgccaactgttccttttgccatgcaaaagctctttagtttaattaagtcccagctatttatctttgtttttattgcatttgcttttgggttcttggtcatgaaatccttcccttagccaatgtctaggagggttttttaatgttatcttctaaaatgtttatagtttcaggtcttagatttaagtccttaagccatcttcagctgatttttgtacaaggtgagagatgaggatatagtttcattctcctacatgtggctagccaattatcccagcaccatttgttgaaaagggtgtctttccccactttatgttttgtttgctttgttgaagagcagttggctgtaagtatttgggtttatttctgggttttgtattctgttccattggtctatgtgcctatttttacaccagtattatgctgttttggtgactatggccttatagtatagtttgaaatcagatatgtgatgcctccagatttgttctttttgcttgttcttgctttggctacatgggctccttttttggttccatatgaattttagaatttttttctaattctgtgaagcatgatggtggtattttgatggaaattgcgttgaatttgtagattgcttttggcagtatggtcattttcacaatatggattctacccatctatgatcatgggatgtgtttccatttgttcgtcatccttgatttctttcaacagtgttttgtagttttccttgtagaggtcttttaccttcttggttaggtatattcctaagtattttatttttttgcagctattgtaaaaggggttgagttcttaatttgattctcagcttggtcactgttggtgtataaaagagctatgatttgtgtagattaattttgtatccagaaattgggctgaattcttttatcagttctaggagctttctggagaaatctttaggtattctatgtaaacaatcgtatcaacagcatacagtgacagtttgacttcctctttaccaattttgatgcccttaatttctttctcttctctcattgctctggctaggacttccagtactatgttgaagaggagtggtgagagtgggcatctttgtcttgttccagttctcagagggaatgctttcaactttctcccattcagtattatgttggctgtgggtttttcatgaatggcttttattacattaaagtatgtcctttgtatgccgatttttctgagagttataatcataaagggatgctcgattttgtcaatgctttttctgcatctattgagatgatcatgtgatatttattttttattctgtttatgtggtgtatcacatttattgacttgcatatgttaaaccatccctgcatccctgctatgaaacccacttgatcatggtggaatatctttttggtatgttgttggatttggttagctagtatttttttattattaaactttaagttctagggtacatgtgcacaacatgcaggtttgttacataggtatacatgtgccatgttggtttgctgcacccattaactcgtcatttacattaggtatttctcctagcatctatgttcataagggtattggtctgcagttttcttttttggttatgtccctttctggttttggtattaggatgatactggtttcatagaatgatttagggaggattccctctttatcttgtggaatagtgtcagcaggattggcaccaattcgttgaatgtctggtagaagtctgctgtgaatccttctggtcctggatttttcttttgttgttggtaatattttaattaccatttcaatctcgatgcttcttattggtctgttcacggtatctaattcttcctgatttaagtgagtagggttgtatctttccaggaacttatccatctcttcaaggttttatagtttatgcatgtaaaggtgttcataatagccttaaatgatcttttgtatttctgtgatgtcagttgtaatatctccagtttcatttcttattgagcttattaggattttctctcttcttttcttggttaagcttgctaatggtctatcaattttatcttttcaaagaaccggattttttttcatttatcttttgtatttttttgtttcaatttcatttagttctgctctgatcttggttatttcctttcttctcctgggtgtgggtttggtttgttcttgtttctctagttccttgaggtgtgaccttagattgtctgtgctctttcagactcttggatggaggtgtttaggctacgaactttcctcttagcactgcctttgctgtatcccaggggttttgataggttgtgtctttattgttgttcagtttgaagaatttttaaatttccatcttgatttcatttttgacccaatgatcattcatagcaagttatttaatttccatgtatttgcatgattttgaaggttccttttggagttgattttcagttttattccactgtggcctgagacagtgcttgataaaatttcaatttccttaaatttattgaggctcattttgtggcctatcctatggtctatcttggagcaagttccatgtgctgttgaatagaatgtgtattctgcagttattggatggaatgttctgtatgtattggttaagaacatttgttccagggtataacttaaatccattgtttctttgttgactttctgtcttaatgacctgtctagtgctgttagtggagtgttgaagtcccccaccattactgtgttgctgtctatctcatttcttaggtctattgctaattgttttataaatttgggagctccagcgttaggtgcatacatgtttatgattgtgatattttcctgttggacaaggtcttttatcattatataatgtccctctttgtctttttaaacttctgttgctttaaagtttgttttgtctgatataagaatagctacccctgctcacttttggtgtccatttgtgtgaaatgtctttttccacccctttacctcaaatttgtgcgagtccttctatattaggtgagtctcttgaaggcagcagatagttggttggtgagttcttatccattgtgcaattctgtatcttttatgtggagtatttgggccatttacattcaacgttagtattgagatgtgaggtgtcattccattcattgtgctattcgttgcctgtataccttgattttttgttttgtgtttttgttttttagattgtatttttgttttataagtcctgtgagattaatgctttaagaggttctgttctgatgtgtttccaggatttgtttcaagatttagagttccttttagtagttcttgtagtggtggcttgatcgtgctgaattatctcagcatttgtttgtctgaaaaagactgtatttttccttcatatatgaagcttagtttctctggatacaaaattcttggctgataattgttttgtttgaggaggctgaagatagagccctgatctcttctagcttgtaggctttctgctgagaaatctgttgttaatctgataggttttcctttataggttacttggcacttttttctcacagctcttaagattctttcctttgtcttaactttagataacctgatgacaatatgccttggcggtgatctttttgtgatggatttcccaggtgttctttgtgcttcttgtatttggatgtctagttctctagcaaggctggggaacttttcctcgatggttcccccaaatatgttttccaaacttttagatttctcttcttcctcaggaacaccaactattcttaggtttggtcatttaacataatcccagacttcttggaggctttgttcatattttcttattcttttttctttgtctttgttggattgggttaattcaaagaccttgtctttgagctctgaatttctttcttctacttgttcaattctactgctgagactttccaaagcattttgtatttctgtgtgtccattgtttcctgaagttttgattgttttttatttatgctatctatttcattgaatatttctcccttcacttcttgtatcactttttggatttccttacattgggctttgcctttctctggtgcctgcctcattagcttaataactagcctcttgaatgctttttcaggtaaatcaggggtttcttcttggtttggatccattgctggtgagctaggttgatttctggggtgtgttaaagagccttgttttgtcatatttccagagctggttttctgcttccttctcatttaggctggctctgtcagagggagggtctaggactgaaggctgttgttcagattcttttgtaccacggggtattcccttgatgtagtactctctcaccttcctatggatgtggcttcctgagagctgatctgtagtgattgttatctctcttctggatcaagacacccagcaagtctaccaggctctacgctggtactgggggttgtctgcacagagtcctgtgatgtgaaccatcctgtgatgtgatgttcctaggaggattatggctgtctctactgtgtcacgcaggttgttagaggagtcagggaaagcttgcagtcacaggcctcacccagttcccacacaatctgaagggctggtctcactcccaccgtcccccacccaacagcaccaagtctgtttccaggcagtgggtgagcagggctgagaacttgtcccaggctacctgcctcctagctgtgaaagtaagttggctttccttcttcccctgcctatggaatctgcacaccggattcacaccctcccccaagttctggccaggacacttggatcagttcaaattgttactaagttcagctggagatttccttctttctgtggccttttcccagtgcctctggctgccctcctgaaggactcttgtgaggccaagcagagacgacttgctagggaacacagcacactcacagggctttttctgctgcttcctctactcctgtattttgcttagctctctaaactgactcagctccaggtaaggccagaatcttcttcagtaatctagaccttcagtttccccagtgggagtgtgtgctcagggttgggtgatctccctttcccacttccacagtttgggcactcacagtatttgggatgtctcccaggtcctacaggagcaatccgcttccttcagagggtctgtgggtcctctcagatttcccaatttattcctgcagttgttctggagcaaaaattcatgatgtgagcctccacacactgctctgtccatccgagtcagtgctgcaatctctctttctttgttgttttaattgagacaggatctctttctgtcgctcagcttggagtgcagtggacaaatcatggctcactttcaagctcaagcaatgcttccatctcagcctccctagtacataggactacaggcatgttccaccaaccctggctatgttttataaaattttttgtagagacggggtctccctatgttcccaggctgatgtgagccaccacacctattctggaatcacattcttatcacagaaaacaagacataggaggaaggttcctgcagcccttcctggggagcattgtgttctccttcctggtgccgtgttatttcctctgtgccaaccacaacattcctattcttttgatgtaaataagaagtttgaggatacttattttcaatcctaaacttgtgatttatagccagaatatcatcgcccactttgaggcattttggaaatatctgtgggctgctgctgttgttggaataattggcaggagctactggcatttggggactgagtgttaagtgaggcaaacgtcttgttccagaattttacataaactagattttccatacatgtcacttccttgtaaactgagggaggcttgcatattgcttcatctgggaacatataaagacttatttactgctgtggaaatcacatcactgcagggcatttttttcttggattccactctgtcacaatataccagtatcagtttgctttgtagctgtgcatccctggggcaaatagtgaggggaattcaatttactgaccaatggggtcttttccaggataagttgttagttgatggggaaacttaagtgggagatgttcacagtatgaagtctcatgagttggtgaacaacatcggctatgcccattgctattactgcactgaagttctctttgcaggtgtatctccctcactaggctcccaggtctttcctggaaggttggaaacatacacagtagatcccagtgtcctcaggatggagcatagaatgtgacaggcagaaggcagggaacacttgtggaattgtagtgatctctacatggttggatgaccaaacccagtgtcacagtgatgagccacatggatgtcagtctgcagagggtgggagagacctctgtcttaggagccatgtaggagagtgacacctacctgcattactgatcttggttacaccctttatggatcccagatgtaagcagcctattgattaggcttcttctgtgggtgtgtgcatgggaagaaagagagagattgattgattgattgattgattttgaggaactggctcatggaactctgtgtgctggcatacccaaaccttgcagagcaggatgtcaggctggagacccaaggcagaggtgatatgatacctcaaatctaagggcagcatggagcctgaaattcttgatcttgaggaggaccccagtctttttctctgaaggccttcaagtgattggacgaaggccactccacattgtggagggcaattaagcttacccaaagtctgctgatttaaatgttagttctcatgtaaaaaatacctttcacagagacatctactctgctcaaggtgaacattttttgtgtgtatcgtggcctagcaaagttgacatatcaaacttcccatcacagccatcttatacaaatcctattaatgatggatgtctaccttaggaaggcagattacttcctacctaagattctgtattaaactttttttttggccaggccaagccaccatttcaggctcagcacaactctggccaggaagctgaagctgatgtgaatgccttccagggatgaggcagtgaagggatagtcagggcgcacatgtaagaaaaatctcagagggcataggtgatacccctggactccaagagtttacccttgatagggcaccccccagcaggacatacagttgtcaggcaggagctggccaaggcccccactgtggcctcccactgtgtgacctttccctctaggggttcctcgtccggtccaaataattcatttgcatctttggttttagtgggactctcagaaggcagtcagttcagggtggtcattgacacttgttcctcctcttcacaagcctggatgacatccctaagtgttctacatggaatgttcaggagctgggtcacccctgctgtcccatagtcacagctgtcaggtgtgatcgtgatctcagtattcagtgtggttccagcattggctttagggtatggttgtgggctcctcgcaggcaaggagacccaccacctgtgctgttattttgtacctccaattcagtgtcatactgtgagactagggacacagtgctgacacaatgctgatcttgctttggctgtgccttcaagcaatcaatcacttggatccacttgggctcattttgttcttactggccaaatctatggatatatgacaaatcaaactaagaactgcaatggtgatacctgtggcccttttagccaccgcagggctgcttagggatttcttgagcactttacacactattgtattgaggtgtgtgttgtgttgcctgaccagaatattgacttattccttgtgaaatcacactgatccaggagaacagtttgcagcacatactactgactagcacatactaatgacagcattaatgaacatatttatgtaaatcaaataatcttgggaggtcaaatgcattttaaaatgcaatttggtattttcttacaattccaaagcagttatcacttactatagatgtagctgtaaagacaagtcaaatgaaaaaataaattgtaaaagaaaaatatataactagtaaacaacattatctgcaatgtaatgcctacttagtatattatttcatttattctccatagcaatcatttactgtaaatattctaatttctactttagaaatgtggaaatagtcccacagggtataagtgccttgcccaccatcttgaagcccgagtgttagagccacgatggaaacccatgccaatttcatgctataccctataaggagacagggtagctaggacccaagtcattttgccttagcaagctcccctggttgctctcccctttcttctacctacaccctaattctttcaaccaaccttacagccttgggacttctcacatattttatgtcaaatgggatcccctacacttagtctcactttttttttcaactctatcttttcagtcattttggatcagaatatacattaaaatctctgtaagagggagaaataattgctgattataatcccctgctactccctaaacactgtggattctgagtagggacctttgttggaaaaatatctttttgggtgtgaggatacacatggagctcagagttgcaattggtgtattatttacagtaaaagggatatcaggctggatccaggcagctccaggggcttctgaatgagatgtggtgactgtcagggtgatggagttttatgcagatggaaaaagaggcttggtgcttctccctccctgcctcttaataacttttaaagaaaggtcagaagcgtttgcagaagttattgtggcatttttccatggggactgagaaatcccttctctctgtgttcccacaaactattccaaatggctttagtgttctatttttctgtagcagagtaaaataggcatgttattattaatttttaaaaatgtttttgtaccaatggtttcatctggtaatgtctgttagctctatgtgccatattttgggaaacaccttcttcaagataagaccaaaatcttttatgttgaaaaatgaaaaatatatatattttatatattaccatagatgtgtatgaaaatatgcaattaccaataaaatcaacatatacaacactagttctgtattcaacactttcagaagtatttactttgagaaaacacagactgtgaacttagaacttgaatcctcatatttgcttcttactagagtcatttgttgtaaattttatgaaaactctgactcccctttttaaaggattaaatgaggtcagaaacaatgaaacatagctcagaaaactggctaacagatactgaacactctataaatgtgagttattattcctattcttcttaaagaactaaataaatggagctattgtcctaactattcacagctttggtttagccaatccattcacaatcacataccacagatcaacatcaggtagacagaccagccacggtggcagtcacctgtaatccaagcacttttggaggctgaggagggagaatcacttgagctcaagagttcaagatcagcctgggcaacttagcaagaacacatctctgaaaaaacttatgtaagcaaattaatagagtggcaatttttaactttctgtgtacagaggataatgtcagtacagaaacaggagcagattgttttcagagtgacatcatcattagaggcatctttgtggggaagagaggtgccttacaaagtttaaaggcatggaaatctggagctgccccttctgtctttcttttaagtagtgtccaaagttaaaaaagatatgcaatctcaaacaaacacacatgggaaatcctatctgtaagtgattcactcttgcagacatttcagttcctgagaatagaaagaggttttatatcccaattcatttcatgaagccagtgtaaccttgataccaaagtccaacaaagagaatacagatggcccctgactcctgatgccgccatttaaaatttcttgacttcatgatagtgtgaaaatgaaatgcgttcagtggaaacagttttttgagtagccatataaccactgtgtttttcatctccaggaaaatattcaataaattacatgagacattcaatgttatgataaaataggctttgtgttagatgattttgcacaactgtagagtaatgtaagtgtaactgtaactgtatggtaatataactgtagggtaatgcacaactgtagggtaatgtcaacgtaactgtaactgtagggtaatgggcacttttaaggtaggctaagctaagctataatgtttgctaagttagtgtactgaatgcatcttcaacttacacaattttcaatttatgatggatttattgggacataatgtcatggtaagttaaggagcatctgtacatgaaataaaaatataggctaatgccacttatgaggacatacataaaaatcctaaacaaattagtaaggcatagattattaaaaaaggataatatgttgtgacccatttttttcccctagaaaggcaaggtttgtttaaacatagcaacttaccaatgaaattcaccacgttaacagattaataaaagaaaaagtcctatgatcatctgtgtggatgcactacaagtgcttgatgaaattcaacatctattgaagataaatactcctaggaaatgaggaatacaatggaactctctattgtgataaagtgtatctatattaaaaaacacaggaaacattgtaaaatgttaaaaaaaactttccagtgcctattaggcataagagaaggatggccacaattactggttctattcagcattctattgggtgggtctgtccaatgttgtaaaataggaaaaaggacaaagcgtactgtttgaaatgtcagaaacaagctgttgttattcaaagatgatatgattgtgtaagttgaaattcagaaaggatctagagataaatttggaataagtatatttagcaaggttactggatagaaaaccaataaacaaacactgaatccattgaatggattaaaaaagttttttctctgttcttacctcacaacaattaacatggaagagttttgtgatcaaatgtgtgggggcttttctacacacaccaaacaagcaatgagttttgcagcacacaccagctgggtgtcctctcattcaattctgacacaagctaccttgacatagagtaagattgcacaggttaagggctcagtcccataagatttccctcactacaagccctaggttgtttcacctgtgtttctgacccaccagctataaattgagttttccatgagtcctactcaggttcagtcagttaatttcctacagcatctcacaagactcagggaaacacatacgtttatgggtttattaaaacaggatattagaaaggatgcagataaagagatgcatagagtaaggaatggggaaaggggcaaggagcttccatgccctctacaggcatgctgccctctttgtgttcagctagccagaagctctctgaaccctgtcattttgggttttttggaggttttcattatgtagctatgattgatgaaaccaatggctagccatttttgaccaagttaaccttgagtccctctcatttccctgaaggttaggggtggggctgaaagtcccaaccctctaatcccccatcctagagctacttaggggctgccagccatcagccaactaattagcatacaataagatatcattttttggagattctaaacattttaaaaactgtatgccagtaagcagggtcaaggaccaaatacacatttcacaaaatcacacctgtattagaccattttcacactgctataaagaactacctgagtctggggaactgatgaaggtttaattgactcacagttccacaggcttgacagcaagcataattggaaggcctcaggaagcttacaatcatggaggaagggaaagcaagcacctcttcaaatggaggcaggagaaagcatgaagcgagaagtgccacacacttttaaaccattagagggttggaactttcagccccaacccttgagtactaactgactgtcaggagaacaacaaggaggaaatccactcccatgatccaatcacctcccaccaggtccctctccaaacactgggaacaattaaacatgagatttgggtggtgacacccagccaaaccataccaacacttgtataccaactcaattttcaaaatttcaaaactttgaaatacaaaatttaaagaaatgatacctttactcttgaaaaaatctccctctgtcactcaggctggagttgcagtggcatgaacatgcactgcatcctctacctcctgggctcaagtgatcctcccacctcagcatctggagtagcttgaactacagctacataaatacatacattcagtcaatcatttacttttgtagagaacagggtctcactattttgcccaatctggtgtcagtctcctgagctcaagcaatcctcctgcctcagcatcccaaagtcctcagattacaggtgtaagccactgcacctggccacacttttcagtagtataaaatatgtgaaataaaattaacaaaagatgtgcaagtcttctttgaataaaactgtaaaactttattgagatatttttaagtcaaatatcaaatataaaaaccgtttgcattctttcagcttctcttcatttaaaactgtggttgcccttcacgtgtaacagaaacataacaggagggaatattactagcagaactgtatttagatgacattaaaggtatgcaaagttttggttttatgcaaaagactaaaactgtaagcctaagtgtcaccctatggctaacattcaataagacccctgtagggactttgaagatagacttccatgcatatacagtattaactttttttgaacccaccctgctttctgtgctctacaagaaaaccaaaagacagtctaaggtcagaacacattaaatcaagtgaacctaataaaaagtggctcaaagtggaaagcaaacattgtgtatacatttactaaaaatatcactgatacacaaaacatctaagaaaaaaaggaatttacaaaattgtataatttagtgttttggcttgaaataatagactggatgtttgacaagctcctaggaaacagttaatgtcacatcaggaactgcataagtacattgaatggaaaagcccatactgtatttgtttgtctctgtggcacaaaagtgcaaaaatgtagctttagctagtttacacttctgtggatttcaaggtacagtaactatttgtccaaggttttcacctatcattatgatgtcaatatgaagagtgcctctttttacacctgaaagtattcccttttgtaaaataaattacatggtcacattcgttttaatctatcactatcattttagatagaggcatatatcatgaacaatggggcaaaaaaaaaaagaaatggagggagaggaaaatggaaaaggagagtaagacatctttaaaaggcaaatatttgtttctagaagtaagtgtttctgagtgtcaactggaaaatttcagaagttcctccacagtgtttgtgatgtttagatattcaggtattcctgagatatatttactaatgtatgcattcctagtttatcaaccatttcgtccatattttgaaaatactagagttcaagaatatattcactttcaattataccgtatattgagttctgttagggtcttgttcatattctgtgttgagcttttaccattttcttcaggattatgtaaactattagatactctattcatagctatttttaaaaagaacaacatttcaatttattgcttttggattacgtttccttttcctaatgattcataccttttattcactcctgctttccttttcccttaagtttattctgtgggtcttctattactatttttatttattattatcactttcatttatcctgtaatttgctattttaataagatatgcacttaaggctatgatcttcctaagaatacaatggagccttgttcaatagactcctggaaatcgtctgaaaactatcttttaatgtaaatgtctaacggaatggttcagcagtgcagagtaaacgcatttaggtaatttcttccctaaacatggagtccttcctttacattcagaagctcttctaattaacagtcagcaatttggaaaatatgtgtaaaagatacttatatctactactcgggaattagttccttatggtttttgaactttaaatgctattatctgatgtctcctgcctcagccccccaagtagctgggactacaggcgtgtgccaccatgcccggctaatttttgtatttttagtatagacggggtttcgccatgttggccaggctggtatcaaactcctgacctcaagtgatctgcccacctcagcctcccaaagtgctggaattacaggcatgagccaccacacctggcctgaactctgtttttaaaggagcagtaatgttctctctttgaattatcaaaagtacaatgttatgaacagtgagtatcagctatctaggaatctgaagcctgcttcatgaatagcattttaatcatgatttaaatataattttctgaaggattagatgaaggtattggtgggtctatgacaaacatagtcctgatgcccatcccctgttgaaaatgttttagttaaaattaattaaagttatgcttaggtccaactgtcctatatgtgactttccatatataaatcccattaagaaaaaagtactaaatataatagcaaaaccactgtcttccagtgaaagtatgagaacctgagttcaaagaaattactgggcattgttgacgatcttattctggaaacctcttaagagtgaattgctaaaataattcatggcccaaattctgtcaatgtttagcttgaaaatgctacccattgaggaaataatttgtctcaagataatcttatcacaatctgaattttctaattataatagtatttaaacaacctttaaaagtcccttaaaatcacactaatatatctatctgcatgccagtgtcctgaattatccagcttttccacatatactgccagaaataccaaagaaagggaacagtggctgccattcattgagctcttttctggagttgctatcctgcttcactgaactgtgttttcttgtgaggcaatattgaagtactttaccatacagacacattcgagtattaaacattttaagcaaaatcattcatgttttctaacaacatagatggtaggaacaacgcaaatcttggaatgtaatatgagttctgtctccatgagtcaactcttcttcataggcctcaatctctaagcctcagttttcttatttattatatagaaaggactatattttcaagcatacaaaatacatctcaaacaaaaagagaagattcattatattcagggactgcatgaagctgcaaaatatcctcttcccttttccagccaactgtcagcaattgtttgagatcctttcctaatattttgtttccgcctgttactggtcatggcataatgcatgatgcacacataggcctccttcccccatagacattctttctttcccttcccagcaccttgaatttcagttgtaccctgatctctgtcatgaacaggtgtaggatcctgatttttagtttgtggttcctcttcttgaggctcttcatgactgggctccaggggctaggggtatatatgtgtgtgtgcagataaaaggtttttttcattaatacatgtcaataatataaatatgcagaatacagagttttccctgatcatgaataagtctaaagacatttctacaacactattccataaacctattcttcataaagttattcttcccacagagaggttactctaagacagttacactcaagggcttcggaagccattttaatttatgttgggatgaatttgtgtaatctgttatcaataaacatgaggagagattcaggtgcaaaatctggggagcacagatcatccatccaggcaaaaccagaacataatattcttgggctagtgtttccttatgagatgctatgatcattttttatcagaatgggatacttttatcactgcatctataatagtgcaacaacactaccacaaaaagaaatttctgctaatagaaaacattgaatgttaagtcactcacatgcataggcccaatcagctgaagaggttgtaaatatcatcttggtctaggcctatatgttgatcttcctcgccaactcatatttcactctgcaaacacaatactatgattgggaaaatgcgcttgagaggacagctatatttgaccactttcatggacaaatgttaacttgcaaaatttttttaaaaatttgcaaacactttgaaagtcccagggcaagtataagtgtgtgtgccttctgaatcaaatatttgtaaagccacttaatgtggtcaagctagctgagcaatgtcttaaggctcctggcaaaagacaggatatttccgatgaggtttgatttcacaactgaactctgctctgtggagacatttaggaaaatacagttagagaattaaaactacagtgaccacggcttttgtcacacatccatttgctaggcccatttcctctgtacaatcaagttttgttggaacacacagtcccatttggacatccagggtggagttgtgaagttggcacacagaacagggcactcctcactggacagctcttcagggtgctcaagagatctcgggcctggtcaccagcccgcggggttcccagttcccaggccctttcctaaccatccacctccctgtttcccaggtctccaccaaggggtctggaatgtgtcttctgttgagggttccaggtgctttcaggactaagaaaactccaatagctccccctagcactctcctcatcttcacctgcaccccctccactctgtggcccaccttcctccttcattctgagtgtcccacaaggcccatggcaatgctattacaccaggaaaaggacgaagactcttcaccctccaaggtcagggactatgctgcccaacactccagaagctcactggctcctccccacactcattcagacttcaactcctgggaggactggtctgaggttctaccagctgggtccaaattggggaaaaaggatccagaatgcaggaatgcaaccctcacaccctcacagctccacagagttcaccacgctggcaaagggatcaattggaagatgtccagtgaacatgcattgaggtgggcattcaaggagcatgcaaagtgagattggtgcctggtgcccagcctcacaccagtccatttggcaccctgtagtcctgcactctttcaccccctttcaggtccccattgaggactttggaatccatcctctgtggggggtttcatatgcctccaggattcaaccaccacaaataatttcccccttcaaaactcactccatgttcaccagaacctcctctgctctatgactttccttcctcccctgtccaggccccccaccacagcaaggccatagctgcgtcactgactgttaggagaaaaacggggacctcaaagcccttctccctaggaggtcctggaccatgactacgggctcctcctcacattcactcacacttcaacttctgggaggattgatctgaggatctaccgacttagtcgtagtcagtgagacagaaggaagtcatgatgtctacttgcacagctctgcagaagacagcaaggcgcacgggcaacaagggacttgggcagcaaggggcgtgcacgctgagtcaggcacatacagggcaggccagggttttcccgctgtccccacacccacatccccaggctgtttgtagtagaaagaaagggacttaggagattttttttgtctctctctcttgtccaaccagaaactttgggaacagacagtcccatgtcactcttagtggaggatgtgtctcagaaatatctgtgacaaaaataaggaattttatgtatatatatatatgtgctttttcctcagtgtattgctctgtcacccaggctggagggaggtggcatgaccatacctcactgcaacctctatctcctgggctcaagcaatcctcatgctgcagccctctgagtagttgggaatatgggtgggtgccaccatgcccagctaatttatttatttttttagatgcaaggtctcactgtgttgctcaggctggtctcaaatacatggactcaagtgatcctcccacctccgccaatttttatacatgccctgattaatcacttccttctctggttcagggttttctgtcatgtgcacaatgagtttgactatctgtatactcaataaattcacaccattttactttttaaggttgtgttgttgcacatttacatctctagactggtaactgtttttttctgaattttcctgtagatcattcaggcaatagggttctgaaatatccatagatattgatcgtagcttctaggctcagtctactgtgatatgatgcacagcagtggtgactatgctcatcatatactcccaaatatcagccaaacaacctgttcataagacagtactgacattatttgcataacgctgtaagaaagagcactacctcgacagagacactcgtatgtcacacatgtggaagggctttaggtatatttattctgattttggagtctggtgtgaagtgcattttttaaagtgggggatggtttggttagaattcggtaggaatcataataattgaggattggtgaacacaacaagaggaggatttttagacaaagggttcaaagagctttggcattgagaaatgtcgtttgacacattttactgaggagttgatggatctttcaggcagttgctggaatgaacaatagttttgttttttttttttttacaacttttattttccttggcaagggattcctgtattactaaagttacattgatgaagccagtggagtataaactctcatttatgtagatagtaagctgtgtgcatgattcctcttcttattacttttatattattcccagttttatatgagaaatagtatatagaagagaaggataagaagggggccctgatcagaatgtagcttgttgtaaacaaattaggatatattgttgaattgactcctatatattccatctagctgggctccttttaaggaaataccttgagaaggaaatgtgtggttcctcagtccctccctccctctctgtaaaaagcagcttgagtaagaattgtggttcttcaaagtttttttaaggagtgagagtagtcataatcctgatctattattaatttgtcttttatctttttggttcttttttggcaagaacaccattaaattttactttcttttgtcccgtattaactctagtttttagtatagtgcactcataggttctcaaagaatggatttagactttctgtgagcaactcattagcaaatggtcaaggtcatgtcatcagatggctggacggttctgcttcacaaggacctggaatttaatgattgctgaatggctccactccagcttcaaaggccaggctttaacctcatgccaaatgtgagcttcctcctgccattcctgtgggagacaacccaggaccaagtggatgggttaaaggatcataatggattgggatgggagcaagttgtgaagtagcccttgcaacacacaggaaacagcagaaaatatgaaagatactgtagagacaagaagagttgtctaatacatgaccctagcaactctagctgctaagggaagagtcagagctgggaccagcacagccggtctacctgtgggagggctcaatttcccacatgactagagcttcccatacttcaagcacaggaatctctgaacaaatttggatttcaacaggatggtaagtggacaaagtctacagattctgaggagttagcaattttcagagtattgtagtgaacattgtcacctgaactcagaatgcttggtgattgaggtcaaattatttactacctatcatgttaagtggaagtctcctacttgcctcataaaaggggagcagagtagggaaatggaggtccctgtgaataaatgcatttagctatgctgcagcccaagtgaagcctccacatgaggccgagaggacaagaggtcacatgtacttgctgtctcttttgtctgtgagttcttgtctgtccaagtaacacttcacatgtacaaaacagacacagttatctgcagatggaacacacatttcatcagtaattacatattttgtggtagcctttgtggtccacataaaagacgacctttttgtctgaaaagactgaattcccaaggagggggcaaaattgggttcccgtgtgtatttgcctatacttttttttttttttttgagatggaatctggctctgttgcccaggctggagtgcaatggcgggatctcggctcactgcaacctccacgtcccgagttcaagcgattctcctgcctcagcctcctgagtagctgggactacaggcacgtgtcaccatgcccagctaatttttatattcttcgtagaggtggggtttcaccattttggccaggatggtttcgatctcttgatctcgtgatctgcctgccttggcctcccaaagtgctgggattacaggcgtgagccactgcacccggcctgcatatacttctataacagcatttattagccattgaggatgttctgtgaaaaggattaaatattttccatgctggtttgtcatccatagtggttcctaagacacatgttgccagccacaaacagcattttaaagaaatgagataaaataaaatagtaaatagcatttattgcatatagaatatttaaatagactgcacaccaacatacacatgcacatatttatttgcctagtagaatatacacaaatggtgtatttctcatgcattgtaactgtgtatttctcatgcattgcaataaacattttgaagttcactactttagccattatcagacaaaatgtctagaagccagttctttaggcttctgtgaagatgatggattaagacctgctcagaataagttcactgttgtctgtagctttctacataatgcttgaaatatatctcagttatgtttatattggtcagttttactgtggtcatttgaccctcagtaaacaaatttgtgaactcctgagttggtgagaaggaaggctgatgagttgtggggctctacttcctaccatgtgtttctgcagctgcagggtgtgttcatgtgtgtgcttctgcactcatctgatggtgctttgatgtgcttctttcatttccctcctgttattgttgactgtgtcttatggttcctattatgtacttcattagcatccagtgacaatgacatctgtggtattcagtgttgatccattttacatgtatttcaaaatattttcaagcatgaatatttatttttaccaactttcctttaagtacttggagaagtccagtgcaattcaatattagtatttgatgttagatcttactgggctataatcctgctaaatttccaatcatactaagtgttgctacacccaagcttttatgtcaccataatgcttcgatatataacacattgaccaagacatagttgtaagattctgagatattcactttttaaatttcctacttttaagttcaggcatacaaatgcaggaggaggtgcaggtttgttacataggtaaatgtgtgccatggtggttgcctgcacagatcatcccatcacccaggtattaagaccagcatccattagctattcttcctgatcctctccatctgctcactccctgctctttgctaggacccaatcaatgcatgttgttcccccagatgtgtccatgtgttttcatcatttggctctcacttttaagtgagaacatgcagtatttggttttctgttcctgctttagtttgctaaggataatggcctttacctccaaccatatccctgcaaagaatatgatctgattcatttttatggctgaatagtattttatggtgtatatgtaccatattttctttatccagtccaccactgatgggattgatacatcaagtatcacaataacacgtggtacttgctgtgagggctatcatattgtgatggggcagacagacccttacagagaaaagcagctgaaatacaaaggagaaacacagggaagggacccaggagaataaataaacagtaaatgcagtggccatgaagcaggaagaaaacaatacaatttcttgaaaagataatctttctcctttgcctttgcacctcttctgaaaatcaatttttaatgtctgtgagtctattgctggactctattctaatctgttgggatttttcccaataccacactgtcttgattactatagaattaacataattgatgtatgaggctggatgattaaaatcatcataataaaataataagtaaataaataaataaaattaatatgaatcttgtcattttgtagtgtgagtttcccaaagttatgcttcaaaattgttttgtcctggttcattttcctttctagataatttacttcaatgtagtgggttgtttacattgatgcagttcttccttcaatggcagcagataaatgcattagtagctactgagtgacacgggggaagaaggtgagttccaccttagcttgaggaatgatccaatatagagggagcagttgatgcttcaggagagagaagtagatcactgcaggagcagagcccctgagaaggtgggaggcgtgggatcctgagctgaggtgagggggctggcttcagttaggagcattctatgcagaaggatgggagataatttgagggaatcactgaaagcgagggtggtcttggggatccctgacacaatagcagcagcagtgtgattcaccagcaagaccatgactcactataaaatgtgaaatccttcttccaataaaggaagagtgaaggggtagagatgatgaagctgtaacaccttggagactatggatttccccataatgtgaagcagctgccgacctgctatctgttagaaacacatgtactcccagcatttaacaataatccctccaactgcaagagagggggctcactggatccctcgtccgcagttctgtgctggataatttaagggggaaaagtgcagccagatgctgactttggcttttcttttcttctaaaggcaggtaaggaaaggacccatacgttaccaaaggtgagctttgtgtaggccaaaaatgttaaaagtttgaatttctctttcctccaagtgggaggaaaataatcagtttcctggacttctgtaaagccttagatcaaccttaagccttagataaatgaaaaaaagcagggagcggggcggggggaaggccgcatgcaatggctcacacctgtaatcccagcattttgggaggctgaagcatgagaatcacttgagaccaggagttcaagaccagcctgggcaacatagtgaggccaggccaaaattttaaaaattagctgggcatggtggcatagcctgtagtcccacctactcaggaatgtgaggcgggaggattgctggagcccagaagcccgaggtagcttaagttatgatcccgccagtgcaccccagcctgggcaacagagggaaaccctgtttcaaaaaggaggttgggggagtgtgaagacacattccggccttgtcttcagctgggctaccgctgctgcagccccctcccaaacatttgagccaggatccctcttggccatggtacttgtgactctgtaatgctgaatttagtgctagcagtttgaaggaaatttccatgagaagaaaaaagggggaagttttaaactggccttgcatcttgtggctattacatctggatgtgtgatgatattgacggaagaggtccggcagtttgactactcagtgaagcagccacaaaccagggagtgatgttttccatgcttctcactggataaatgatagagaaaaaagggatggagtttctgtaaacccattttttgaattttgacaaattcaagatttcatcttgactatttcttaaacatgatgaatcttttcacctaaattatattaaaatacttttttctgaaaatccttttgtccctcttgcagagaactcttccagaaaaagaggtctagagaaaggaaggggatgattaaagaagtaaaatgtttgcatcacaaaatggtatatggtgatttttaacaattggagaaaacatgaaacctggcaataaggagaggcaaaggagggagggaggacattagttgtctctgtttttcaaaattgttgctaaaaactctccacttttcctcaataaatactttccatacaggctttccaagccactgtgagccaacgttgaaatcacactgactgctgagcccacaatcacctacaggtattcagggatttcagttaccagtccagagatttaaatgtgcaataacacaatgtaaaaaagtaaagaggcatgaatgtattgagtctacagaaatatagttaaattcattgtatgcatggaagaaaacccagaaccggagaaggaagtgattaatcaacgcatgtataaaaattggcccaggtgggaagatcacttgagcccacgtatttgagaccagcctgagcaacacagtgaggccccgcatctaaaaaaataaataaataaataataaaaataataaacattaaataaattagctgggcatggtggcgtccacctgtattcccaactactcaggaggctgcagcatgaggattgcttgagcccaggagatggaagctgcaatgaggtatggtcatgccaccgctctccagcctgggcaagaaagcaacaccctgaaaaaaaagcatgtgtaaatatggacataaaattccttatttctgtcacagatctgagacacatcctccactaagggtgacataggactgtctgttcccaaagtttctggatgcatgagaatagttgggcaagagggagaaaaaaaaactggccgggtgtggtgactcatgcttgtaatcccagcactttggagggccaaggcagggggatcacctgtcaggagttcaagaccagcctggccaacatggtgaaaccccgtctctactaaaagacaaaaaattagccgggcgtggtggcgcacacctgtattcccagctactctggaggctgaggcaggagaattgcttgagcccaggaagcagaggttgcagtgagctgagatcatgccaccgcactccagctgggcaacagagcaagactctaaaaacaaaaacaaaatctcaacttcctttctttctactacaaacaacctggggatgtgggtctggagacagcaggaaagccctggccggccctgcatgtgcctgactcaatgtgcatgctccttgctgcccaactcccttgttgcccgtgcactgtgctgtctgccttctgtccctgcagagctgggcgaggagatgtcgtgacttccttctgttgtaccaactacaaataagtcggtagatgctcacgtcaatcctaccagaaagttgaagtgtgagtgagtgtgaggaggagcccgtgggtgtggtccatggcttcctagggagaagggccttgaggtccttatccttctcctaacaggcagtgatgcagccatgggcttggtgtcatgggcagcccagacgcgggagtaaggagggccatagaggggaggaatgtcaagtgaacatggagtatttttgctgttgttgtttgtttttgtttttgagacagggtctcactgtgccacctaggctagagtgcaggggcatgatcatggttcactgcagcctcaacctcctgggctcaggtgatccttccacctcagcctcccacatagctggaactgctggcaggcacaaccatgctcagctaattttttgtatttttagtggagaaggggtttcaccatgttgcccaggctagtctcaaactcctggtagagtgagttttgagcagggaaactatgtgtgttatttgagtaccagaggcatatgaaactgctcacagaggacagattcagaaatgctcatttgggacctgggagagagcagaggacggcagcgggggatagagtattgtgaggtgggtcaccagagcccacaaggcaggcaccaatctcactgtgcatgcttcttgggggctggcctcagggcacatgttcattatgtgtcttcccgtgggccccttcacccacgtggtgaacgcggggaagctgtgaaggtgtaaaggtcaccgttccagcagtctggactctttctcccctactgagactcagctggtaggtctgcaggccagtcctcccagaagttgaagtgtgaatgagtgtgaggaggagtcagtaagctttggaagggtcgggtgatgtggtccctggcttacagggagaagagtttcaagttcatcgtcctcctcttgtgggggcgccgccatgggccctattgtggggagtgtcagaatgagggaggaaggaaggctgcagacaggggatgtggggtcaggtgaacatgggggtgctgttgtgggtatctgagtgccagaagggcctggaacccccgacagaggacagattccacattcctcggtggggacccacgaaagggtggcgtgggcactaaggaaggagcctggaaactcggaacgctgcaggctaatgaccatggctccaaggtctgcagagcttctgataaaggtgtccagtaaggagcgcccagtgctgtgtgacagcttctcaactccaccctggagtttctaatgggcagggctgtgcattccaatgaaacttgattttgggggaggtgtaaaatgggcctagaaaatgggtgtgtgatgaaagcagtggtcactccaattttaattctctaggtgtgtaaacttaaatgtctccacaatggaaagtccagttgtgaaaccaaacctgattggaaatactgtgtgtctcttgccagaagccttaagacattgctcaactagcttgaccaacttaaatgattgtgcaagcattctattcagaaggctcacacacttataactgctctaaaacatactttcaaagtatttccattcttcaaaaaaaaaacaagttaacatttgtccacggatgtggacaaatatagctatcctctcaagtgcattttcccaatcacagtactctgtttgcagagtgaaatatgagttggtgaggaagatcaacatataggcttacaccaaagtaatatttacaacctcttcacatgattgggcttctccttatgagtgacttaatattcaatgttttctactaggagcaatttctttttgtggtagtgttgttgaaccagtatagatacactgataaagttctcccatgttgataaaaagtgattgtggcgtctcatgaaggaaagagtaacccaagaggtctacatcctggttttgcctgaatgtgtgaacttgttttccccagatttgactggtgatttcctcctcatgcttattcatagagcattacacacattcaacccaacataaataaaaatggctacccaagctgttgagggtaacagtcttagagtaacctctctatgggaagagtaactttatgaagaataagtatgtggaatagtgttgggatagtgttggagcatgtctttaaacatgcatatgattagaagtatctatgtaatctgtattcatattattcacaggcattgataagaaattttttatttgcacacacacacgcacacacacacaaacacacacacgaacacgtgtgcatgcgcacacacacaccccttgtcccaggagcccagtgtgccagagcctcaacaagaagaaccaccagctgaaagttgggatcctacacctggtcagaagagagaagaagatcagggtgcagctgagattcaaggtgctgggaagggaaaaaaagaatgtttattgggagaaggaggcctatatgggcatcatggcttatgccatgaccagtaacaggaggaaagaaaacatgaggaaaggatctcaaacatttgctgagagttggctggaaaggtgacaggcatagtttgcagcttcctgcagtccctggatatgatgattcttctctttttcttcgagatgcattttgtaggcttgaaaatacagtccttcctaaatcagataaaaccatttaattggttgtataaaaatgtacattatttcactagtttaatttgatcttcttaggatgttgcagtgtgacctcctcagccatgctgtccacagtgttgtaagcaccctttaatagcatgtggagtgccaagtcaccctaccttataacaccctgaataaagcccacttgcaaagggatgttagcttcattttataaataagaaaaatgaggccagacagcgcagtggctcacgcctgtaatcccagcactttgagaggcctatgcgggataacctgaggtcaggagtccgagatcagcctggccaatatggtgaaaccccgtctctactgaaaatacaaaaattagctgggcatggtggcacacccccgtaatcccagctattaagcaggctgaggcaggagaatcccctgagcctgggcgacggaggttgcagtgagccaagattgtgccactgcactccagagcaagtgggtgacaaagactccgtttcaaaataaatacataaataaatgaataaaaaatgaataagaaaactgagcctcagagattgagacttaccaagaacaattgactcatggagaaggaattcatatttttgttccaaggtttgcattcttcctaccatctatgttagaaaatgtgaatgattttgcttaaaaatatttaatactcaaaagcatctgtattgtaaggtacttcactattggctcaggacaaaatgcagttcagtgaagcaactccagaaactagggcagtgaatgaaagccactgtttctttgaggtgtatttttgacagtatgtttggtaaaaagctggataattcaggacactggcatacaggtaactatattagtaggattttcaaggggcttttaaaagttgtttcaatatttttataattagaaaactcaaagtacgataagattatcatgaaacagaaattgttttttcaacggatagcattttcaaactaaagatagacagaatttgggccatggattattttagcaattcactgttaaggggtttccagaatatgcctgtcaacaatacccattgatttctttgcacttcagttcccatactctcactggaagacagtgattttgctgttacattgcatacatttttcttagtgacattcatgtatggaaagttacatgaagggcatttggacctaagcattactttaattaagtttaaccccaacattttcaaggtacctcaacagggtatgagtgtcagaactataagatttttcctaggcccaccaatacatcgatctaatcatagaaatttacatttaagttttgattaaaatgttatccatggggcagtcttcagatttccaaggtagctgtgtgtgtataatatacaatggtaaagtatgggaaatgtaggtgtgctgagacttatcctccctgaaatgactgccttctgacagttcccctaaaccaaagatgcaaatcagttgtttggactggacgaggaaccttagagggaaaggtccctcagtgggaggccatatcgggggccttggccagctcctgcctgatgactgtatgtcctgctgggggtgccctaacaagggtaaactcttggtgtccaggggtatcacctgtgccccgtgggattgttcttacctgtattccctgactagcccatcactgcctcatccctggaaggcattcacatcagcttcagcttcctggcaagagctgtgctgagcctgaaatggtggcttgggctggacaaaaatacagaatcttagttaggaagtcacctgtctttgtcagatagaccttcaccattaataggatttgtataagatggctgtgatgggaaatctgatgtgtcaactttgctaggccacgatacatgagaaatgttcactttgaccagggtatatgtctctgtgaagggttttctttacatgagaactagcatttaaatcagcagacttcaagtaaacctaattgccttacccaatgtgggtgggcctcatccagtcccttgaaggccttcagagaagaagactggggtcctcctcaagttgaagaaattctgcctccaccctgcccttggatttgggctctcatatcacctctgccctggctctccagcctgacatcctgctctgggagatttggacttgccagtcgcaacagctgcatgagctaggtcttcaaaaccgctcccccgtctctctctctctctctctccacacacacacacacacacacccagaggaaccctaacaaatagggtgcttatatctgggacccttgaagggcataactgagatcagtactgaaggttggtctcactctgctgcatggcttctaaggcagaggcctgttgcgttcccctcccaccctctgcagactgacatccatgtggctcatcactgtgactcagggtttggtcatccaaccatgcagaggtcactacaattccacaagtgttccctgccctccttctgcctatgaggtcctctgtcccatcctgaggacacagagatctactgggtatgtttccagtcttccaggaaggagccaggagcctggtgagggagatacacctgcagcagcagtaacagcaaggggcatagccagtgtgttcacaaactcatgagagatcacattaccaacatctcccacttaagtttccccatcaactaacagcttatcctgaaattatcatgttcgtaggtaagttggattccccttattctattggcccccaatatgcacagatacaaaaaaactgatactggaatattctgtcagagtgaaatccaagaatggaatgccttgctgtgatgtgattttcgaagcaatcaataaggctttataagttcccagatgaagcaacatacaggcctccctcagtttaaagggagtgacatgtatgggaaatccagtttattgaagactctggaaaaagacgtttgcctgcctgtaacactcagtacccaaatgcaagtagcacctgccaatcattccaaaaactgcagctgccctcagaaatttctaaaatgccccaaagtggccgaagatattctggctataaaccacaagtttaggattgaaaagaagtatcctcaaacttcttatttacatcaaaagaataggaatgttgccgttggtacagagaaaatagcagggtagcgtggagaaggacacaatgttccccaggagggtttgcaggcaccttcctcctctgtcctgctttctgtgataagaaagtcgttcagggataggtgaggtggctcctacctctaatagaggttgaggagtgagtattgcttgaacccaggagtgtgagatcagcctgggcaacataaggacaccccacctctacaaaaaaaaaattggccgtgggcggtggagcctccatgtagtgaaactacttgggaggctgagatggaaggatcacttcagcctgggaggttagggctgcactgagtcatgatttttccactgcattccaggctgagtgacagacccggtctgaaacagcaacaacaagtggtttggggccagctggggtgtgccgggaagcttatcctggaaaagatactgttgctaggtaagttggattcccttcatttttaccccaggcatgcagagctactaagcaaactgatactggaatgttgtgtcagggtgggatccaagaatggaatggcctgcagtgatgtgattttccaaagcagtcaataagtctttcataactttccagatgaagcaacataccagcctccctcagtttgcaggggagtgacatgtatggaaaatctagtttacttaaaactctggaaaatgatctttgcctccctgtaacgctcagtccccaaatgccagtagctcctacccatcattccaacaaccacagctgcactcggaaacaaccaaaatgtttcaaagtagacaatgatattctggctataaaccatgagtttaggattgaaaagaagtatcctcacacttcttatttacatcaaaagagtaggaatattgcggccagtacagaggaaataacaaggcaccaaggaggaggacacaatgttctccaggaggggttacaggcaactccctcctctgtcttgctttgcttttagtgacaagaaagtggttcagggataggcatggtgtctcaagccagcctggggaacatagggagaccaccatattaaagaaatttaaaaaaaacagccaggcgtggtggagcatgcctgtagtctcagctactttggaggctgaggtggaagcatcacttgagcctaggagtgagccatgattgctctactgcaccgcaggctgagaaagagagtgggaccccatttcaaacaaaacaaaaataagagaaagtgtttcagggccagctggggtctgtggtgaagcttcatttcaaaagtcaatcactgctattggacattgatgctcaggatgtttccttggtagtcatagttctgagatcccaggactgatgtccttctcggcaaggacagccctctccaggctggggcacaggaggaaggtgccaggctaggttgtcaagctaccatggacagctgtctgctgtagaatcacagatgagaacaggaaaagaacagctgaaaggaggagaagggagacaacttctgcagttgaggagcaggtgcctgttagtgaagggaagacattggccctaagtcctgacattgctctaggctcccatggaaggacatgatggtgccaagcagaatccaaggctggtgggaggagcagaatagctgggaacacctcccacctatgcgttcaatggtccctgagaggagcccatgccattttggaatctgaaaggttattttttgacattccctccattcaccgcccatgaagagaagggatttgagataaactgaggccttcagggagaaaggccagatggagttgtgaggccttctcaaaagtctgtctgccccacccttatggtgagtctcactgcgctcatcttgtcctgtgttcctctttgctctgatgtcgatctcctcaacctcatgtctgtcctgggaagagtaggtatattgcagacagtcttgctacctaagcaatttaataaggtttctgaaagttcccaagcctgagcagtaaattccaagatcctaggacaccattgtggccacgctacatgagattcgccaggtgtgaatcgtggaatcttcattttaaaggatcctggcttgcaaccttaatggaaacttgtctgagaactagtagcagagcagaataatctgctttcccagcaagacagcttctttctcctttgtgaaggtatagaagggacaggtttggtgtgttctctgatgtacaaatccaagaccttcaggtgaggagaccgacactgacgtgctgcctgttatggtaatgacacactcagggcaccatctccaaatgatacccaggccgatcctttcaagtctccatctcttaactatttccgaagaaatcgaatgtctcttgcctgtgcagtctcatgctatgaaatcctaaatattttgcaatagcctttggaccttactcttgattccacaaatatgcagcacagtagagttttacatgatgtctctgacctgtggctccagcactcactgctgggtgacactgagaaagttacttaacatctctgtgattcctttctccattagtaccattgaaatactactagtaattgcatctacttcttggggcagtttagatcactgactgtgtgaagacatgcacagttgtcaggactgtccctggcacattgtcagtttccaatgatttctagctgttactgttttgctgtttatattgttgttgttcccacatttccctggagcatgttccagagatacaatgtcacgactacctttgaccccttcgatgatcttttgattatcactttatttcctcagggactcaaggactgagtctgtggggcagggcgaggccatatttttaagagcataatgaatattcagctctccttacagggtattgtggagcctaaatgtaatgctgggatttcatcatcatgagcttgcacgaaaaattcgaatggaaatttttctaggaaatcggaacactaatgacctcttcatgtgatttgtataatgcttggaaaagtaactagtgactggatagggatagcacataaggatataaatatttaaaagattatgaattttctatttcttagtttctgctttttgtatcctatctgtctttgttttacacgatgccacaggttctcttacattttcttctagaagtgtcaaaactttagcttttacattaagttctataatgcattttgaggtaacttttttatatcgtgtgagataaaggttgaggttcacttatttgcatgtcaatgtccaattattccaccatcattctctgaatacaacatcctttcccactaaattatcttggcaccttatggaaaaaatcaatttaacgtgactatataggtctagctttggccccttatttcttttcatatgccgatatcacactgtcctaattaccacagttatgaaatacgtcttgaaaacaggtactgagtcctccaataattttgttctttataaaattgttagactattctagtccctttgcttttccatatagattttaaggccagcttatcagtttgtagaaacaaaaggcttcaaggattttgattgtgtttacattgaatgtatagttcatttgggagtaactaacttattcacaatcttgagtgttgcaatccattaacgtggtatacctttccattaatttcagcctgctttaatatttcacagcaatgttttttaggcttctgagtatagtttgtgtgcatattttgttaaattttaccagtaaatatttcatggatttttgctgctatattaagtggtaatgattttcaattttcaattatttgttgatgatatttaaaaatcacattgacttttgcatacttatcttgtaccatattactttgctaaactcacatatgtatatatattcaagtcatgggatgaatctcatttggccatgatgttgtatatttttaatacattcttagttctgaactgctattattatagcatatatatatatctatgcttttatgaacatgagttatattagtctgtcatgttattttctcataatgtttgtatggttttgatataaggctgatgtgggctctgtaaaatgctttgaaaagtgtgatctctttcaattatcataaagggtttgtgtagaattgatactatttcttccacaaatgtttgcagaattaaccagtgaaatcaccagaaacatgaattttatttgagaaaaaaattttgtttcatttctttgttggttttagtgaattcaatttctttaattggtataaacactatatatgtcatctatttctttggggggaatgaggtttgctagctagtgtccttcaaggaatcttcccactccatttaaaaaataatattttggatagtgcttttcaccatgttccctatcatatatttaatatctgaatgatttgtattgatgtgccctctggcgctactgatatctgtgatttgtattctctctccacttctctcatcagtctgtctaaaggtttattaatttgactgttcctcccaaacaagcgacttctggtttcactgatttttttaatagattttttcatttctatttaatttatttctattcatatctttattaatttttccttcttgttgttttgggtataatttgattttatttttccagtttcttattttatttatttgtttaggttttttttttttttcatagacagtctggcactgtcacctagactggagtgcagtggcacgaccttagctcactgcaacctccacctactgggctcaagagattctcctgcctcagccactatgcccagctaattttttttttttttttttttttttgagacagagtctcactccttcacccaggctggagtgcaatggcacgatcttggctcactgcaacctccgcctcctcagttcaagcgattttgctgcctcagccacttgagtagctgggattacaggtgcgtgcccccacacccagctaatttttgtatttttagtagagccagggtttcaccatgttggtcaggctggtcttgaactcctgaccttgtgatctgcctgcctcggcctaccaaagtactgggattacaggcgtgagccaccatgcccggccaactgtttttctagtttcttaatgtggaagcttaggtaattgacttgagacatttcttcctttctgatataagtattgaatgctataaatttccctctgtgcactgctttactgtgttatcttgcattttttgataggctgtgttttcattttcaaattttctctacaatttattctttcatccctgcgttacttaaaagtgtcgtttaatttccaatatttcagggattccgtatatctttctacaactaatttctatttcaattcttttgtggtcacaaaacatgttttgtaagatttcattcctttagaatttgttgagatttgttttttggcccataaataaggtctatctcggtgaacattccatgtgcacttgtgaagaatgtatattctgttgttgttctataaataacaattaggccgagttggttgataccattgttcaagccttctgcatatatatatatatatatcctgattttcttgtacactgtttctaccaattgctgagagaaatgttgaaatctcctactataagtgcagatgtgtttgtatcttctttctcatgtatgggtgttcccctcatgtattttgaatataatatgatatataattaaatacacctaatgtatttaattattttttcagatgcagggtgttactgtgttgctcaggctgctttcaaacacatgggctcaagtgattttcccattttggccaatttttatacatgctttgattaatcacttccttatctggttctgggttttcaaccatgtgtacaatgaatttaactacttctgtagactcaatcaattcacacctctacccttttttttaggttgtgttattacacatttaaatctctcgactggtaactaatttccctgaatacctataaggtgatcatgggctcagcagtcagtgtgatttcaacgttggctcacaacagcttggaaagcctgcatgggaagtattgcttgaggaaaagtggagagtttccaggaacagttttgaaaaacaaagacaaccgatgtcatccttccctcccttgcctctcctcatgtgccaggttttctgtttcctccagctgatagaaaatcagcatgaagtattctgtgatgaaaagtttttatccctttaatcatcccgtttcttcctccaaaccttttattctttctggaagggtggtatgcagaaggaacaaaagcattttcagaaaaacacattataatataaatttagtgaaaagattcatcatgtttaagaaatggtcaggatgaaatcctgaatttgtaaaaattgtaaaaatcagtttacataacctccatcccttttgtctctatcacttatccagtgagaagtgtagaaaagatgaattccttatttgtggctgctgcgttgagtagccaaactgctggccaccttccatcaatatcatatatccagatgtaatagccacaaaatgcaaggcctgtttaaaactttccctgatttcatccatctcattgaaatttccatcaaactcctagcagtaaattcagcattcaaagagttacaagtactgtggctaagagagatcctggctcaaatgttgggagggggctgtagcagtgggcgcccagctgaagacaaggctggaatgtgtcttcacaaccccccccaccctttttcagacaggatttctctctgttgcccaggctggagtacactggaggactcacaactcactacgacatgaaactcctgagctaaagtgatcctcctgccttaccttcctgaatagatgggactacaggcatgtgtcaccatgcccagctaattttttaaattgtgtagagcaagagtctcactatgctgtccaggctggtcttgaactcctggcctcaagtgattctcctgcctcagcctccaataatgctggaattcctggtgtgagccagtgcatgcagccacttttacccgccttttaaaatctaaggcttaagggttttctgaggctttgctccaacccaggaagctgataattttcctcccacttggatgaaagagcaattcaaatgttcaggatttttggcctgtgcaaagctctttggcaattattgagtcctttgtctacctgcctgcaggagaaaacaaaaattaacattagcatgaggctgcacctttcccccatatattatctggagcagaacagtggttaagggatccagggatccagctctcttgcagttggagggactattgttaaatgctgtgagtacatgtatttttcataatagacaacagcttcggctgctgcttcatattatgggtaaatccatggtctcccaggcatgacagcttcatcatgtctaccccttcactcttcctttattcaaacaaggctttcaccatattgtatgcagttcctaatgtgacattaactgatttctccaaagatacttttcagggtatttccaggagcctattaggcatccagaccgtagtttgaagccaaaacattaaaagcaagtttacagaaaaagtacacattatttgtaaattcctttagtttcttaggtattttgtgtggtgctgatattttgagtaaaactatgcacatgttcggaccttggactatcttttggtttccttgcaggactagaaagcagggtgtgttttaaaaatgtttttaatgcatatgcttggatgtttatcgtcgaagtctctacagaggtctacctcaatgtaagcaaaagggtgactcttagacttctggtttttgtccactgtataaaactaagattttggtgtccttcccatatctttaatttcatctgaatataattcccctagtaatgttcccaacttttatgtttctattataggagaaaggcaaccacagttttaaacgaagacaagctgaaacaacacaaactggttttatattagagatatttgaattaaaaatatttcaataaagttttgcaactttcaccaaaaaagtcttgcacatcttttgttcattttattcccaggtatttgatactattgaaaactgtggcttgatgtggtagctcaagcctctaatcccagcactttgggatgctgaggcaggaggactgattgagcacaggagatgagaccaacctggccaacagaaagagacccccttttttaaaaaataaaagaataaatacatgaatgtatgcatatatgtatgtagctgtagtcccaggtactctggagactaaggtgggaatgtatgcatatatgtatgtagctgtagtcccagctaatctggaggttaaggtgggacctcttgggcccccaagaggtccaggatgtggttaaattattttggaatggagactcaatttcaaaaaaaattaagaatcatttttgaaattttgtattgtgattgagctggtatgcacaggtgtgatattgtgaaacacatatttggttctagaccctgcttccaggcatacaacgcctacaatttttagaatctccacaaagtggtgtctttttgtatgctagtgaattgactgatggctagcagcacctaggtagctctaggttggggaagaagagagttgggcctttcagccccacccacaaccttcagggaagggacaagggctgaaggttaagttgatcacaaatggcgggccaacagtttaatcaatgacacctacataatgaaaaccgaaaaggacatggttcagagagcttccctctagctgaacacatggagggcagcttgcgcatagagggcatggaagctccctgccccttcccccgtacctcaccttatgtgtctcctcatctgcttcctttgttacgatatccaatttgccacaaaatatgtaagaagttcctaggctgtagaactggatggaagaattagggcttaggtagaagaaaggggaaagcaaccagagcaacttgctgaagcaagatgacttgggtcctacctacactgtctctttagaggctatggcatgaattagccatgggtttccatcctgcctcccacacactggccttgagatggtgggcaagatacttgcaatatttgggaccatttcctcatttctaaagtagaaattacaatagttacactaattacttgctatgaagaatcaatgaaataacataccaagtaggcattgctttgcagttaaatttggtttactagatttccttgtttcctttaagatttcaaactttttccttccatatttctttaaaactacatctcttgtatgtgatatctgcttttgaatttcaagtaggaatgtcaagttaccttttaaaatgcatttgacttcacaaaattatttgatttcaatgaatatgttaatgaattagcagtgtagctggtgtcagacacgggatcgattctaaagtggatttctaaaaaactgaggtgtgacaaggccaaacctaagtcaattgtccgtgcagaaaacttgtttgctgtgtgcgatgccatgaagaataaatcaatattctgggcatgcaatgccacacaactcaatacagtagtgtgtcaagtgctcaagcagtccctaagcagccctggccacaaggatcaccactgcagttgttagtttgccgtgtaacatattcatagatttggtcaataaggagataatgagcccaaatggatccaagtagttgattgtttgcagacacaacaaaagcaagagcagcattgtgtaggcaccgtgtccctagtcccataatacaacactgaatagcaggtactcagtgacagacagcacagatggtgggtctctctgcctgtgaggagctcacagccataccctaaagcagtgagcagttttataacaagttaggataacagctgtaccctaagttgtggaaaaggcctgtggttttctgaaactagagcaatggatgaaaatggactccaatgaagtgaagttgtataagttcatgaagttttgctgtgaagggcagcagataaatgtgttagtagctacagaaggacatgggggaataaggtgagttcctccttagcttggggaataatccagtatagagggagccgttgatggttcaggggcagaagtgatcattgcaggatcaaagcccctgggaaagtggaagttatgtgatcctgagctgaggtgaggggctggcttcagtcaggagcaattgcatgcagaagggccgcagagaatgccagaacagcacaggtagactgggtttgggaagctctaagagttcccagcagattgcttctgtcttctgaatgaatcattaggagaggtcattcaaatggaggagggttcctggcattttgtgagagtattgtagtagtggaagtaggaagagcatgaaagggagaaaattctctcgtggtcatggacttaaggtaaaataattcagaaggttttgaagttttcttatcactgctcagttgctcagatacaggcatcattatgcggtcattaaattagtaggaggagcagtagtgctagttcataaaatagatatgataatgctcacctcctgaggggcactaaaaggatttttattcgtttgttagggctgccatcaataactaccaccgactgggtggcttaaacaacagaaatgtattttctcacaattctggaggctacatgtctgagatcaaggtgtcagcagagttggtttcttctaaggcgtccttccttgccttgtagtcagctgttttctccctgtgtctgccttagtcctccctctgtacgtgtgtctgtgtcctcatttcctcttcttataagggcactgggcaaattgccttagggcccagtctaatgacctaatttctcttaattacctctttaaagaccccacctatgtcacatacagttacattcttaggcactaggggttaagacttcgccatatgaattttgagcagacacaattcagcccataatagtattgctgttagctttatcttaataccgttttttatttctgagacagggtctcattctgttgcccaggttggagcgcagtgatgttaatgtgggttactgcagcctgcaactcctgggctccaggggatcctgccatgtcaccctccctattagctggtagtacaggcatgtaacagcacaccaggctaatggtttaattttttttttttttttgacatgggacatcccactatttttcccaggctggtctggaactcctgtgctcaagtgatccttctgcctcggcctcccaaagtgctgggattacaagcatgaaccaacaagcccagccttattttaatactatcttcactactattgtcactatcatttattttattcttacaattacctggaaaggtaggaagtagtcactgaagctcacaaagttcatctattgctgaacctcaccaggaaaggaagtactagtcaaacagacaaacctcatgtgttttcaagtggagtgtaactgagaaagtcagatttgttagatttcttatcatgaatttatttgttattgttaaattttacatgctcagcatcagtaaagaaaagagtaatgaaaaatcattaagcccagagataaatccacacacttacgctctattgatttttgacaaagatgccaagcacagacagtggggggagggcagctttcaataaatggtattggagaaattgtacatccacacgcagatgaatgaaatttgaccctcatctctcaccatatacaaatcataaacagagggaggctggtatgttgcttcatctgggaacttataaagatttattgactgctttggaaaattacatcactgcagggcattccattcctggattctgctctgacacaacagtccaatatcagtttactttgtcgttgtgcatgcctgggggaaagaatgatgggaatccaacttccctaccaacatgaccttttccaggatcagcttcactgtattccttgtttttaaaaaattaagtgttttctactttgatggagaaaattttaatctcaattttgccttatttttcattctaaaattactagattgcataattatttccatagctttgtactttgaattgttttagtactaattttttattttattgtgttatttattcatcttgttacttatgtagtgctttaaatttatttttcacttcaagagtttttttgtctgtgtgaagaatatcaactctacatattatataaagactaatttttctgtatatatattgttcgaaggttgttgacttactattttttcttttttaaaacctgtttaattaacaactattatatgtatttatggggtacaatgtgatgttttgatatatgtatacaacttaagagttgcatcagttataaaaggtactggatagaagtgcaacacattgtttacctcagactggagaaattgtggttgttagtgtttattctgctattccatattttacaagtttctataaaaagcatctactacttttttaatcagaaaagaaatattattttacatcaggaaaatcaatattaaattccctcagagagaatatactatcacaaatctttgataaaataaatagcagtgtgctatcttgaatacattttcttggcctattagctggggttctctagagggtcagaactaataagagatatatatatatatagctcctatatatatatgtatatatatatatctcctatatatgtgtgtgcgtatatatgtacatacacatatgtatccacatatatacatatatatacatatatatatatgagtttattaagtattaactcacaagatcacaaggtcccacaataggccatctgcaagtggaggagcaaggaaagccagtctgagtcccaaaactgaagaacttggagtccaatgttcaagggcaggaagattccagcatgagagaaaggtgtaggctgggaggctagactgctctagccttttcacatttttctgcctgctttatattctagccgcactgacaactgattaggtggtacccacccagattaagggtgggtctgcctttcccagcccacttactcaaatgttaatctcctttggcaacaccctcacagacacacccaggatcaataattttcatccttcaatccaatcaacttgacactcactattaaggtcacacttggttatgtcagttttcctttttaggtatcatttaggggtggaggatagagaggaccttagtttccatttttcttggtgaaagttaatgaatgctgctttctgtgaaagaaagaaggctacaatatttgctgtaatagtatttcacgacatcaataccatctttatctttatttctttcatcattacagcaaagggaaataatcatggtgctcagtcatcagacaagaagcaaaagtccatcaatgtgaatgccagaggatatctttgcttcttagagtagccgtttagcagtctgtcatctgtaaatttaccttagcctcttccaaatatttcctcatctatcatcatttaggggttcagaaagtggctattttcgtattttttttgtccaaaacttacttaggttggctcctttactaactcccaatcttctccactataatgactctggaaccagtccctttgctgtgaaagcagcatcaacaacattgattcttctacctcagacccactggataacataattaatgaaatttttaaacttaaaattggaatgaaaacaccatagaattagcaatggctaaattatgtaactccaagcagttaacaattaagagaaactttgtccctcaaaaagtgaacattactttcttctttttgatttttctcagaattttttctgaactgaaaatgtaacaaattcataaaggccaaacacaggcaaattttctattttttaatttttaatttttatgagtacatagtaaggtgtatatatttatggggtatatgagatattttgaaacaggcatacaatgcataataatcccatcagggcaaatgaggaatctatcccctcatgtactttgatttttaatccaaaatgttaattctgcctttaagtttttttctttttttagcatccatttttttttaagacagtctcactctactgcctgggctggagttcagtggcgcaatcagctcactgaaacatctgcctcccacgctcaagtaattctcctgcctcagcctcctgagtagctgggattacaggcacttgcctccagtcctggataatttttgtatttttagtagagacgaggtttcaccattttggccaggctgatctcgaactcttgacctcaagtggcctgcctgcctcggcctcccaaagtgctgggattacaggtgtgagccaccgtgcccagccagcatccatctttttaatgactattttagtcttaaaaacaataaatttctccggacgcaattcctttgaaaaaaattatgacaacattaaattgaattatgcaattttaaaaattataatgataaatttacatgtctctgggctgggtttgatggttcacacttgtttttgttttgttttgttttgatggttcacactggtaatcccagttcccatgggaggtcgaggtaggaggatcacttgtgcccaggagctcaaggctacagtgaagtagcaacacaccactgcagtgcagcctatgtgacaaagccagaccctgtctcaaaaacaaagaaagaaaaactttaattaatttatatgtgtccttaaccaaattgcatatcctttgagggaagaggctattgagcatccttttgcctccccgtaacttctaacacctaaacttataatgatggatcaattctccaaaggaaagaatatagagcaaagctaaggaatacatgaaaactgacagagagaagcaaggacaataaaattgaggaatataaatccggaaagagaactgaagtattatggcatccccaaaatagacatgtgacccaaaggaacagaatagagagcccagaagtaaatccatgcacttacggtcaattggtttttgacagaggtgccaagaacacacagtaagggaagggcagccttcaataaattgtatttggaaaatgatatatccacatgcagaggactgaaattccatcctcatctctcaccatatacaaaagtcaacttaaaatgaattaacattgtataatgtaagacctgaatctatgaaactactagaagaaaacatagggagaaagctccatgacgctggtctgggcaattagtttttggatataatccccaaagtgcagggaacaaaagcaaaagtaaacgaatgagattatctcaaactcagaaacttctgcagagcaaaggaaacaatcaacagtgtgcaaagacaacctatggaatgagagaatacatttgcaaaccatacatctgagaaggggtgaagacctaaaatatataaggaactcaacagtaagaaaacaaataatctgattaaaacctgagcaaaaagcccggcacagtggctcacacctgtactcccagcactttgggaggccaggtcagaggattgcttgaggccaggagtttgagaccagtcctggcaacatagtgagaccttgattctacaaaaaaataaaaataaattagctggggtaacaaggcagccatgggaactgataccaagggtggctagtctctctgaggggagatgagacacacaaactgcatcacctctggcagagcacatgtggaagaagtgacagtcataagaggggataagaaggaagtaattgaaaatgtaacaaattcataaaggccaaacacaggcaattgggagagctggaatcccagaaagtctcagacacaagtggaatccacattcacttgccagctttttcctgcacaccaccatctggcattcatgaggaagactggaggaatccacggaggcctgggggcatcttcgttggcaagaaaccctgattgcttcgaaaaccttgtccctttaaaaaaaaaatcattgtgtatatttgaggtttacaacatgatggtatgggttacataaagatagtaatgtggctaatgtagtgaaggaaattaacctattatatcatctcacagtgacttttgtgtgacaagaacagctaaaatctacttatttaatcaaagtgcctaatataatagcaacaatcttcatgttgtaccttagctctctagacttgttcatcctacatacctgctactttgtatccttggaccttcatctccccatttcctcctctatcctcccctgtccctgatcaccaccaatttattctctatctccctattgcttgctctttcttctatctccctattgcttgccctttctttctttctttttctctctttctttcttcttccttcctttccttctttctttccttctttctttccttttttccctttctcattctctttctttctccccccacctttctttctgattccacacataagtgagatcatacagtacttttctttctatacatgtgccatgttggtgtgctgcacccattaggtatatctcctaatgctatccctccccgctcccccgaccccacaacagtcgccggtgtgtgatgttccccttcctgtgtccatgtgttctcattgttcaattcccacctatgagtaagaacatgcaatatttggttttttgtccttgtgatagtttgctgagaatgatggtttccagcttcatccatgtccctacaaaggacatgaactcatcattttttatggctgcatagtattccatggtgtatatttgccacattttcttaatccagtctatcgttgttggacatttgggttggttccaagtctttgctattatgaatagtgccgcaataaacatatgtgtgtgtgtgtctttgtagcagcataatttataatcctttgggtatatacccagtaatgggatgggtgggtcaaatggtatttctagttctagatccctgaggaatcgccacactgacttccacaacggttaaaccagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttgtttttttcctgtaaatttgtttgagttcattgtagattctggatattagccctttgtcagatgagtagattgcaaaaattttctcccattttgtaggttgcctgtttactctgatggtggtttcttttgctgtgcagaagctcttgagtttaattagatcccatttgtcaattttggcttttgttgccattgcttttggtgttttagacatgaagtccttgcccatgcctatgtcctgaatggtattgcctaggttttcttccaggatttttatgtttttaggtctaacatttaagtctttaatccatcttgaattgatttttgtataagttgtaaggaagggatccagtttcagctttctacatatggctagccagttttcccagcaccatttattaaatagggagtcctttcctcattgcttgtttttgtcaggtttgtcaaagaccagacagttgtggatatgtggcattatttctgagggctctgttctgttccattggtctatatctctgttttggtaagagtaccatgctgttttggttactgtatccttgtagtatagtttgaagtcaggtagtgtgatgcccccagctttgttcttttggcttaggattgacttggcaatgcgggctcttttttagttccatatgaactttaaagtagttttttccaattctgtgaagaaaatcattggtagcttgatggggatggcattgaatctctaaattaccttgggcagtatggccattttcatgacattgattcttcctacccatgagcatggaatgttcttccatttgtttgtatcctcttttatttcattgagcaatggtttgtagttctccctgaagaggtccttcacgtcccttgtaagttggattcctaggtattttattctctttgaagcaactgtgaatagttcactcatgatttggctctctgtttgtctgttattgttgtataagaatgcttgtgatgtttgcacattgattttgtatcttgagactgctgaagttgcttatcagcttaaggagattttgggctgagacgatggggttttctagatatacaatcatgtcatctgcaaacagggacaatttgacttcctcttttcctaattgaataccctttatgtctttctgccgcctgattgccctggccagaacttccaacactatgttgaataggagtggtgagagagggcatccctgtcttgtgccagttttcaaagggaatgcttccagtttttgtccattcagtatgatattggctgtgggtttgtcatttggcactttttactgaacagtggataggccttttaagcagttcctagaatcaataataaagttatgttcaacttttatcttcccaggcaagagattcttgtagtaataatgttatgttaatgaagccagtggaatagtaaactcttgttcatataggcagtaagctgtgtgtgtggtttcagttctcattacttacttttagataacttatgagcgtggtaggtcatataggaaagggaaggagaggaagggggccttgattagctagttgctttttgttagtaaatgaggacatatgtgtgtgtgtgtgtgtgtgtacatatatcctattcatacataataattgtacatatttacagggtacagtgagatattttgatacacatacacaacttgtaatgatcaaatcaggataatcagcatatccaccacctcaaacatttagcatttctttgtgttggaaatgttcaaaatcctcttttatagctatttgaaaatatacaatagattattgttaactatagtcaccctacagtgctaaatagacgactagagattattcctcctatttagtcttaattttgtatccattagctaaactctacctgttcatctcccacccttcccagagtctactattctctattctgctctctacatctatgaaataaaagcttttagcttccacatatcaatgagaatattcagtatttatctttctgtgtctggcttatttcacttaatgtcctccaggctcacacatctgaagcccatacatgttgcctcaaatgatgggatttcattcttttatatgactgaatagtattccattgtgtatacatacaccaatgtaaattagattgtattttgtttacttatttcttttttattgatacattgttgtacatatttatggggtacatgtgacactttgatatatgtatacaaaggacaatgactaaatcagggtatttaggatatccatcacctcaaacatttatcatttatttgtgctgggaacatttcaaatcttcccttctagccattttgaaatatatgataatttattgttaccattagtcaccctactgtgctatcaaatagaagttattccttttacttaattgtatgtacccattaaccaacttcgcttcatcccacccaccccctgttcccagcctctggtcaccaaaattctactccattagatcaaaatttttagctcccacatatgacagacaacatgtctcgaactcctgagttaaagcgatcctcctgcctctgctttccaaagtgttgagattatacatgtgaaccaccgatcacagcttctgttttcttttaagatgtacattaaactcacatttgtgagttttctccttcagtcagaagaggaacactgactctttcatctgccccttggaggtaaatttttctttttaaataaactatgactccattgaaattcttatttcaaccaagtttatgaagcactgtctcatttaaattatcagggctatattatgcgaagatttagaagatttgaagctcctccaaccccaaatcaactgaaccttacttggtgacctgaaccctcacctctcttctgattaggctatttctgctttggttgaagatgttcatggatcctgcaaggaaaattcaatttccctaatgtcttgacatttcctataatcaccaaacctgtaactatagtggatcctactcaggataaatgtggttttaagtttatatcctgtcgtaggttattatataaaaaataactacagggatttgctaattatatctccattgtctaggtaatatacttgggagaggaaaaaaagcattgcttctcttgttttttgagtgctggccttcctccctctggctccccttgagcaagggatgaagccatttctggggtttggcaagttagccttatgggcagggcatgtggctatttgctcatgggatgtgacactccagtagggttgattttagctggagtctgggaagaccattttataagggaatctctgttgcagattcagttttaaggagagcttcttccactgtggagggcataacagggtaattggctctactccagtaagggcttcagttttaattaaatggtcatataagttttaaggtatcacgatcatgattgatattaaaatgtgaaagagttatacatcatatccagtatggcaaaaaaaaatgaagagggaaagaaaactgagagtaaggcatctggaaaagctaaatatttgcttctaaaagtaactgttttgagggacgaacagcaaatttcacaagctcatgcacagtctttgtgatgttcagatattcaggtattaaaggtatatgttaaataatgtaggtgttcctagtatgtgaaccatttcatccatactctgaaaatattagtgttcaagaatgtattccctttcaatcatgccttatattcaatatctgtgtcttgttcatattccgtgttgtgctttttccattttcctcaagaatgtttaagctactggatgctctcttcctagatatttcacaaaagaacgatctattaaatttattacatttggattacttttcctttggttaatgattcgtacctttcatttactgcctgtttccttttcccttaagtttctcttgtgactcttttttttatttctaagtattattttcttgtatcatgtaatttgctgtctattttaataggatacgcatataatgctatgactgtcctaagaatacaattcaggcttgttcaataggctcctggaaatcgtctgtaaactatcctttaatgtaaatagtcgaatggaatggttcagcagtgtggagtaaaaacatttagataatttcttccctatacgtgcagtgcttcctttaaattcagaagttcttctaattaagtcagcaatttggaaaacatgtatgaaaaatacttatgtggactactcaggacttagtacattatagactttgaactctaaatcatatcatctgatgactcaaggcagaagcctgtaatataacctctgatatggttagaggttaccatatgtgtcttcaatctaattacacacagtagctcatgaagactgacaggaggacagggagcatgcttagcacaggcatcttacaaccaccttgagcatgactgacctacatgcattctccctacttcatgggtcacaaaaacctgactgtctctatcgattttattactcagtcattcaaggcttcactgcgggaagactttaaaatgtaatcattgggtctggcgcaggaggaggttcacccctgtaatcactcccaacattttgggaggccgagacgagtgggtcacttgaggtcaggagttcgagcccagcctggccaacatggtgaaacctcgtctctactaaaaataaaaaaactggttggcatggtggcaggcacctgtaatcccaaatacacgggaggctaaggcatgagaattgcttgaatccgggaggcagaagtcgcagtgaaccgagatcggaacactgcactccatcctgggtgacagagtgagaccccatctgaaaaaaaaaatgcaatcattgtttaagagcctgagagaattcaggatttgacaaaatccaaaaacactcatgaaggtctccatacaggaaaacaagcatcaagcagagtgccttctcattttcttaggagcaatgaaatctcaactcagatattttaattggactaaagctgattgttatgatgaaaaaatcatgaaaatcagaatatctgtgtattctctccaacagaaccatagcatgcagaaatcagcactgaaatggattttaatctatttgatatgcattcactactttcaataaaagcaaaaatgggtgtaggattgatgtgatttgtccagaatctcacaaatcgtgttggagctggtactagaatctccttcagagatcagtatatttcatacaaagtggtattacaaatgcattatatatttgtgagaaacagaaattacaaagtaatctgaaaattgttagctgttggttatacttagaagtaacaaaatgctttcctatttgatggttcaatatggctttcacccaatttgtgtctgtatctgatagtgtttcggctttgcagtcaggcttctggggtctgaaccaccttacaaataaagtctgcatttgaattctgtttttaaaggggcagtaatattctctctttttattatgaaaagtgtaatattgtggaatacagaaagcacataattttgaatcttaatggataacatacctccttctggcattttaaattgctctgactttgtcagaatcttcccctggacatcaggaccatctccgcattcatccccagtctttgactgagacagctcctggagatcagcttccaggtcaggcactaaaaaataccaaggaaatcgattggagcagccagacaagaatgataaataaggaaatgatcctattcttttcctcagtgttgtgcaataaaagcctgtaggctactgtggtaataaatgtgatgcaaagatgtccccgtttgttttcctgtattatgatatcttatttttaatgacaatctgaggataagtctcagcacacctgcatttcccatactttaccattgtgtattataaacacacagctacctaggaaacctgaagatggcctcgtggatagcattttaatcataacttaaatgtaattttctgaaggattagatcaatgtattggtgagcctatgacaaatcctatagtcttgacactcatctcctgttgaggtatcttgaaaatgttgttgttaaccttaattaaagtaattattaggttgaaaggccctatatgtgactttccatacatgaatgtcattaagaaaaaatacaaaatataacagcaaaatcactgtcttccagtgagagtatgggaactgaagtgcaaagaaattaatgggcattgttgacagtcatattctggaaaccccttaacagggaattgctaaaataatccatggcccaaattctgtctctgattagtctgaaaatgctatctgttgaggaaacagtttctgtttcatgataatcttatcgtacttgaagttttctaattataaaaatattagaacaacttttaaaagccccttcaaaatcctacaaacacagttacctgtatgccattgtcctgaattatccagcttttactaaacatatggtcaaaaatataaatcaaaggaaacagtggctgtcatccattggcctcttttctggagttgctatcttgcttcactgaactgcgttttgccctgagccaataccaaattaccttatagtacagacacatttaagtattaagcatttttaagcaaaatcattcacattttctaaaacagaaggcgggaagaatgcaaaccttgaaacaaaatatgaattccttctccatgagtcgtgttcttggtaagtctcaacctctgattctcagttttcttatttatttttttatttttatttttatttttcaagacggagtctcgctgtgtcaccgaggttggagtgcggtggtgcaatcttggctcactgcaaccaatgccacccgggctcaagcaactcttctgctgcagcctgcttagcagctgggattatgagtgtgtgccaccatgcccagctaatttttgtatttttcgtagagacagggtttcactatgttggccaggctggtctcgaactcctgacctcaagtgatccacccgcctcggcctcccaaagcacagggattacaggcatgagccaccacaccgggcctcagttttatttataaaatgaggttaacatccctttgcaaatgggctttattcagggtattataaggtagggcgacttggcactccacatgctattaaagggtgcttaaaacactgtgaacaccatggctgagaagatctcactgcaacatcctaagaatatcaagttaaactagtgaaataatgtacatttttatacaaccaattaaatggtttcatctgatttaggaaggactgtattttcaagcccacaaaatgcatctcgaagaaaaagagaagattaatcatatccagggactgcaggaagctgcaaactatacccgtcacgtttccagccaaccctcagcaaatgtttgagatcctttcctagtgttttctttcctcctcttactggtcatggcataaggcatgatgcacacataggtctcctcccccccatagacattctttctttcccttcccaccaccttgaatctcagctgcaccctgatcttcttctgtcttctgaccaggtgtacgatcccaactttaagctggtggttcttcttgttgaggctctggcacactgggctcctgggaaaagagggttttgtgtgtgcgcgtgcagataaaaaatttttcttatcaatgcatgtcaataatacgaatatacagattacatagatacttctgatcatatgcatgtttaaagacatgctgcaacactagctatgtgctagtgtaatgagctatgaataagcatgaggaggaaatcactagtcaaatctggggaacacaaattcccacatccaggaaaaaccagtatgtagtcctcttgggttactgtttccttcatgagatgccgcaatggttttttgtcaacatgggagacctttatcattgcatctatactaattcaacaacactatcacacaaaaaaaattctgctaatagaaaacatcaaatgttaagtcactcacaagcataggcccaatcagctgagcaagtcgtaaacatcgtcttggtctatatcatcttcctcgccaactcatatttcagtctgcaaacagaatagtgtgcactttgggaggccgaggtgggtggatcacctgaggtcaggagttcaaggccagcttggccaaaatggtgaaacatcgtctctactaacaatacaaaaacttagctgggcatggtgcgggtacttgcaatcccagctaatcaggaggctgaggcaggagaatcgatagaacccaggggcaaatgttgcagccagccgagatcacgccattgcactccagcctgggcaacaagagcaagactccctctcaaaaaaaccaaaccaaaccatagcaaatcaaaacaaaacaaaaatcagaatactgtgattggaaaaatggggtacatgtgcaggatgtgcagccatcagatggctagattttactgtttcacactgtattagttagggatctgtaaaggacagaactgatggatagatgtgtatgtgcagcagggtttgttaaggagtattaacttacacaatcacaaggcgaagtcccaaaataggctgtctgcaagctgaggagcaaaaaaggcagtctgagttccaaaacctcaaacgtattgaagccagcattgcagcctttagtctgtggctgaaggcccgagatcccctagcagatcactggtgtaaattcaagagtccaaaagcagaagaacctggagtctgatgttcgaagacaggaagcatgcagcacgggagaagttggaggctggaagactcagcaagtctagttttccatgttcttctgcttagtttattctagtgctgctggcaactgattagatggtgcccacccagattgagggtgggtctacctctcccagtccactgactcaaatgttaatctcctttggcaacaacctctcagacacacccagaaacaatactttgcaccctttgatccaatcaagttgacacttaatattaaacatcacctgcagacctggactttaatgattcctgagtggcctcactccagcttcaaagggcaggcttgaatttcttgccaaatttgaacttcccactgccattcctgtgggccataactccggacctgctggatgacttcaaaggatcataattgcgttggtattgggaaagttgtgaaggagcccttgtgacaaacaggaagcagcagacagtatgaaagacactgcagagacaagaagcgttgcctgatacatgaccctagcaactctctagctgctaagggaggaaacagagctgggaccaacacagccagtctacctgtgagagggctcaatttcccacatgaccagagcttcccatcctccatgcatgggaatctatgaccaaacatagatttccacaggatggtgggtgggtgggacaaagtctacagattctgagcagctggcaagtttcagggtaccagagtaaacactgtcacgtgacctcagattgcttggtggttgaggccaaattatttactacctaccattttcagtgtagctctcccacttgcctcataaaatggagcaccataagggaatggaggtcacacagggacctccctgtgaatgcatgcaatgcatgacattcagctatgctgcagcccaagcaaagcctccacatgatatcaagaggacaagaggtcacatgtattttctgttccttttgcctgtgagttcccatctgtccaagtaagacttcacctgtgcaaaacagacgctgatatctgcagatgaagcacatatttcatcagtaattgtatattttgtagtagcctttgtggcccataacaaagatgatatttttgtctaaaaacactgaattgcaaaggaggtggacaaaattgggttctcatgcatatttgcatatattctatagcaacatttatcaaccatgggggatgttctctgaaaagctgtaatcatttctaaactggtttttaatccatagtgggttgtaagattaatgttgtcagccacaaacagcattttaaagaatggagataaaatatattactaaatagcgttcactgcatatagaatatacaaatacactacacatccccatgtacaaacgtatatttatttgcctagttgactatatataaactgtgtatttctcacacattgtcataaaagagtttgaacgtcactactttagtggttattagaaaaaatgtttacaggccatttctttagccatctgtgaagatgatggattaagatttgctaagaataagttcactgttgtctgtggctttctacataatgcttgaaatggcactcagtgatgcttaaactggtcagttttactgtgggcatttgaccctcagcaaactcatttgtgaactcatgagctggtgagaaggaaggctgatgagttgtggggctttacttcctaccatgtctttctgcagctgcaggtgtgaccatgtgtgtgcttctgcactcgtctgacagtgctttgatatgttcccttttatttgcccctttattattgactgtgtcttatagttcctattatgtacttcattagcatccagtgacagcgacatctgtggtattcagtgttgatccaatttacacaaattttaaaaatattttcaagcatgaatattttttcttaccaactttccttaagtacttccaggagtcaaatgcaattcaatattagtagttgatgttagaccatactggggtataatcctggaaaattactgataatactaattgttgttacgcctcagcttttatgtcaccataatgcttagataaatggcacaatgaccaacacatggaaagaaggattctgaaatattgacattttttatttccaaaatttactttaagctcaggggtacatgtgcaggatgtgcaggtttcttacataggtaaatatgtgccactgtgatttactgcacacatcatcacatcaccctggcattaagcccagcatccacgagctactctacctgaccctctccctcctcccacccccgcagtccagtaggctcagtgtgtgatgcttctcccatgtgtccatgtgttttcatcatttacctcccacttataagtgagaacatccggtatttggttttctgttcctgcattagtttgctaaggataatggctgccaccaccatccatgtccctgccaaggacatgatctcatttttttatggctgcatggtattccatggtgtatatgtaccacattttcttgattcagtttatcattgatgggaaggacatctcaaataccacaaagacacttggtccttgttgtgggaaatatcggactgtggtggggcagacagacaaacagaacagcagtagaagagcaaaggagaaacacagggaagggaaccagaggaataaaaaacaatatattggccatgagacaggggaaaacaacacaatattttaaaaaggtaatctttctcctttgcctttgccacttttctgaaaatcaacttattaggttttgtgagtctattgctggctctattttgatttgttgacttttctccaataccacactgtcttgaatactggagaagtaacacaattgccatatggggctggatgattaagaatcataatcaacaacttcatgcaatgcttcctaactcaaggcagcaccctcacctcagctgaggatcccatgcctcccaccttctcaggggctccgctcctgcactgatctctcttctctcctgaaccatcaacggctccttctatactggatcaatccccaagccaagggggaagtcaccttcttccaatgcactgataacataatcaatcaataaatataatagaattaatgtgaatcttgacctcctgtagggtgaattccccaaagttaaacttcagaattgttttggatattctgattcattttcctttgtagataattttgaaaatggactccagtgaagtgtgttgcataagttcatgcagttttcctttgcagggcaggaattaaatgtgttcgtagctagagaaggacatgggggaagagggtgagttttcccttagcttggggaatgatccaatgtagagggagcagttgatggttctggagagaggagtgatcactgtaggagcaaagcccatgacaaggtgggaggcatggtatactgacctgaggtgagggggctggcttcagttaggagtattgtatgcagaagggcagcagagaatgtccatgaatcactgaaggtgagggtggccttgggggtccctgacacagtgtcagcaaccgtgtgattcaccagcaggaccctgactcactacaacatggtgaaactttctttgagtaagggaagagcgaaggggtagagatgaggaagctgtcactcctgggagactatggatttccccatagtatgaagcagcagctgagctgttgtctattatgaaaaatacttgtactcacaacattcacaataatccctccaactgcaagggaactggctcactggatccctcaactgctgttctgtgcatgataatatatggggggaaagcgcagtctttaatttttgttttctcctgcaggcaggtagagactggatacaattgttgccaatgaactttcagtaggccaaaaatcctgaaggtttgaattgttctttcctctaagtgggagggaaaaaatcagtttcctgggctaaagcaaagccttagataaaacttaagtcttagataaaggaaaaaaagtgagaaaaaaagaccactggcagtggctcacacctgtaatcccagtattttgagaagctgagggaggagaatcacttgaagccaggagttcaagaccagcctgggcaacatagtgagacccctgctctacacaatttttaaaattagctgggtatcatggcacatgtctgtagtcccatctactcaggaaggtaacacaggaggattgcttgagcctaggactcctaggttgtggtgagctctaagtcctccagtgtattccagcctggatgacagagagaaaccctgtctcaaaaagggagtggggtgtgtgaagacacatttcagccttgtcttcagctggactgccactgctgcagcctcctcccaacatttgaggcaggatttctcttggccatggaatcataactctgtgaatgctgagttcagtgctagggttttgatggaaattacaatgagataaaaaaaaaggtacagttgtaaaatgtctttgtgttttgtggctattacatctggatgtgtgatactgacggagagggtccagcagtttgactacttaatgcagttgccacaagtgaggaattcatcttttctacacttctcactggataagggatagagacaaaagggatggatgttatgtaaactgatttttaaaatttttatgaattcaggatttcatcctgtccatttcttaaatatgatgaatcttttcactaagtttatatcataatgtgtttttctgaagatgtttcgtcccttctgcttacaacccttccagaaaaaaaaaggtctggaggacgaaatgggatgattaaagagataaaaacttttcatcacaggatacaacatggtgattctgtaatagtggagaaaacagaaaacctggcacatgaggagaggcaagggagggaaggaggacatcggttgtctctgtttttcaaaactattcctgcacactctccacttttcctcagaaatacttcccatgagggctttccaagccactgtgagccattgttaaaaccacattcattggtgagccggtgattaccttacaggtattcaaggaaatcagctaccagtcaagaggtataaaagtgcaataacacaaccttaaaaaaaagtacaggtgtgaattgattgtctacagcatgtataaaaattggcaggcatgggaggatcacttgaggccatgtgtttgaaagcagcctgagcaactcagtgacaccccgcatctaaaatataataattattaaatacgttaggagggcgtggtggcggccaactgcagtcccagctacaggggaggttgctgtgtgaggaggattgcttgagcccaagagatggaggctgcagtgagccatggtcatgccactgccctccaccctggacaacagaaaaacaccctgagaaaacagtatgtgtaaatatagacataaaattctttatttctgtcacaaaaggtctttctgagacacaccctccactaagggtgacatgggactctctgttctcaatgtttctggatgcctgagaatggctgggcaagagacaaaaaaaatttaaaaaatctctcatgtccctttcttcctactacaaactacctgggataagggtgtggggatagcaggaaaaccctggccggccctgcatgtgcctgactcagtgtgcatgccccttgctgcacaaggcgtagtggctcacatctgtaatcccagcactttgggaggccaaggtgggtggatcacctgagttcaggagttcgagacgagcctgggcaacatggcgaaaccccgtctctactaaaaatacaaaaattagccgggcgtggtggcacatgcctgcaatcccagctactcgggaggctgaggcagagaaactgcttgaatccaggaggtggaggttgcggtgagccgggactgcaccattgcactccagcctgggcaaaaagaatgaaactctgtgtcaataaataaataaataaataaataaataaataaataacagaaaaatgaggctcagagattgagacttaccaagaacacttgactcatggaggaggaattcatattttgttccaaggtttgcattcttcccaccatccatgtcagaaaatgtgaatgattttgcttaaaaatgcttaatactcaaatatgtctgcactgtaaggtactcagcattgactcaggacaaaacgcagttcagtgaagtaggatagcgtctccagaaaagaggccaataaatgacagccactgtttcctctgatgcctatttttgacagtatgtttggtaaaaggtggataattcaggacactggaatacagataactatatcagtaggactttgaaggggcttttaaaagttgtttcaatatttttataattagaaaactccaagtacaataagattatcgtgaaacagaaattgtttcctcaacgaatagatagcactttcgaactaaagatagacagaatttgggccatggattattttagcaattcactgttaaggggtttccagaatatgactgtcaacaatgcccattaatttctctgcacttcagttcccgtactctcattggaagacagtggttttgctgttgtatcaggtactttttcttaatgacatatagggcctttggacctaaacattaattaagtttaaccccaacactttcagggtacctgaacagggaattagtgtcaggactataagatttgtcataagcagaccagtacattgatctaatcattcagaacattatatttaaggtatgattaaaatgctatccacggggcagtcttcagatttcctaggtagctgagatacttcagatttcctaggtagctgagtgtttataacacacaatgttaaaaagtatgggaaatgtaggtgtggtgtgatttatcctcagattgttagttaagatatcataatacaggaaaacaaacggggacatctttgcatcacatttattaccacagtagcctacaggcttttattgcatcacactgaggaaaagaataggatcatttccttatttatcattctggtttggctgctccagtcgatatccttggtattttttagtacctgacctggaagctgatctccagaagctgtctcagtcaaagactggggatgaatgtggagttggccctggtgtccagggggaagattctgacaaaatgagagcaatttaaaatgccagaaggaggtatgttatccattaagattcaaaattacgtgctttctgtattccataatattacacttttgataatgaaaagagagaacattactgcccctttaaaaacagagtccaaatgcagactttctcgggaaggtagtcgagaccccagaagcctgactgcaaaactgaaagactatcagatacagacacaaactgggtcaaagccatattgaatcatcaaatagaagcgggggctcacgcctgtcatcctagcactttgggaggccgaggcgggtggataatttgaggtcaggagttcgagaccagccagggcaaatggtgaaacccagtctctactaaaaatacaaaaaattagccgggcttcatggcaggcacctgtaatcccatctactcgggatggtgaggcagaggaactgcttgaacccaggaggtggaggttgcagtgagccgagatcatgccactgtactccagcctgggcaacagagtgaaactccgatctcggggggaaaaaaaagaaaggaaaagaaaaaagaaaagaaaagaaaagaaaagaaaagcattttcttacttctgagtataaccaacagctaaaaatttgtagattattttctactttctgcttttcacaaatacataatacatttgtaataccacttcgtatgaaatatgctgaccctgaagaagattctaataccagctctaagataatttgtgagattctggacaaaacacataaatcctgcaccggtttttgcttttattgaaagtagtgaatgcacatcagatagattaaaatcatttcattgctgatttctgcatgtttcggttctgttggagaaaatacaaagataatttcattttcgtgatttgtttatcataaccatcagcttcagtccaattataatatccgagttgagatttcattgctcctaagtaaatgagctggcactctacttgatgtttgttttcctgtatggagaccttcatgagtgttcttggattttgtcaaatcctgaattctctcaggctcttaaacaatgattgctttttttttttcagtaggggtctcactctgtcgcccaggctggagtgcagtggtctgatctcggttcactgtgatctccacctcccggtttcaagggattctcatgcctcagactcctgtgtagctgggaatacaggtgtgtgccaccacgccggactaatttttgtatttctagtagagacagagtttcaccatgttggccaggctgggctcgaactcctgatctcaagtgatccacctgcctcagcctcccaaagtgctgggattataggcatgagccacctcccttgctggacccagtgattgcattttaaagtcttcccgcagtgagaccttgaatgactgaataataaaatggaaagagacagtcaagtttttgtgacccaagaagtagggagcatgcatgtaggtcagtgatgctcaaggtgtttgtaagatgcctgggctaagcatgctccctgccctcctgtcagtcttcatgagctactgtgtataattagattgaagacacatatggtaacctctaaccatatcagaggttatatattacaggtttctgccttgagtcatcagaagatacgatttaaagttcaaagactataacatactaagtcctgagtagtccacgtaagtatcttttacacatgttttccaaattgctgacttaattagaagaacttctgaatttaaaggaagcactgcatgtttaggggagaaattacctaaatgtttttactccacacttctgaaccactccattaggctattaacattaaaagattgttttcagatgatttccaggaggctactgaacaagcctcagttgtattcttaggacagtcatagcattaaatgtatatcttattaaaatagatagcaaattccatgatacaagaaaataatattaagaaagagcaaaataataagagtcacagaataaacttaagggaaaaaggcagtaaatgaaaggtatgcatcattaacaaaaggaaaactaatttgatattaataaatttaatagaatgttcttttgagaaatagctaggaagagcatccagtagattaaacaatcttgaagaaaatggaaaaggcacaacacagaatatgaacaagacacagatattgaatgtagggcataattgaaagggaatacattcttgaacactaatgttttcagagtgtggatgatatggttgatatgctcagaatgcctacactatttaatatatccctgaaatacctgaatatctgaacatcacaaagactgtggaaggacgtgaaatttgccagttgtacctcaaaacacagtcaccttttttttttttttttgagatggagtctctctctgttgcccaggctgcagtgcagtggcacaatcttggctcactgcaagccccgcctcccgggttcatgccattctcctgcctcagcctcccgagcaactgggactacaggcaccagccaccacgcctggctaattttttgtatttttagtagagacggggtttcaccgtgttagccaggatggtcttgatctcttgacctggtgatctgcctgcctcggcctcccaaagtgctgggattacaggcgtgagccactgcgcccagccaaaaacagtcacttttagaagcaaatatttagctttccagatgtgttactctccgattttgtttccctctccatttctttttctttgccacattgcttatgatgtataactgtttcacgttttaatgtcaataatgacagtgatatcttaaaacttatattaccatttaattaattatacaaatgggaatactttccggtgaaaaatgtatcattattcatattgacataatgactataggtgaaaactggatgcaaatggttagtgtatgtcaaaaaaggactaagaagggtaaactagcccaaagcaatattattgcacttctgcacaatagacaaaaaacaaatgcaatactggaccttctattcacttcacttacgtatttcctaatgtatcataactgttttcagttacattatggcaaaacatacttctcagactatttgcaggagcctattggacatccaggtgatagtttcaagccaaaacattaaattatatatttttcacaaattccttcggttgcttaggttttttgtgttttagttgcattttgagtaaaactctacacaatgtttgctatctactttaagccccttttaataggttcacttgatttaatgtgttctggtctcagactgtcttttggtttccttctagcaccaaaagcggggtgtgtttaaaaaatgttgtttaatgtgtatgcttggaggtgttatgttcaaagtctctacagaggtctagtggaatgttagccatagggtgactcttacttaggcttctggtttttgtccaatgtataaaactaaaattttggtgtcctttgtatacctttaatttcatctgaatacagttctgctagtaatgttccttcctgttgtgtttctattgcaggggaagggcaaccacagctttaaacaaaggcaagctgaaagaatgcaaactggatttatccgagatatttgacttttaaaaatctcaataaagatttccagttttctccaaataagtatcacacatcttttgttcatttattctcgcatattagaccctattgtaaattttggccgggtggagtggctcatgcctgtaatccaagcacattgggatgctgaggcaaggggattgcttgagcttgggagagtgagacatgcctgggcaacatggcaaaaccccctctctacaaaaataaatgaatgaatgcatgaatgtatgcatgtatgtttgtaggtgtagttccagctactctggaggctgagatgggaggatcccttgagtctaggaggtcgaggatgcaggtagtcatgttcacaccactgcaactccagcctgggcgaatgcgactctgtctgaataaaatatagtatcatttttgcaactttgcattctgattgagctggtatacacatgtgtgatattgtgaaatatatatatttggtcctggaccctgcttactgtcatacagctcctacaggttttagaatcgcctcatagcgacgtctttttgtatgctagtgagttgactgatggctggcagctcctaggtagctctaggatgggagcttagagggttcgcactttcagctgcatccccaaccttcaggacagggagaggggctgaaggttaagttgattgccaatggcgggccaacagtttaatcaatcatgcctttataatgaaaacctccatcaaaacccaaaaggacagggttcatagagcttctgcctagcggaacacatggagggtagcatgcccgtagagggcatggaagccccctgcctcttccttcattccttcccctgtgtatctctgtatctgcatccttcgttaggatatcccatttgccacaagatatgtgagaattccctagactatagagctggatgaaagaactagcgcctaggcagaagaaaaaggaaagcgactaggtcaatttgctgaagcaaaattacttggatcctacctacactgtctccttacaggcaatggcatggcatagccttgggtgtccatcctgcctctcaaacactggccttgtgatgttgggcaagatacttacatcctgtgggactgtttccccatttccaaagtagaaattagaatatttagactaaatacttgctttgaagaataaatgaaataacataagatgcaggcattacattgcagataaatttactagttatctttccttaatccctttaaaatttcacattttttttacaactacatctctagtatgtgataagtgctttggaatttcaagtaggaatattagtctaccttttaaaatgcatttgacttcagaaactgatttgatgtaaatatgtaaattaaatagcagttgtagctggtatcagacatggcattgcttttgaagttgatttgtaaataaccgaggtgtgacaaggccaacactaagtcagtagtacgtgctgaaaacttgtttggtgtgtgtgaagccatgaagaataagtctactccagtcagtcaacaccacacaactcaatatcatcgtgtgtcaagagctcaggcagtccctaagcagccctgtggtggctaacagggacacaaggatcgccagtgcggttgttattttgtcttgtcatatattcatagatttggtgggtaagaagacaatgaggccaaatggatcgaaatggttgattacttgcagacggaacaaaagcaagatcggcattgtgtcaacactgtgtcgctactcccacagtactacactgaattggagatactcagtaacagcacagatggtgggtctctctgcctgtgaggagcccacagtcaaaacctaaggccaattttgaaaccacactgaatcctgaacccaaacttacatctgaccgagctgtgaccattgggcagcaggggtgacccagctgctgaacatcccacatagaacacctagggatgtcattcacacttgtgaataggaagaactagtgtcaatgactactctgaactgactgcctgctgatagttccactaaatgaaagatgcaaatcaattgtttggactggacaaagaaccctagagggaaaggtccctcagtgggaggccacattgggggccttggccagctcctgcctgatgactgtatgtcctgctgggggtgccttaacaagggtaaactcttggtgtccaggggtatcacctgtgccctctgggattgttcttacctgtatgccctgactatcccaccactgcctcatccctggaaggcattcacatcagcttcggcttcctggccagagttgttatgaccctgaaatgctggcttgggttggacaaaaatggataatacagaatcttagttaggaagtcacctgcctttgtcagataggccttcatcattattaggatttgtataagatggctatgatgggaaagctgatgtgtcaactttgctacgccacaatgcatgagaaatgttcactttgaccagggtagatgctctgtgaagggttttctttaggagaactaacatttaaatgagcagactttcagtaaacccaattgccctctccagtgtgggtgggcctcatccagttccttgaaggccttcagagaagaagactgcggttctccacaagatgaagaaattctgcctccacactgcccctggatttgagctctcatatcatctcttccccgggtctccagcctgacatcctgctctgcgagatttggacttcccggtcacaacagctgcatgagctaggtcttcaaactcaatctttctctctctctctctactcactcacataaatacttgggtgcacagcccaccccacgacacacacacacacacacacacacacacacacacacacagaagaaccctaaccaataggctgcttatatttggggcccttaaagtgcataactgagatcgatactgcaggttgatctcactctgctgcatggctccaaacgcagaggcctgtggtgttcccctcccatgcactgacatccatgctgctcgtcactgcgactcagggtttggtcatctaaccatgtagaggtcactacaattctacaagtgttctctgccctccttctgcatgtgaggtcctctgttccatcctgagggcacagagatctactgggtatgtttccatccttccaagaaggactttggagcctggtgagggagatacacctgcaacagcggtaacagcaacgggcatagccagtgtgttcaccaactcatgagagatcacactaccaacatctcccacataaatttccccatcaacaaagagcttatcatggaaatgatcgtgttcgtaggtatgttggattccccttattctattttccccaggaatgcacagatacaaagaaaactgatgctggaatgttgtgttggagtgcaatctaagaatggaatgccctgcagtgatgtgatttctgaagcagtcaataagtctttataagttcttagatgaagcaacatacaagtctccctcagtttacagggaagtgacatgtatggaaaatccagtttatggaagactttggaaaaagatgtttgcctccctgtaacactcattccccaaatgccagcagcccctaccaatcattccaacaaccacagctgcactcagaaaagtccaaaatggcccagtaggtaacgatattctggctataagccacaagtttatgattgaaaagaagtatcctcaaacttcttgtttacataaaaagagtagggatattgtggtcggtacaaaggaaataacagggcaccaaggaggaggacacaatgtccctgggaggggttacaggcaccttcctcctctgtcttgctttgctttctgtgataagaaagtggttcagggataggcgtggtggctcccgccagcttgggggacatagggagaccccttttctactaaaaattttgaaaaacagccaggcatggtggagcatgcctgtagtctcagctacttgggaggctgagatggaagcatcgcttgagcgtgggagtgagccatgatttctccactgtaatccaggctgagcaacagagtgggaccccatctcaaataaaacagaaataaaagaaagtgtctcagggccagctgcgatgggtggtgaagcttcatttcaaaggtcaatcactgccatgaacattaatactcagatggttctgtggtagtcatagctctgagatcctgggactgatgtccttcttgatgaggatagccctctccaggctgggacacaagagcaaggtgccaggctaggtcatcaggctaccagggacagctgtctgctgtgggatcacagatgagatcaggagaaggacagctgaagggaggagaagggagacaacctcctcagaggaggtgcaggtgtctgttactgaagggaaggcatttgccctaagtcctgacattgctctaggctcccatggatggacacgatggtaccagaaagatccaaggctggtgggaggagcacgatagcttccatcacctcccatcttatgtgttcactggtcccttagggaagtccatgcaattttggaatctaaagggttattttctggcattccctccattcaccacccacaaagagaagggatttgagataaactgaggtcttcagggagaaaggccagatggagttgtgaggccttctcaaaagtccctctgccctacccttatggtgagtctcacactgcattcatcatgtcttgtgttcctgtgtgctctgaggtctctcttctcaacctcatgtctgtcttgggaagagtgggtatattgcagacagttttgcaacctaagggatttaatcagttttctgaaacttccctagcctgggcagtaaattcccagatcctagggcaccattccgaccacactacatgagactcactgggtgtgaatcatggaatcttcacttttaaaggatcctggattccaactttcatggaaacttgtctgagaactagtagagcaggggagtagtctcctttcccagctgcacagcttctttctcctttgtgaaggtatagaagggacaggtttttttgtgttctctgatgtacaaacccaagatcttcaggtgaagacatgctgccgttatggtaatgacacactcagggcactgtctccaaatcatacccaggccaatcctttcaagtctccatctcttaactatttctgaagaaatcaaatgtctcttgcctgtgcagtcccatgctataaaattctaaatattttgctatagcctttggctcttacccttcagatcttacccttgcacaaatatgcagcacaatagagttttccatgatgcctctgacctgtgcctccaccactcagtgctggtgacactgagaaagttacttaacatctctgtgactcctttctccaatagtaccatagaaatactactagtaaatttatgtagttcttggggcagtttagagcactgagtgtgtgaagaaaacatgtacggttgtcaggaaagtccctggcatatggtcaatttccaatcaattctagctgttactgttttgctgtttatattgttgctgttcccacatttccctgggagcatgttccagagatacaatgtcacaactacctttgaccccttccatgatcttttgattatcacttcatttcttcagggactcaaggactgagtctgtgggggcagggtgaggccatatttttatgagcataataaatattcagctctccttacagggtattgtggagcctaaatgtaatgctgggatttcatcatcatgagcttgtatgaaaaatttaaatggaaatttctctaggaaatcagaagtctaatgacctcttcatgtgatttgtataatgcttggaaaagtaattagtgactggataaggatagcatgtaaatatataaatattaaaaattttatgaattttctatttcatagtttgtgtgttttgtatcccatctatcgttgttttacatgttgccacagattctcctacattttcttctagaagtgtgataagttctatgatgcattttgaattaacttttgtatatggtgtgagacaaaggttcaggttcacttgtttgcatgtcaatgtccaattgttccaccatcattctctgaatacagcatcctttcccactaaattatcttgggaccttatggaaaaaaattaacgagaatatataggtctagctttggcccttatttctttccttatgccaatatcacagtgtcctgattaccacagttatgaaatacatcttgaaaacaggtaacgattcctccaatattctttgttctttataaaattgttagactattccagtccctttgcttttccatataaactttgaattcagcttatcaatttgtagaaacaaaaagttgcatggattttgattgtggttacattgaatgtgtagttcatttgggagaaactgacatgttcacaatcttgagtattgcaatccattaacgtggtatacctctccactgatttcagcctgctttaatatttcacagcaatgttttttaggcttctgagtacaggttttgcacatattttgttaaatgttaccactaaacatttcatgagattttgccgctatattaagtggcattgattttaaattttcaatagtttgttgctgcgaaagtcaaacttctcttgtacatattaccatgctaaactcacatatacatgtataaatatattcaagtcatggggtgaatctcatttggctatgatgttgtaaatttttaatatattcctagttttgacctgctattattatagcataaacataaatctatgcttttatagacatgagttatattagtctgtcatgttgttttttcatgatgtttgtctggttttgataccaggttgatgtggactctgtaaaatgttttgaaaagtgtgatctcttttcaattataaagagtttgtgtagaaacaacattatttctttcacaaatgttttgcaggattatccagtgaagtcaccagaaacgtgaaatttatttgagaaaaaatctttatttcatttctttgtttctgatgtatttcttcctttttgatgtataatgtaaaatgtataatcttttgcaaacactctttttaatgttctggcttgaatctatggtctgtatgccaaatgggctcctggaaatagtctctcttggaagaaaatggttaatgtcaccttaggaactgcatcagggaagtgaatagaaaggccagcattgcatttatttttactctattgtgcagaagggcaaaaatatttatttgggctcgtttaccctactgtggtttttaaggtacagtaaccgtttgtacccagttttcttctaccgtgatgtcaacatgaatgatgcctctttttacacttgaaagtattcccatttgtataattaaatataaggtcacattactcttaagctatcactatcagttttgtcatcaatgtgtgacagcattatgaactgtgccacacacgaaaaaatggagggatatggaaatggaaaacaatagtaagacatctgaaaaagtcaaaatcagtttctgaaagtaaatgggatgccttccgagcttatcaaccatttcattcatgctctgaaaatattagagttcaagattttattcactttcaataatgccctatattaaatcaccctgtcttgttcatattccatgtcgtgctttttccattttctgcaagatggtgtaaactactgaatactctattcatacctatttttcaaaagaccattcttttaaatgcattacatttgaattattttttcttttactgatgatttgtaactgtcttttattcattacctctttctttttcctttaagtttattctgtggctcttttattattatttcatagtattattttcttttatcatgtaatcagctatttattttaagaagatttgcatttaaagctatgatctcccaaaaaataaaacagagtcttgttcaataggctgctggaaatcgtccgagaactatcttttaacgtaaacagtctaatggaatggttcagcagaggagagtaaaaacatttaggtaatttctcccttaaacatggagtgtttcttttaacttcaagaggtattctaattaacagtcaccaatttggaaaatatgtgtaaaatatatttatgtcaaccactcaggaattagcacattactgttattgtactttaaaccctgtcatctaatgtctcaaggcagaaacctgtaatgtgtaatgtatggtatggttagaggtgactctactatatgagtctttaatctaattacacgaagtagctcatgaagactgactgacaagagggcagggagcatgcttagcagaagcatcttacacccaccttaagcatcactgacctacatgcattctccctgctatactggccacagaaatctgatgatctcttgccattttatcattcagtcattcaaggcttcactgcgggaaggctttaaaatgcagttattctttaagagccagagaattcctttggcaacaacctctcagacacacccaggaacaatactttgcaccctttgatccaatcaagttgacacttaatattaaacatcacctgcagacctggactttaatgattcctgagtggcctcactccagcttcaaagggcaggcttgaatttcttgccaaatttgaacttcctgctgccattcctgtggactgtaactccggacctgctgaatgagttcaaaggatcattatagtattgggattgggaaagttgtgaaggagcccttgtgacaaacaggaagcagcagaaagtatgaaagacactgtagagacaagaggagttgcttgatacatgaccctagcaactctctagctgctaagggaggaaacagagctgggaccaacacagccagtctacctgtgagagggctcaatttcccacatgaccagagcttcccatcctccatgcatgggaatctacgaccaaacttagatttccacaggatggtgggggggtgggacaaagtctacagattctgagcagctggcaagtttcagggtaccagagtaaacactgtcacgtgacctcagattgcttggtggttgaggccaaattatttactacctaacattttcagtgtagctctcccacttgcctcataaaatggagcaccataagggaatggaggtccctgtgcattcacagggaggtctccgtgaatgcatgcaatgcatgacattcagctatgctgcagcccaagcaaagcctcctcatgataccaacagaagaggtcacatgtactttctgtcccctttgcctgtgagttcccatctgtccaactaagacttcacctgtgcaaaacagacactgatatctgcagatgaaacacatatttcatcagtaattgtatattttgtagtggcttttgtggcccatatcaaagatgacatttttgtctaaaagcactgaattgctaaggagggcgacaaaattgggttctaatgtgtttttgcatttattctatagcaacatttaccaaccatccaagatgttctctgaaaaggctttaattatttcttttttttattattatactttaagttctggggtacatgtgcacattgtgcaggttagttacatatgtatacatgtgccatctaaactagtttttagtccatgttcgatcataagattaatgttgtcagccaaaaacagcattttaaagaacagcattttaaaaaatggaggtaaaataaattactaaatagcgttcactgcatagagaatatacaaatacactgcacattcctatacacatacatatatttatttgcctagtcaactatatataaactgtgtatttatcacacattgtcataaaagagtttgaacgtcactacttcaggggttatcagacaaaacgtttacaggccacttccatagccatctgtgaagatgatggattaagacatgctcagaataagttcactgttgtctgtagctttctacataatgcttgaaatagcactcagtgatgtttaaattgtcagtttgactgcagggtgtgttcatgtgtgtgttcctgcactcatctgatgatgctttgatatgtctccttttatttactcctttattatttactgggtcttatggttactattgagagaagagagagatcctctcatattgttttatattgttttatattcagtatcttttttaagaaaaaacaacaaggaagtaaaaccaaagacaggcagccccgcgccaggcccaaaacctgacccgggcctgcctggcctaaacctagtagttaaaaatcaactcatgacttagaaaccgatgttattcatagattccagacattgtatagaagaacattgtgaaactccctgccctgttctgtttctctctgaccaccggtgcaggcagcccctgtcacatacccattgcttgctcaaatcaatcacgaccctttcatgtgaaatctttagtgttgtgagcccttaaaagggacagaaattgtgcattcggagagctcggattttaagacagtagcttgccgatgctcccagctgaataaagcccttccttctacaactcggtgtctgagaggttttgtctgcggctcgtctggctacactattatgtaattcattagcatagtgccagtgacatctgtggtactcagtgtcaatccaatttacatgaattttaaaaatgttttcaagtgtgaatactttttcttaccaactttccttaagcacttcaaggagttgaatgcaattcaatactagtagttgatgttatatcatactgagctataatcctgctaaattgctaatctactaactgttgttatgcctcagctttcatgtcaccataatgcttagataaatgacacaaagaccaaaacatagaaataaggattctgagatattgacttttttttaatttccaaattttactttaagttcaggggtacatgtgaaggatgtgcaggtttcttacacaagtaaatgtgtgccacggtgatttaccgcacacatcatcacatcacccagatattaagcccagtatccgtgagctgttcttcctgatcctctccctcctcccacccccgcactccagtacgccccagtgagtgatggttctcccatgtgtccatgtgttttcatcatttacctcccacttataagtgagaacatccggtatttggttttctgttcctgcattagtttgctaaggataatggccgccaccaccatccacctccctgccaaggacatgagctcattcatttcatggctgcatagtatttcatggctgcatagtattccatggtgcatgtgtaccacattttcttgattcggtttatcattgatgagatggacatagcaaatatcacaaagacacttggtccttgctgtgggaaatatcgcactgtggtggggcagacagacaaacagaacagcagttgaagtgcaaaggagaaacacaggaaaggaaaccagaggaataaaaaacaattaatgtagtggccacgaggcaggagaaaataacacaatttttaaaagataatctttgtccattgcctttgcctcttttctgaaagtcaacttattaggtttgtgagtctattgctagactctattttgatctgtagattttcccccaatatcacactgtcctgaatactggagaagtaacataattgccatatggggctggatgattaaaaatcataatcaatagcttcattcaatgctcctaactcaaggcagcaccctcacctcagctgaggatcccatgcctcccaccttttcaggagttctgctcctgcactgatcattcctctcccctgaaccatcaacggctccctctatattggatcaacccccaagccaagggggatgtcaacttcttccaactcactgataacataatcaatcaataaataaaatagaattaatgtgaatcttgacattgtgtggggtgaattcccccaagttacacttcagaattgttctagatattctggttcattttcctttgtagaaaattttgaaaatggactccaatgaagtgtgttgcataagttcatgcagttttcctttgcagggcagcagacacatgtgttcgtagctacagaaggacatgggggaagaaggtgagttttcccgtagctggagaatgatccaatgtagagggagcagtcgatggttcaggagagaggagtgatcactacaggagcaaagcccatgacaaggtgggacgcatggtatactgacctgaggtgagggggctggcttcaattaggagtattgtatgcagaagggcagcagagaatgtccatgaatcactgaaggtgagggtggccttgggggtccctgacacagtgtcaacaaccgtgtgattcaccagcaggaccctgactcactacaatatggtgaaagctttctttgagtaaaggaagagtgaaggggtagagatgatgaagctgtcactcctgggagactatgcatttccccatagtatgaagcaacagccgagctgttgtctgttatgaaaaatacatgtactcccagcatttaacaataatccctccaactgcaagagaactggctcactggatccctcaaacgctgttctgcacaggataatgtatggaggaaaagtgcagcctggtgctgactttaatttttgttttctcctgcaggcaggtagagacaggacacaattgttgccaatgaactttcagtaggtcaaaaatcctgaacgtttgaattgctgtttcctccaagtgggagggaaaaaattcagtttcctgggctggagcaaagccttacataaaccttaaaacttagataaaggaaaaataagtgagaaaaaggccacgggcagtggctcacgcctgtaatcccagtattttgagaggctgagggaggagaatcacttgaagccaggagttcaagaccagcttgggcaacatagtgagacccctgctctacacaatttttaaaattacctgggcattgtggcacatgtctgtagtcccatctactcagaaacgtaaggcaggaggatcgcttgagcacagaagtcctacgctgtggtgcactataagtcgtccagtgtactccagcctgggcaaaagagagaaaccctgcctcaaaaaaggggttgcaggtttgtgaagacacattccagcctcgtcttcagccgggttgccactgctgcagccccctctcaacatttcaggcaggatctctcttggccatggtacttgcaagtgtgtgaatattgaatttagtgctaggggtttaatggaaattacaatgatataaagaaaaccgccacagttgtaaaatgcctttgcattttgtggctattaaatctggatgtgtgatatcgatggacagggtgcagcagtttgactaactaatgccactgtcacaagcaaggaactcatcttttctacacttctcaccggataagtgatagagacaaaaggattggaggttatgcaaactgagttttacaattattacaaattcaggatttcatcctgaccatttcttaaatatgatgaattttttcacgaaatttatattacaatgtgtttttctgaatatgtttagtcccttctgcctaccacccttccagaaaaaaaaaaaaaaagttttgaggaagaaacgggatgatgaaagagataaaagcgtttcatcacataatactccatgctgatttgttaacaattggagaaagcagaaaacctggcacatgaggagaagcaagggagggaaggaagacataagtagtctctgtttttcaaaactgttcctggaaactctccagttttcctcaagacatacttcccatgcaggctttcctagctgctgtgagtcaacgctgaaatcacactgactgatgagccatgatcaccttacaggttttcatggaaatcagttaccagttgacaggttcaaaggtggagtaacacaatattaaaaaagcacacaagtgtgaactgattgagtctacagcatgtataaaaagcctttataaaaattggccaagatgggaggatcacttgaggctgtgtgtttgaaggcagcctgagcaacacactgacacacctcatctaaaaaaaaaattaaatacattaggtgggcatggtggcggccatctgcactcccagctacttgggaggtttcagtgtgaggaggcttgcttgagcccagaagatggatgctgcagtgaggcgtgatcatgccactgccctccacccttcacaacagaaaaacaccctgagaaaaaggcatgtgtaaatatagacataaaattctttatttctgtcacaaaaagtctttctgagacacactccgcactaagggtgacgtgggactctctgttcccaacgtttccggatgcaggagaatggttggacaagacacacacacagacagacacacacacacaaacacagacacacacagacacacatacacacacacacacacaagcacacacacaaaagctctcgcgtccctttgtttccactacaaacaccctggaattcgggtgtggggataccaggaaaaccctggtcggccctgcctgtgcctgactcagtgtgtctgctataaagacacatgcacacgtatgtttattgcagcactattcacaatagcaaagacttggaaccaacccaaatgcccatcaatgatagactggataaagaaaatgtggctcatatacaccatggaatactatgcagccatgaaaaaggatgagttcatgtcctttgcagggacatggatgaaattggaaaccatcattctcagcaaactgacacaggaacagaaaaccaaacactccatgttctcactcataagtggtagttgaacaatgagaacacgtggacacagggaggggaacatcacacactggggcctgttgggcgatgggggtctatgggagggatagcattaggagaaatacctaatgtagatgacggcttgatgggtgcagcaaaccatcatggcacgtgtatacctgtgtaacaaacctacacgttcagcacacatatcccagaacttaaagtataatagtaattttaaaagaaagaaaatggttcacggcaaggtaaggtggctcagacgtcaaatctcagcatgttgagtcatcgaggcatgaggattccttcagccccagagttcacgaccatcctgggcaacatagggagaccccgttttacaaaaaattttaaaagcatatacccaggcatggtggagcatgcatgtaattccagctacttgtgaggctgagatggaaggattgcttgagtctgggaggtcaaggctactgtgagccatgatttctccacggcactacaggctgagcaacgcagtgagggcctgtctcaaatgagacaaaaagaaaagaaagtgtttcagggccagctgcgatgggtggtgaagcttcatttcaaaggtcagccactgccatgggacactgatgctaaggatggttctgtagtagtcatggctctgggaccctgggactgatgtccttccactcggggagggcagccctctccaggctgggacataggaggaaggggccaggctagatcatcaggctacgagggacagctgtctgctgtggaatggcagatgagatcaggagaaggacagctgaaaggaggagaggggagacgcactgctcaggcgaggggccggtctcctaaaaagggaagacattggccctaagtcgtgtcattgctctaggctcccgtggaagcacatgatggtgcaagaaggaaaccaaggctggtgggaggggaacaatagcttgcatcatgccccatcctatgtgttcagtggcccctgaaaggagcccatgccttttggggatcgaaaaggtcatttcctgacacaactccattcaccacccatgaggagcagggatttgagataaactgaggcctctggggagaaaggccagtaagagttgtgaggtcttctcataagacgcactgccttacccttatggtgattttcacactgtgttcatcatgtcctgtgtttctgtgtgctctgaggtcgctcttctcaacttcatgtctgtcctgggaagagtggatatatttcagacagtcttgctacctaagggatttaataaagtttctggaagttccctaggctgggcagtgaattcccagatcctaggacaccattgtggccacactacataagcttcactgggtgtgattcctggaatctgcacttttaacagatcttgggctctaactttcacagaagcttgtctgagaactactagagcaggggaatagtctgctttcccagctccaaagcttctttctcctttgtgaaggtatagaagggacaggtttgtagtatataaaattttaaaaatgtatgtttgttctatttcatagtttgtgctttttgcatcctgtctatctttatcttacacgatgctgcagattcccttacattttcttctacaagtgttgtaacattagctttcacatttagttctatgaagcattttgagttaacttttgtgtatggtgtgaggcaaagtttgaggttcatttgtttgcatgtcaatgtccgactgttccagcaccactcctggaataaaacatccttccccactgaattctcttggcactttatggaaaaatccatttaacttgaatatatagatctagcttcggactcttatgccttttcttctgccaatatcacagtgtcctgattagcatagttgtcaaatgcatctcgatatcaggtaatgtgagtcctccaatattcttggtcctttataaaattgttaggctattctagtccctttgctttcccatataaattttgaagtcagcttgtcattttatagcaacaagaggctgcagggatttttattggtttacactagacatatagattatttgggagtaactgacatattgacaatcttgagtcttgcaatccattaatgtggtatgtctctctatttatttcaacgtggtttcatatttttctgaaatgttttttaggcttctgagcacaggtcttgcacatattttgttaaattttaccactacagatttcacgggggggtttgctgctatattaagggatatcgactttcaattttcaattgtttgttgctggcatataaaaatagcattgacttttccatgttcatcttgtaccatgttactttgctaaactcacatggaggaaattccatttggctaggatgtaaattttttatgttgctagtttctaactccggttaattgttttttacagagtttgtgtctatgttcatgagttacattggtctgtcatgttattttctcataatgttgtctggttttgatatcaggcttgtgcttgctctgtaaaatgctttggaaagtgtggcctctcctcaattatcttgagtggagaactggtgttatttctcccagaaacgtttggcagaattatccagtgaagtcaccagaaacatgaggtttaattgagaaatatctttgttgagtttctttgttgcttttactgaatccaattcctttaattgatatacggctatatatgtcgtttatttgttttttaacgtttcatttatgtccatttttatgggtatttagtaggcacacatacttgacatgttttgatgcagcttgcaatttgaaatgaggacatgatggagattgaggtattcctcctctcaagcatttatccactgagttgcaaataatccaattatactgttcatgttattttaaaatgcacagttacactctttttttgtttgtcttttttagcacttgtccactgtttattcattggaaggaaggcccggtcctaggtagactcgacctcccccgaggaaccttggagccaaaggcaggaggcttccagaatgcttagactctgatcctccttactatcaccctgagacctgtctcaccaaagccttcttctgtccatggttttctcactggatctacaagggaatccccccacaagtctggggtccagtgtggtcactcctgatggttttcaagaaggggaaggccaggaacctagggaaatacctcatttggcccgaccacaactggccagagcaggacaaacatgccatgccatgtcaggcgcccagttacccagctggagggaaagtcagtcctgagagggtggaaggggccagtcacaaatcccggatagatagtgacctgggctccacaggtgagctgggctctgatggctttccctgcctttggaaacaaggaggagaagttttttgcagaaaaagcctcttttccttccagaactgctgttttatgacagctgtttcggcagtgagtcttgtgtctgttatgagggtgggtccccctcttggccctgctctacagaaaatgatggagcagggcaagctgtcctcagtgaatgtacaccagaatggcctggacgtgagccacgccttcagaaaccatgcgtgctccaagagcgctacagcatcaaataaggcctatggagggtccccatctgaagggcatcggggaggtctctgagtcgaggtaggtgtctcagagaagagggtgacagcccagcctactgcctggagttctggcattgggtagggactgcagagggcccgggaacggggaggctttcagggaagtcctaggggctctgaacacctctgctccttccatgaggacaaggaaatgttgtgcacccagactgccaccttaatgtgcttcccacagcactcaattgatggggcaaggatgcacaggagaccgccccccctccccagtccagtgaccctgctgcccacagtgcctggcttccccgctgtagggttctgacccctccagaatgatcctgctcgtctcctctgcacaggaggcagaggcacgtccctgcagggcacagaaaccatgccgacatcccacagcaggggctggggctcagagccggcatcgtgtgcagactgggctaggactcaccttgggagagaacttggggagccccttcttccaggggccacatcccactgagatgagtcgacccccatgaggatctgcaggatcttgtctgacatagcctcattgggaaggggggtctgatactgtgcagagtgggtccccggcactacagactgggatcccaataggctctgctcactccaccagccatcagccttgacaggccaggtcctcccaggcctgctgtccccacagaccccttttgggctcatcctgaggctctgggaggtctgccttctgcagggcgagcacaagctcacagccaggacataagcggcattcaaagttcatagaaacttgtccccatgtgcctgaaggtagcaggaggaccacacaagacagacctcaactgtcctgagggcagcacttgcactgtccacacgaccctctgctctggcctagagggaaggccaagccaagccaggcctggtcagctgtgcagggcaccgtgagtccttctggaaactgagcccacccctgacacgacacagatgaaaggcaggagcgtggtgagcattcccctgcctgggccttccctgcatccatggcctcctgtgcacagctggaccccagggttgtccaaaaggggcccagcactgcccactgggaagtgcccagagcagaaacgaggtgaaggcacagacctctcccaggagaccccacctggcctgatgtgcagccccattcctagaacatctcctgaagctgtctctctttggcccatgggagctccttcaggacatgctgtctcaggcctggactcttgaggaccacgtggtgctcaggcctccatggtcgagttgagaaggacacactgcgacctgcatcccacgtgggctccagcctcccgagtcaccctctgaggcattaaatcatggggagtgcccagaaccctccatccctactccctgggccttcctccttttcctcttccttctcaaagaagtttctgaaaacaggccagctgggccccagggcaggtgctagactcgcctcagtgacagggcatgggatgagggcaagacccctccaagcccctcccccacacccttcccctcctggcctagaagaaccctagggggcactggaggggttggtcccatctgtgcgagccaacacccacagctgccagcaccaacgccagagaacagcaggggcgcctcactcacaagcacccctccaagtgtgtcacgacggcaagccttgagccagggaatggagagaatcagtgtctcagacccagagagaggattcagggaaacggtgcagtaggccccttggtgtgggaagtcatggcatggcgtggattgtccgggatggcagaggggcccagtgcccaggagcgtctcacgcgctatggagacagatcctcatcttaggtggcaagggggccaggtgacaggtaaggcctctcccagctgggttctgcaccagggctgaagcccagaccgagccgccctggggtgagggtatgaggcctggagccccgagccagcctgaaccctggggtccgtctcaggagcagcctgagatgctctgacagcaaccatgccccaagctgcacgcacccctcactctgggttcagcagcctgtgggtgtttcctcagtgtcacaccaggtgggccactagagacccccaaaactccaggggcccaggttcatgaggcccagccctgcaaggaacaaatgggcttggtggagaagtggaccaaatctgcttttctttcagccaaacccgcaaagatccctaggaaggtcctgggcctggagcgagtgtccctggcacccaggcctctgtgggcatccctcagcatgcagaccctccccaagggggatgggctggccctccgtggcccaccagcccagctccagaagtccagaagctgaccctgaggccaaggcccagcagcatgaggggacttctgcagagccccgggcagcaggacactctctgggggctcagccgcccagagtgcagcaagtctgttcctatctcaggacagaccccaggattttgggcgatttctgtgtgggtgtcctctcccaaaactccccatgtacctggacatccagggctcatggtttctacagtgcagctttgagcaggcatgctgaactcctattccttccacatctgctctggacatcgccaggaccaatggacaggcccatccctgcaaccccagcagggctccaacaaccagacccggcccaccccactgaaaacccagaggtaggaccacagaaactccccttgcatggtggcatctggatctgacgtttctctgaggatagtgacctgcacagccccaaagcagtcagtactactgctaggccatatgggatcaatatcaatggggaagctgggccctcagaggctgctggaggggagagtgactgtggcatctgcacagccccagccagccagcagcatatcacatgtcctcatgtctgcccattcgtgtgacagagcctctctcacatggcaagcgtcctagagccatggggctgcgatccagcccaagccctccccaaccaaagccctaagagaaaaaggacccaggggagccatgggtgccccagaaacagctaagatggatacacaggggactgagttcctgggacactggccagaactagactgtggcccaaggcagggcaagccccttaaagcagtgtgtgggtacgcagggcctgtgcatgcctggcagagccaagccagtgacgttaccaggctcaaagagcaaccatccacgacggccatggtggggcaggagcaggtgggccagccccctgcctcatcaactcaaggaatcagggatggctgggttcccaggccctgagtgcccaccacctgaccattagtgaggcagagacatgaggccaatcacatgatcctggggccctgcttccatcttacaagaactccttcagctcacagcaccaagaaaaatcctgggcaagtgagggtccaggaggccaggttcctacgtctattctccttgtcaggtgcattttgccactgggaaaagtcagaaaaggtggcctcagtccatgtaagcaggctccaaagtaggcaccatagctgcagggggagaaggagctcctggcggcactggaataggctctggcaggatcccagattctgtgattctgtcccccgcaacctgttttttgttttgtttttttttttgttttttttttttttttttccccttgagtgcttggaatcgtccccattttacacggagtctgcagccattgacaatcagtttattagaggacttgtcggcacccacttctgtagccaccctgtggaaagctggatgaaaggcacactgctatctctgcacaacggtgaccatccggatctcaccaacaggcagagacaatttcttaaatctgtctgagtaatggtatccgccagatcaccaacatacactctggtggaatccttctctgctggtgattcaagatgaagcgtggttgaagcctgctttagaagcttatctgctacagggtcattgtttccacaatatcgatctttaatattttgaccagcaagagggggtcatcgggatctgcaggcttctcatgtctttacggacagtcctctcctttcacctggacagaacaaatgtaaggcttattcctcagccagtacagtgtggtccgggccagtttgagcagcatctcactactggacgtggctttccccagcagagcaactggccatgttctatcagggttagaaattcctctgtccatatctgcagtcacctttaaaggcaagtctgtgtcatgaacctgtatgggcagtcatactctaggtctaagaggcaagtctgacagacatttcctgcaggcttggcccccttcagtcttcttgggatgcatgtgctcccccgggcaccagccaaacactgaatggcctgacagagtttgcattttttctcatagttctccttggtcatgtttctctgagacatatctggcacagaatggagaaatcgacgtcctcccagttttgcctgttttaggcgctggaacccagagaggtcgccatcttgagagggtcggcaggcagcagtagatttccaggtgggagagaggacccccagaatcccaccagacccagctctccttcctggtgctgttcttgaggccctggataattgcctttcaccatacgtgagtcatctttcttgagtcaaggtgaacctcacttccaaggaatccccattcttgtaggacactctgtgcttcctggtctctccaggagctggctaaaattctatgctttttcattggaatactgagatagacagaagtgcagtttttttacaagtgtctttatccagccatggcattaatttcccgtttggtaggaggacaatagtcttattttcatcagtatgtgtagtgcatgttagtgcacagcatgaaccttagaggaagacttctaccttgagatgtgaaatgcatcaatacttgtgtggagttaataaacctgctctacctccacaagtgtcagcttcctcacccatacaatggggatcacacaacgacttcttcaagttgttgccagagttacattcaccaagatatttaaaagtacctaactacaagggtccacagcattaataaaactgcatcagacttcaatgcacacaaaaggaataaagtacatgcgtccaaagacgagatgagcagctttctaagcagcctgatgagcatcagaatgagatctacatttaagtagaattcttcacagctccactgaagaggacacacatgggggctccaagaagataagcacatggccattgcacagtaactggtgtagtgtggatggaatccctgaagaccctctgaaatatcattacacaactggctctcagggaacactggaacaaatcaggaaactcagcagatgctaccaggaactgggtgagcagaggggggtcacatccacaaatttaagcagaagacaccaaaccgcaaggagctcctggctctgcaacagcagctgtggtggcatcggggccaatcttctgagacagctgctgtgggattgctgagaccatgtgtttttgcagccacacacccaaaagcagtgcatttgaaaacggatcacaacactctcctctccattcatctttgttttaagatgactgatgatggataccctcacattgcaacatccccaccaacacttgtggacaatcgtatttagaaaatcccacctaaagagggaacagtcaggagtaggatgagaatattgagggatgggggagagatgcgggtacttcaccccagactctgtttgaaacaagagccattgtgctgtggtctccctatacttcctcattttgccgcattcgtagatgccacctggtttttgtccctttacttacaaaggtgctgatgagcccatgggtggttaatcctgaaggaggaaattcttcacaaaatacaataacagagtctaatttcaatgaccaggttttttagtttttttttttttttcatagtatcccacattaaaaatcacaaatgaaacctgttggaatgtgtgatatgaacaaagtcttattttcatgcagattaacaacttggcttttacggattacacataaaagcataaaagctggtaccatcccagaatcaaaggaacagtcccagaggacatacggaatttagtgacatcaattattaagaggctacacgaaactggaagtgctcccagaagttttcattgtctagacagaaaaattcaagacatcagccccatcgagtaaaggtacgtcccctggctgccgtgggtgatgagcttttcattcaaagcagagatatgaagcctgaggtgtctcaaagtcaccccaagtgctccacaccttgaaagtcactcccacaaagctggaacaccatctgttcctgaaggatcaggtcatgacctgtatctttgagacactgggcagtcaggcctcagttgagatgaagccaatgatttcaagtgtaaaatacctaaaaccaaatctttaggtatctattagcagccccgtccacttaaatgggttggtgaacatggcccatcagacagacacacacctgagcactggggttttctcctctgttcttagcatcccctgggtaaaccagtaattaccctccctcatgcctcaacgttcacatctgtgaaaaaggtgatggggagagtggcctttccaggaaagcggagcacatgtcaacacctgctaagctctgaatttgtgcgtgggcccaggcgacggatttctccagaaagcggctgaactgggactctggctgaagagagcggaggtcagcagcacaatgcacagcccctgggacctcaggccagttccatagcagcttaggaaagcagttgggtccctaggctggaggaggcccggtgctctggaaagatccagggtgcgggtggagaggaaacggagctgagcagtgagaggtggggtgagcaccacgtccatccggtttgggcaaaggcaaggtgtcctttgcagtgtcacaccctcctcactactgagcccagaactgcctctcatggccttctccagactcacttcccatggccaggaggtggcacatgatcagtagccggcacatgatcagtagccagcatcattcttctatacagttaacttcttattgactaccgtctctcggctgtgctatcaaataggacgtcttattcagtctttctaactatgtttttggtacccattaccatccccacatcccccaagctccccactacccttcccagcctctggtaaccatccttctactctctgtgtccatgagttgaattgtttggatttttagatcccacaaataagtgagaacaattgatgtttgtctttctgtgaatggattatttcacttaacatattgatctccagttccattcatagttttgcaaatgagtggctctcaattttttttatggctgaagagtactcccttgtgtgtatgtgccacattttcttcattcctctgttgctggacgcttaggttgcttccaaatcttagctattgtgaacagtgctgcaacacacatgggagtgcagatatctcttcgatatactgctttcatttctttggggcataaacccagcaataggattgcttgatcatatggaagctctatttttagtttgtagagaaacctccaaactgttctccgtagtggttgtatattacattcccactgacagtgtatgagggttcccttttctccacatcttcgccagcatttggtatttcgtgactgttggttaaaagccatttgaactggagtgagatgatatctcattgtagttttgattggcatttctccaaagatcagcgatgctgagcaccttctcacatgcctgttttccatttgtatgtcttcctttgagaaatgtccactcaaatcttttggtgatttcttgatcagatattagattttttccgatagaattgtttgagcttcccgtatactctggttattaatccctcgtgagacgggtagtttgcaaatattttgtcccattctgtgtgctgtctcttcaatgtgttgattgtatcctctgctgtgcagaagcttttgaacttgatgtgatctcatttgcccgtgtttgctttggatgcctgtgcttgtggggcattactcaagaaattttcgcccagggaaatctacaatctaaatgtcttgtagagtttcctcaatattttattgtagtagtttcatagtttgaaagcttagatttctttaacccattctgatttgatttttgtatatggtgagagataggggtctagattcattcttctgcatatggatatccaggtttcccagtaccatttattaatgagactgtctttccccagtgtatgttcttggcacctttgtggaaagtgagttcactgtaagtgtgtgggtttgtttctgctttctgtattctgttcaatgggtctatacgtctgttttaatgtcagtaccgtgctgtttgggttactatctctctgtagtatgatttgaagtcaggtaatgtgagtcctccagatttgttcttttttgtttagaatagcttggctattctgggtcacttgtggttccatatgaattttgtgattgctttatccatttctgtgagaaatgtcactgtctgttgttgtttgttttttttttttagggattgcactgaatctgcagattgcttgcttgtatatgttttagaatgagttttgctagctagtgtccttcaaataattttttctttcaatataaatataagtttttggataacatttcttgaaaggttccctgttgtacatttaatatctaaaggatctgtattgacgtaacgaccctctgggtttgctgatattaatatttgtagtctctgtgtctccctctctcatcagtctggataaaggtttattaattcgagttgtcttctcaaagaaacaatgtctgggtttcactgataatttctatagatttttatcaattctatttaattcatttttcctcatgtcttttaaattttttccttctttttttctccttttttttttttttttttttaacagaatctcgcactgtcacccaggctggagtgcagtggcatgatctcggctcactgcagcctgcacctcccaggttgaagagattctcctgccttagcctcccgagtagctgaaactataggcgtgcaccaccagcccagctaacttttgtatttttagtagagaccgggtttcaccatgttggccaggctggtctcgaactccagacctcaggggatcggccacctcagcctccaagagtgctgggattacaggcatgagccactgtgcacggtctaacagttttccttctgactttgggtataatttgatttcatttttctagtttcttaatgtggaaacctagataattgatttgagacttttcttcctttctggcataagtattgaagggtataaatttccctctatgctttagtttcatcttgcaaagtttgataagttgagttttcattttaaaattttttcctgcaatttcttctttgatctctgagttacttaaatgtgacatttaatttccaagatttcatgagttgcagacatctttctacaactaatttccatttcaattctttttttggtcatagaacatgttttataacatttcattccttttgaatttgttgagatttgttttttggcccacaatatggtctatcttggtgaacattctatgagcacttgagaagaatgtgcattctgctgttgatctatgaatatcaattaggccatgctgtctgatagtgttgttcaagccttctgcatttatatatcctgattttttgtacactttttctaccaaatgctgggagtaatggggaagtcttctactaaaggcacatgtgtttatttcttctttgtgatgatgtatcagttgtccctcaagtattttgaagttgcctacatatccgtggtgtttctgtcttctgaatcaatgcacctctctatgattattatgtaatgtcccactttgtcccttgtagtaatctccactataaagtgtgctttgtgagatactaatttcacactttgagtttatgtgattcatatttgcaggaaatatctttttccatcttttacttgtatcttatttatttgtagagtggggctctttttttcaagatacagattactgataaatatactgtgaaaatcaagatcctcttgcaactgtgcaacaacaataaaagtaccgaaaaattagatgcagaagttaatatacaactaaaatgttacgcagaaatccacagaataatctgctcggctcttcaaaagaacctcaatcaaactctttgacagccttcatagaaagatatcttcacattaaagtggtatatttatatgaaaaatataattttatccccctattttctacagtagggttttgggtaaaatttcatttcacgaaggtgttcttttgctaaaaatcctttgagaaacaactatataaaatgatctctcagagctctcttagctttgaaatgtggagattcaaatatccctctgtagattgaggaggagatgtaaaaaaaaaaaacaaaacaaaacaaaaaaaaaaacaaaaaaaaccacgggggaggaaatgttggtctcctgcacttttcttttctttttcttcctagactaaccagtttgtgttggtcctccgctgagctgttaatccagggaagagttgcccttctgaagaatatgtggatttaatggagaccaaggcaggtttgaatcgctcagaaacaacagccagaataacttttgaagggctgtaaatgaagatgattcaaatcctctgatttatgttacttttcactcaagtttctaaaagtgccttcccatcaagagctgtttggctagggacagaaacgtttgttcagccctatttttctcttccttccttccttccttccttccttcctgcctcccttcctgcctccctccctccctcctttacttctttccaccctccctccctcgctccatttgtccttattttctcccttcctccctggctcccttcatgcctcactcccttccttctttcctaccttttataaaaagaagtgaactgatatttgtaaagtagaaagatcagaagagttcacaattattttcgagttttcttttaacttttattttgggttcagggtgcatgtgcaggtttgtaatataggtaaactcatgtcatggggtttgttgtacagattatttcatcacccaggtagtaaggccagtgcccattagttattttgttgatcctctccctcctcccagcctctaccctctgataagccccagcgtgttggccctctctgggtgtccatgtgttctcagcaattagctcccatttataagtgacttcatgtggtattgggttttctgctcctgcattagtttgctaaggataatggcctccagctccatccgtgttcctggaaaggacatgatctcactgttttttatggctgcatagtactccatggtgtatatgtaccacattttaaaaagtgcagtctgttattgatgggcatttaggttgatcccatgtctttgctattgtgagtagtgctacaatgatcatacatgtgcatgcgtctttataatagaaaggtttatgtacctttgggtatagtcccagcaatgggattgcagggccaaatggtatttctgttcttaagtccgtgaggaattgccacactcctttccacaatggttgaactaatttatactccaaccaacagggtataagcgttgccttttctgcacaaactcaccagcgtctgttatttttgttcttgctttttatccagccttatagactctgactctgttttttgagacaggatgtctttctgtctgtgaacgtgaattccgctggtgtctgagacttgccaggattccagctctctcaaatgcctgtgttcgaactttatgaatttgctacattttcactggttttcttcttaccccctgttatggctgtcacttcttccacacatgctctgccacaggtgatgcagtttgtttgtctcatccctcctcagagggactaagtcaccattttggatcagttcccatggctgccttgttacctcaggtctctcatgatctaaaaacaaagcaaaacaaaagataacgttatagattattaggctgtttttcattttcaaggctaaagtgactttctcttgaggctttctaaatcttacctggtggtagaactctcctttgttaatcttttgactactggtacaaaaatacagcattcaaatatgtgaagtaaaagataatccaggggctagctgactatggcttgagatctaaatacagcccatggcttgttttgcatagccattgagataaggatttttttccatttaaaagtattattgctaaaaaacacaacactacgccacagaaactacatgacccacaaagactgaaataattacgatcagatctgttaaagcaaaatttggtgatgccgtattaatcaaatacctgttattctgctttgcattattgcatacatcttttcatccattaattaatttatttacacacggattgaaaatatggatgttactctatcccctcaagaaagcgtccagctttatgataccatgatttcagtctgggaaacttgtcccagggatcaggtcaatacacaaacatacatttgaggtaggagactggcaggacttgttttctggtcataactgagcctagagcctacagtcagaatctatggctatttctgaaacatatactgtctgaatgacctacaggtatattcagggaaatcagttaccagtccagagatttaaatgtgaagtaacacaacctaaaaagaaaagagtaaacaggtgtgaatgtatttattctacagaagaatttattcaattacgtttattggaagcatggcagaaaacccagaaccagagaacaaagtgattaataaaagcatttataaaactggccaaggtgggaggatcacttgagcccaggaaattgagaccagcatgggcaacacagtgagaccactatctaaaaaataaataaataataaataaaccaattacccaggtgtggtgtctgcacctgtagtagcagggactggggaggctacatcgggaggattgtttgagcccaggagatggaggcttcagtgaggtatggtcatgccactgccctccagcctgagcaacagagtgacactctgtctggaaaaaaaaataaataaaaacggctttataaataaagatatgaaaataatttatttcttccacaaaaggtcttcctgagacacatcctccagtaagggactgtctgttcccaacgtttctgaatgcatgagattggacaaagagagacgaaagctctcaagtccctttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagtgtgagtgagtgtgagggggagcgtggggggcttcctgtgggttgtgccacttggtccatggcctctgaggtcgtcatctttctactaaaactcagcgatactgccatggccttgctgttgtggggtcccgggcatgggacgaaggagggccatagcggggaggagggtcaggtgagcatggagtgagtttttttttttttttcacggagtcttgctctgtcaccaggctggagtgcagtggcgcaatctcggctcactgtaacctccgcctcccgggttcaagtgattctcctgcctcagcctcccgagtagctgggagtacaggcgcgcacaaccacacccagctaatttttgtatttttcagtagagacgggttttaaccatgttggcgaggatggtctcgatctcttggccacatgatccacccgcctccgccccccaaagtgctgggattacaggcgtgagccaccgcgcccggtcatggagtgagttttgaaggctgactttatttgaggtatttgagtcctggtgggggggaacccacacacagagaggagggattccaaagtcgttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcctgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaagaagtcttgctcatctttggttcacttccttcccaggtatttgataatattggaaattgtttctggctgcggttgtccacgcctgtaatcccagcactttgggatgctgaggcaggaggattgcttgagctcagtagtttgagaccagatggggcaacaaagcaagactctctctctacaaaaataaaagagtgaatgcatgaatgtatgcaagtttgtatgtagctatagccccagctactctagagccgaagggtggaggatgcctccagcccaggaggtccaggatgaggttaatttttttttgagatagagactctatttttttttttttttttaaaattcagtatcatttttgaaattttgtgttctgattgagctggtatgcacaggtgtgatattgtgtaatacatatttggtcctagaccctgcttcctggcatacaactactacaatttttaaaatctccacaaagtggtgtctttttatatgctagtgagttgactcatggctggcagcacctaggtagctctagtttggggaataggagggttggggctttcagctgcccctcccccccccccagcattcgggaagaggcagaaggttaatttgatccccagtggcaggacaacagtttaatcagtcacgcctacagaatgaaaacctccatcaaaaccaaaaggacaggattcagacggcttctggctagctgaacatatggagggcagcatgcccctagtgggcacagaagctccctacccctttccccataccttgcgctatgtctctcctcatctgcttcctttcttagggtatcccatttgccacaaaacatgtgagaagtccctaggctatagagctggatgaaagaattagggcctaggtaggagtaagcggcaaggaaccagggcaacttgctgaagcaagatgacgggtcctacctacaccgtctctttagaggctatgtcatgaagtagccatgggtttccatcttgcctctcacacagtgctcttgatatggtggtcaagatacttacaccctttgggactgtttttccatttctaaagttgaatttacaatatgtacactaaaaatacttagtatgaaaaataaaggaaataacatcaaggaggctttacattgcagataaatttggcctgctacttagatttccttttttcctttagatttcaaactttttcatttcatttttccttacaactacatttctggtgtgtgataacctgcttttgaatttcaagtaggaatgtcaagttcacttttaaaatacatttgaattcagaaaattatttgatttaaatatgttaatttaatagcagtgtagccggtgtcacccacggcatagattctgaagttgatttgtaaataaccgaggtgttataaagccaactgaatgtcagcaatgtgtgctgaaaacttgtttgctatgtgttatgcgggtggatcacctgaggtcaggagtatgagagcagcctggccaacatggtgaaaccccatctctactaaaaatacaaaaattagccagatatggtggtatatgcatgtaatctcagctactggggagtccgaggcaggagaatcgcttgaacccaggaggcggggcttgcagtgatcggagatcgtgccattgcactccagtctggaaaataaagagtgaaactctgtcaaaaaaaaaaaggaaggaagaaaggaaggaaggcagacaggaaaagagaaaaagagaaagagaagggaagaaaatgaagaaagaaaaaggggagagagagagagaaggatggagagggggaggaaggaaggaaggaaggaaggaaggaagggaagtccctctgtccgtatttgcagtcactttaaaggcacgtctgtgccatgaacccggatcggcagtcatactctaggtctaagaggcaagtctgaaagacattgcctgcaggcttgacatccttcattattcttgggatgcacgttctccccagggcaccagccaaacaccgaatggcctgacacagagtttgcattttttctcatagttctccttggtcattcagataatatgggttctctctaagacatatctggtgcagaatagagaaggttgcatcctcccagttttgcctgttttaggtgctggaacccagacaggtcgcaatcttgagagggtcggcaggcagcagtagattttcaggtgggaaggaggacccccgcaatcccaccagacacagctcttctttctcatgctgttcttgaggccctgggcaattgcctttgaccgtatatgattcatctttcttgtgtcaaggtgaacctcacttccaaggaatccccattcttgtaggacactctggacttcctggtctctccaagaactggctaaattccatgtttttccatcggaatactgagatagacaaccttgaagtgcagtttctttacaagtgtctttatctggccatgacattaatttcgcatttggtaggagggtaacagtcttattttcatcagtatgttcagtgcatgttagtgtacagcatgaaccttagaggaagacttctacgttgagatgtgaaatgcatcaaaagcttgtgtggagttaataaagctactctacctctacgagtgccagtttcctcacccataaaatgaggatcacaagatgacttcttcaagttgttgccagagttaaattcagaaagatatttaaaagtacctaactgcaagggtccacatcatgaatgaaatagcatcagatttcaaagtacacaaaaggaataaagtacacatgacctaagatgagatgatcagctttctaagcagactgacgagcatcagaatgagatctatatttaagcgatttcttcgcagccccactgaagaggacacacatgggggctccaagaaggtacgtacacggccattgtagaggaactgatgttgtgagggcggaatttgaaatgtcattacacaactggttctcagggagcactggaagaaaccgtgcaacccagcagatactaccaggaattgggtgagcagaggagggtcatggccacaaatctaagcagaagacaccaaaccacaaggagcttctggctctgaaacagcagctgtgatggcataaggagcaatcttctgagatagctgctgtgggattgctgagagcacatgattttgcatcaatacacccaaaagcagtgcatgtgaaaacagatcacaaaactctcccctccattcatctttgttttaccatgaccaatgatggataccctcacgttacaacatccccaccaacacttgtggacaagtatatttagaaactcccacctaaattgggaacgctcaggagtagggtgagaatattgatggatgggtgagggatgtgggttcttcacctcatagactctgtttgaaacaagagaagagctgctgtgctgtggtctccctatacttcctcatcttgccacattcatagatgccacatagtttttgtccctttatttacaaaggggctgatgaacccatgggtaattaatcctgaaggagaaaattcttcacaaagtacaataacagggtctaatttccatggccaagttttttaggtttttttttttttaatagtggctcacattcaggaatcacaaaagaaacctgttggaatgtgtgatatgaacaaggtcttattttgatgtagattagcaactaggcttttacagattagacataaaagcataaaagctggtaccatcccagaatcaaaggaatggtccctgaggacatacggaattagggacatcaattactaagaggctacaggaaactagaagtgctcccagaacttttcattgtccagatagaaaaattcaacaaatctgctctaataagtaaaggtacctccctgactgccatgggtgatgggctttccattccaagcagagaagtgaagcttgaggcccttcaaaagcaccccaagtgctccacaccttgaaagtcattcccacaaagctggaacaccatctgttcctgagggatcaggtcatgatctgtgtctttgagacactggccaaacagactctgagtcctgaatggatcttcactgggtaactgcatctctattcctgcattctgctgagatggttgatggagccatgagtcacatacctcacctcttaagcaatcaattgtccagctacatccttggccatgttttcatggcatgctatctgaataggctgagaatcttccaaatcatcacaggctgatttctttttcttagcagttctgttgttgatttatttctcctctcttggattttgctatcagcagcagggagaaacatggcaacatcttcaatacttggcttagaaatcttagctaaatacccacgttcatcacttgcaaattctactttgcatctaagagtatgcagtttagctaaattctctgcgattttctcataaggaatgtgaatccatgtttccaataacatgttccccattcctgtctgagacctcaccggaagcacctttaacattcatttttctagcaacattctgttcttgatgttggatgtattctctaagatgacagaaattttctgtatagctctcctgtttttttctgagcacttgccagaatttatcttaatgtccatatgtctaccaattgccccttcaaggaagtgtaggctttttctgtcacttactttgaaactcttccagcatctcttcacgacccaattccaaagctactttcatgctgttaggtatttgttagagccgcacttcatttcctggtaccacaatctttgagagttctctagggctgcagtaacaaatcaccacaaactcactggcttcaacaacagacatttattgtatcacagttccggaggctaagagtctgaaatcaaggtgtgggcagggttgactccttctgaggcctgaatggaagaatctgttccatgcctttctcatagtttctgttggcttgctggcaatccttgacattcattgaccagtagatgcatcacccctatctcttccttcatgctcacgtggttttttccctgtgtgcacgtcgtagtccattttgtgttgctataaaggaatacctagaaccaggtaattcataaggaaaagatatttatttagctcacagttctacaaactgagaaattcaagggaatgcatagccctctggctttcggtgagggatttcgatccacatcacaacatggtggagaaggccaaagtggaagtggacacttgtgaagaggggaaaacctgaggggtgtcgtggctttacaacaacccactttaaagggaatgaatccattccttcaagagctactccagcattctgaaactgagaactcacttaccatttcaccaagagatcagcaccaagttattcataagggatccacatccataacccaaactcatcctaacaggccccacctcccaacactgccacgggaagtggggggtcaaatttcttttttttcctttttctttttttgagacagagtcttgctctgttttccagtctacagtacagtggtgcgatctcagctcactgcaaactgtgcttcccaggttcaagtgattctcctgccgcagcctcctgagtagctgggacaacaggtgcatgccaccacttccggctaatttttgtatttttttttttattagatacagagtttcaccatgttggccaaactggttttgaactcctgacctcaggtgatctgcccacctgccttggcctcccaaagtgctgggattacaggcatgagccaccgcaccagggcaagggggtcaaatttcaacatgagttttcctggagacaaaccaaccatacccaagccataccaacgtctgtgtacaaatttccccctcttctaataacaacagtcatattagattaggggcccacccaacctcattatgacctcatctgaaattaattatattttcaataaccctatttccaaataaggtcacattctgcggtacctggggttaggacatcaacatatgaatttttcaggaaacccaaaataaactatgtgtattttgccacaataaaaaatgtttaacctcctcctgtgcagtaaactgcttcaagggcacctttggaaacatctccatgtgaacctcactgtccagaaagcttctttcacaataaacaccatagaaagctcttgacaggtatagtctccacaagaatttgaacaacagccactcccatctcctctgctctcccctgtattgctacttgttgctgctgctgctgctgctggaatgttgataactgctcctccctggatcccttgcagagggttgtgcgccacagtttaccaggtattgctaatgatatgccctattataaggtttgggaattagaagtaattttttagttctaccaaaaatggttgcagtgtgaatcatgaatgtggcaaagtttaggcaggtgggaatggcgaatgtgagaattttcagcaggtgcgcatggtgaatatggaatgtttaggcagatgtgcatggtgattgtggaatatttgggcaggtgtgaatcgtgaatgtgaaatgtttgggcaggtgtgaatagtgaatgtgggaatgtttggacaggtatgaatgatgaatgcagaatgttctggcaggtgtgaatggtgaatgtgcgagtgttcaggcaggtgtgaataatgagtgtgcgagtgtttgttatggccccgggattcccctactgatcacctgcctcaggattccaggaggcagagacatttggcagaggtttcctccagttgcctgaccatcaggtatatttcagtggactccaaatctagtatgatttccattatgtctgtaggttttatgagacttgaagattcttcattactattttctgtactgataatttaattaataattttctgtacatataatttaataacacatgaattcatgataagaaatgtaacaaatttgactttctcagttacattccactcaaaaacacatgagttttgtctgtttgactagtacttccattcctggtaaggttcagcaagagctgagatttctgagcttcagtgactacatcctaccttgcaggttacttgcaataatgaaataaatgatagtgataatagtagtaaaaatagtagtaaaagaaggctgggctcagtggctcatgcttataatcccagcactttgggaggctgaggcaggaggatcgcatgagcacaggagttccagaccagcctggagaacatggcgcaaccccccgcccctgtctacaaaaaggttaacaaaatttagtccagtgtggtgtcacacgcctgtactgccagctactaggaagatgacatggcaggatccctggagcaaggagttccagacagtagtgagccatggcaaagtcagtgcactccagtcagggtcacccagtgagacttggtgtcaaaaataatcagttttaatataaaaccaacagtcatactgttacggactgacttctgtctgcacgagattcatatggtgaagtcctaacccctagagcctcagactgtaactgtatgtgagatagatggggtctttaaaaaggtaattaagtgaaatggggtcattagagtagagtctaaggcaatgtgcctggtgcccttacaagaagaggaaatgaggacacagacttgtacagagggagggctaaggcagacacggagaaaacagctgcctgcaaggcaaggagggaggccttagaagaaaccaactctgctgacaccttgatctcagatgtgtagcctccagaattgtgagaaaatacatttttgttgtttaagtcacccagttcatggtagtttttgatggcagccctaacaaaccaatagaaacacttttagtgccgctcagaaggcaagcattatcatatctattttatgagctagaactcctgctcctccaactaatataatgagcatgtaatgatacctgtatctgagcaactgagcagtgatgagaaaacttcaaaactttggaattattttaccttaagtctatgaccacgagagaatcgcttctccctttcgcactcatcctacttccactactacaatactctcacaaattcctaggaaccctcctccatttgaatgacctaccctaatgattccttcagaagacagaagctatctgctgggaattctcagagcatcccaaacccaggctacccctgttgggcctggcattctctgccacccttgtgcatacaatgctcctaacggaagcaagcccctcacctcagctcaggatcccataactcccactttcccaggggctttcctgctgcaatgatcgttcttctctcctgaaccatcaatggctccccctatattggatcactccccaagctaagggggaaactcactttcttcccccatgtccttctatagctacgaatacatttagctgctgcccttcaaagcaaaactgcctcaacatatacaactcacttcactggagtcattttccaaaattacctggcaacaaaaatgaaccagaacagctgaaacaatgctgaactataactttggggaactcacactacctaatagtaagagtgatgttaattctatagtaatcaagagaacgtggtaatttggaaaaatcaacaaatcagaatggagtccagcaatagactcacagacatgatatattgattttcagaaaaggtgcaaaggcaatggagaaagattgtcttttcgtgaaagtgttattttcctcctgcctcttggccactacattgattggtttttattcccctgggtcccttccctgtgtttccccctttgcacttcagctgctcttctgtttagtggcctctctgccccaccacagtgtgacagcccccacagcaagtaccatgtgttgttggttgttcttccaatttccagcatcccaggtatttcttgtaacatggcaggccactcatgcatgtctactgaattgatgaattaaccttttgtaatgatcctaacagaaaagcatctcctgtgtttaggagacattattggagatgatatgtttctaggcaccttacatatggtctttggttttgtgccggacactctagggtaatggctctgtatgttgctctggagctcctgcaggtcaccactaataggggaagtaggcaaagctagactacaagctaacctgagtctgggcacaatatcttgactgcccttggaacaaggaaagataggcagggcggtgggagctgccacaggtatttttgcaccagctccctatctgcctggaggctgacacaaggccattcttcatccgtctccctagtttgaggtaagcacaggcctttcttcatcatagggtacagttgtggagtataaaattgctcactgcctttgggcacaggtgtgggctcctcaccagcagaaagacccactatctgtgctgtccatcactgagtacctccgattcactgtcacactatggaaatagggatacggtgcttacacaatgctgatcttgcttttgctttctctacaagcaatcaaccacttggatctgtttgggctcattgtctccgtattggccaaatttaagaatatgtgaaaaggcaaactaacgactttagtggtgatcctcatggcccttttaggacaacacagggctgcttacggaccgcttgagtaattgacacactactgtattgagttgcgtggtgtagcatagacagaatattgatttagtcttcatggcatcacacacagcaaataagttttcagcacatactattgacttatggttggccttgtaacacctcggttatttacaaatcaacttcagaatctatgccgtgggtgacaccggctacactgctattaaattaacatatttaaatcaaataattttctgaattcaaatgtattttaaaagtgaacttgacattcctacttgaaattcaaaagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaattttaaaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacaatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttatattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccataaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagatatcatctcactccagttcaaatggcttttaaccaacagtcacgaaataccaaatgctggcgaagatgtggagaaaagggaaccctcatacactgtcagtgggaatgtaatatacaaccactacggagaacagtttggaggtttctctacaaactaaaaatagagcttccatatgatcaagcaatcctattgctgggtttatgccccaaagaaatgaaagcagtatatcgaagagatatctgcactcccatgtgtgttgcagcactgttcacaatagctaagatttggaagcaacctaagcgtccagcaacagaggaatgaagaaaatgtggcacatacacacaagggagtactcttcagccataaaaaaaattgagagccactcatttgcaaaaccatgaatggaactggagatcaatatgttaagtgaaataatccattcacagaaagacaaacatcaattgttctcacttatttgtgggatctaaaaatccaaacaattcaactcatggacacagagagtagaaggatggttaccagaggctgggaagggtagtggggagcttgggggatgtggggatggtaatgggtaccaaaaacatagttagaaagactgaataagacgtcctatttgatagcacagccgagagacggtagtcaataagaagttaactgtatagaagaatgatgctggctactgatcatgtgccggctactgatcatgtgccacctcctggccatgggaagtgagtctggagaaggccatgagaggcagttctgggctcagtagtgaggagggtgtgacactgcaaaggacaccttgcctttgcccaaaccggatggacgtggtgctcaccccacctctcactgctcagctccgtttcctctccacccgcaccctggatctttccagagcaccgggcctcctccagcctagggacccaactgctttcctaagctgctatggaactggcctgaggtcccaggggctgtgcattgtgctgctgacctccgctctcttcagccagagtcccagttcagccgctttctggagaaatccgtcgcctgggcccacgcacaaattcagagcttagcaggtgttgacatgtgctccgctttcctggaaaggccactctccccatcacctttttcacagatgtgaacgttgaggcatgagggagggtaattactggtttacccaggggatgctaagaacagaggagaaaaccccagtgctcaggtgtgtgtctgtctgatgggccatgttcaccaacccatttaagtggacggggctgctaatagatacctaaagatttggttttaggtattttacacttgaaatcattggcttcatctcaactgaggcctgactgcccagtgtctcaaagatacaggtcatgacctgatccttcaggaacagatggtgttccagctttgtgggagtgactttcaaggtgtggagcacttggggtgactttgagacacctcaggcttcatatctctgctttgaatgaaaagctcatcacccacggcagccaggggacgtacctttactcgatggggctgatgtcttgaatttttctgtctagacaatgaaaacttctgggagcacttccagtttcgtgtagcctcttaataattgatgtcactaaattccgtatgtcctctgggactgttcctttgattctgggatggtaccagcttttatgcttttatgtgtaatccgtaaaagccaagttgttaatctgcatgaaaataagactttgttcatatcacacattccaacaggtttcatttgtgatttttaatgtgggatactatgaaaaaaaaaaaaaaactaaaaaacctggtcattgaaattagactctgttattgtattttgtgaagaatttcctccttcaggattaaccacccatgggctcatcagcacctttgtaagtaaagggacaaaaaccaggtggcatctacgaatgcggcaaaatgaggaagtatagggagaccacagcacaatggctcttgtttcaaacagagtctggggtgaagtacccgcatctctcccccatccctcaatattctcatcctactcctgactgttccctctttaggtgggattttctaaatacgattgtccacaagtgttggtggggatgttgcaatgtgagggtatccatcatcagtcatcttaaaacaaagatgaatggagaggagagtgttgtgatccgttttcaaatgcactgcttttgggtgtgtggctgcaaaaacacatggtctcagcaatcccacagcagctgtctcagaagattggccccgatgccaccacagctgctgttgcagagccaggagctccttgcggtttggtgtcttctgcttaaatttgtggatgtgacccccctctgctcacccagttcctggtagcatctgctgagtttcctgatttgttccagtgttccctgagagccagttgtgtaatgatatttcagagggtcttcagggattccatccacactacaccagttactgtgcaatggccatgtgcttatcttcttggagcccccatgtgtgtcctcttcagtggagctgtgaagaattctacttaaatgtagatctcattctgatgctcatcaggctgcttagaaagctgctcatctcgtctttggacgcatgtactttattccttttgtgtgcattgaagtctgatgcagttttattaatgctgtggacccttgtagttaggtacttttaaatatcttggtgaatgtaactctggcaacaacttgaagaagtcgttgtgtgatccccattgtatgggtgaggaagctgacacttgtggaggtagagcaggtttattaactccacacaagtattgatgcatttcacatctcaaggtagaagtcttcctctaaggttcatgctgtgcactaacatgcactacacatactgatgaaaataagactattgtcctcctaccaaacgggaaattaatgccatggctggataaagacacttgtaaaaaaactgcacttctgtctatctcagtattccaatgaaaaagcatagaattttagccagctcctggagagaccaggaagcacagagtgtcctacaagaatggggattccttggaagtgaggttcaccttgactcaagaaagatgactcacgtatggtgaaaggcaattatccagggcctcaagaacagcaccaggaaggagagctgggtctggtgggattctgggggtcctctctcccacctggaaatctactgctgcctgccgaccctctcaagatggcgacctctctgggttccagcgcctaaaacaggcaaaactgggaggacgtcgatttctccattctgtgccagatatgtctcagagaaacatgaccaaggagaactatgagaaaaaatgcaaactctgtcaggccattcagtgtttggctggtgcccgggggagcacatgcatcccaagaagactgaagggggccaagcctgcaggaaatgtctgtcagacttgcctcttagacctagagtatgactgcccatacaggttcatgacacagacttgcctttaaaggtgactgcagatatggacagaggaatttctaaccctgatagaacatggccagttgctctgctggggaaagccacgtccagtagtgagatgctgctcaaactggcccggaccacactgtactggctgaggaataagccttacatttgttctgtccaggtgaaaggagaggactgtccgtaaagacatgagaagcctgcagatcccgatgaccccctcttgctggtcaaaatattaaagatcgatattgtggaaacaatgaccctgtagcagataagcttctaaagcaggcttcaaccacgcttcatcttgaatcaccagcagagaaggattccaccagagtgtatgttggtgatctggcggataccattactcagacagatttaagaaattgtctctgcctgttggtgagatccggatggtcaccgttgtgcagagatagcagtgtgcctttcatccagctttccacagggtggctacagaagtgggtgccgacaagtcctctaataaactgattgtcaatggctgcagactccgtgtaaaatggggacgattccaagcactcaaggggaaaaaaaaaaaaaaaaaacaaaaaaaaaaacaaaacaaaaaacaggttgcgggggacagaatcacagaatctgggatcctgccagagcctattccagtgccgccaggagctccttctccccctgcagctatggtgcctactttggagcctgcttacatggactgaggccaccttttctgacttttcccagtggcaaaatgcacctgacaaggagaatagacgtaggaacctggcctcctggaccctcacttgcccaggatttttcttggtgctgtgagctgaaggagttcttgtaagatggaagcagggccccaggatcatgtgattggcctcatgtctctgcctcactaatggtcaggtggtgggcactcagggcctgggaacccagccatccctgattccttgagttgatgaggcagggggctggcccacctgctcctgccccaccatggccgtcgtggatggttgctctttgagcctggtaacgtcactggcttggctctgccaggcatgcacaggccctgcgtacccacacactgctttaaggggcttgccctgccttgggccacagtctagttctggccagtgtcccaggaactcagtcccctgtgtatccatcttagctgtttctggggcacccatggctcccctgggtcctttttctcttagggctttggttggggagggcttgggctggatcgcagccccatggctctaggacgcttgccatgtgagagaggctctgtcacacgaatgggcagacatgaggacatgtgatatgctgctggctggctggggctgtgcagatgccacagtcactctcccctccagcagcctctgagggcccagcttccccattgatattgatcccatatggcctagcagtagtactgactgctttggggctgtgcaggtcactatcctcagagaaacgtcagatccagatgccaccatgcaaggggagtttctgtggtcctacctctgggttttcagtggggtgggccgggtctggttgttggagccctgctggggttgcagggatgggcctgtccattggtcctggcgatgtccagagcagatgtggaaggaataggagttcagcatgcctgctcaaagctgcactgtagaaaccatgagccctggatgtccaggtacatggggagttttgggagaggacacccacacagaaatcgcccaaaatcctggggtctgtcctgagataggaacagacttgctgcactctgggcggctgagcccccagagagtgtcctgctgcccggggctctgcagaagtcccctcatgctgctgggccttggcctcagggtcagcttctggacttctggagctgggctggtgggccacggagggccagcccatcccccttggggagggtctgcatgctgagggatgcccacagaggcctgggtgccagggacactcgctccaggcccaggaccttcctagggatctttgcgggtttggctgaaagaaaagcagatttggtccacttctccaccaagcccatttgttccttgcagggctgggcctcatgaacctgggcccctggagttttgggggtctctagtggcccacctggtgtgacactgaggaaacacccacaggctgctgaacccagagtgaggggtgcgtgcagcttggggcatggttgctgtcagagcatctcaggctgctcctgagacggaccccagggttcaggctggctcggggctccaggcctcataccctcaccccagggcggctcggtctgggcttcagccctggtgcagaacccagctgggagaggccttacctgtcacctggcccccttgccacctaagatgaggatctgtctccatagcgcgtgagacgctcctgggcactgggcccctctgccatcccggacaatccacgccatgccatgacttcccacaccaaggggcctactgcaccgtttccctgaatcctctctctgggtctgagacactgattctctccattccctggctcaaggcttgccgtcgtgacacacttggaggggtgcttgtgagtgaggcgcccctgctgttctctggcgttggtgctggcagctgtgggtgttggctcgcacagatgggaccaacccctccagtgccccctagggttcttctaggccaggaggggaagggtgtgggggaggggcttggaggggtcttgccctcatcccatgccctgtcactgaggcgagtctagcacctgccctggggcccagctggcctgttttcagaaacttctttgagaaggaagaggaaaaggaggaaggcccagggagtagggatggagggttctgggcactccccatgatttaatgcctcagagggtgactcgggaggctggagcccacgtgggatgcaggtcgcagtgtgtccttctcaactcgaccatggaggcctgagcaccacgtggtcctcaagagtccaggcctgagacagcatgtcctgaaggagctcccatgggccaaagagagacagcttcaggagatgttctaggaatggggctgcacatcaggccaggtggggtctcctgggagaggtctgtgccttcacctcgtttctgctctgggcacttcccagtgggcagtgctgggccccttttggacaaccctggggtccagctgtgcacaggaggccatggatgcagggaaggcccaggcaggggaatgctcaccacgctcctgcctttcatctgtgtcgtgtcaggggtgggctcagtttccagaaggactcacggtgccctgcacagctgaccaggcctggcttggcttggccttccctctaggccagagcagagggtcgtgtggacagtgcaagtgctgccctcaggacagttgaggtctgtcttgtgtggtcctcctgctaccttcaggcacatggggacaagtttctatgaactttgaatgccgcttatgtcctggctgtgagcttgtgctcgccctgcagaaggcagacctcccagagcctcaggatgagcccaaaaggggtctgtggggacagcaggcctgggaggacctggcctgtcaaggctgatggctggtggagtgagcagagcctattgggatcccagtctgtagtgccggggacccactctgcacagtatcagaccccccttcccaatgaggctatgtcagacaagatcctgcagatcctcatgggggtcgactcatctcagtgggatgtggcccctggaagaaggggctccccaagttctctcccaaggtgagtcctagcccagtctgcacacgatgccggctctgagccccagcccctgctgtgggatgtcggcatggtttctgtgccctgcagggacgtgcctctgcctcctgtgcagaggagacgagcaggatcattctggaggggtcagaaccctacagcggggaagccaggcactgtgggcagcagggtcactggactggggagggggggcggtctcctgtgcatccttgccccatcaattgagtgctgtgggaagcacattaaggtggcagtctgggtgcacaacatttccttgtcctcatggaaggagcagaggtgttcagagcccctaggacttccctgaaagcctccccgttcccgggccctctgcagtccctacccaatgccagaactccaggcagtaggctgggctgtcaccctcttctctgagacacctacctcgactcagagacctccccgatgcccttcagatggggaccctccataggccttatttgatgctgtagcgctcttggagcacgcatggtttctgaaggcgtggctcacgtccaggccattctggtgtacattcactgaggacagcttgccctgctccatcattttctgtagagcagggccaagagggggacccaccctcataacagacacaagactcactgccgaaacagctgtcataaaacagcagttctggaaggaaaagaggctttttctgcaaaaaacttctcctccttgtttccaaaggcagggaaagccatcagagcccagctcacctgtggagcccaggtcactatctatccgggatttgtgactggccccttccaccctctcaggactgactttccctccagctgggtaactgggcgcctgacatggcatggcatgtttgtcctgctctggccagttgtggtcgggccaaatgaggtatttccctaggttcctggccttccccttcttgaaaaccatcaggagtgaccacactggaccccagacttgtggggggattcccttgtagatccagtgagaaaaccatggacagaagaaggctttggtgagacaggtctcagggtgatagtaaggaggatcagagtctaagcattctggaagcctcctgcctttggctccaaggttcctcgggggaggtcgagtctacctaggaccgggccttccttccaatgaataaacagtggacaagtgctaaaaaagacaaacaaaaaaagagtgtaactgtgcattttaaaataacatgaacagtataattggattatttgcaactcagtggataaatgcttgagaggaggaatacctcaatctccatcatgtcctcatttcaaattgcaagctgcatcaaaacatgtcaagtatgtgtgcctactaaatacccataaaaatggacataaatgaaacgttaaaaaacaaataaacgacatatatagccgtatatcaattaaaggaattggattcagtaaaagcaacaaagaaactcaacaaagatatttctcaattaaacctcatgtttctggtgacttcactggataattctgccaaacgtttctgggagaaataacaccagttctccactcaagataattgaggagaggccacactttccaaagcattttacagagcaagcacaagcctgatatcaaaaccagacaacattatgagaaaataacatgacagaccaatgtaactcatgaacatagacacaaactctgtaaaaaacaattaaccggagttagaaactagcaacataaaaaatttacatcctagccaaatggaatttcctccatgtgagtttagcaaagtaccatggtccaagatgaccatggaaaagtcaatgctatttttatatgccagcaccaaccaattgaaaatggaaagtcgatatcccttaatatagcagcaaacccccccgtgaaatctgtagtggtaaaatttaacaaaatatgtgcaagacctgtgctcagaagcctaaaaaacatttcagaaaaatatgaaaccacgttgaaataaatagagagacataccacattaatggattgcaagactcaagattgtcaatatgtcagttactcccaaataatctatatgtctagtgtaaaccaataaaaatccctgcagcctcttgttgctataaaatgacaagctgacttcaaaatttatatgggaaagcaaagggactagaatagcctaacaattttataaaggaccaagaatattggaggactcacattacctgatatcgagatgcatttgacaactatgctaatcaggacactgtgatattggcagaagaaaaggcataagagtccgaagctagatctatatattcaagttaaatggatttttccataaagtgccaagagaattcagtggggaaggatgttttattccaggagtggtgctggaacagtcggacattgacatgcaaacaaatgaacctcaaactttgcctcacaccatacacaaaagttaactcaaaatgcttcatagaactaaatgtgaaagctaatgttacaacacttgtagaagaaaatgtaagggaatctgcagcatcgtgtaagataaagatagacaggatgcaaaaagcacaaactatgaaatagaacaaacatacatttttaaaattttatatactacaaacctgtcccttctataccttcacaaaggagaaagaagctttggagctgggaaagcagactattcccctgctctagtagttctcagacaagcttctgtgaaagttagagcccaagatctgttaaaagtgcagattccaggaatcacacccagtgaagcttatgtagtgtggccacaatggtgtcctaggatctgggaattcactgcccagcctagggaacttccagaaactttattaaatcccttaggtagcaagactgtctgaaatatatccactcttcccaggacagacatgaagttgagaagagcgacctcagagcacacagaaacacaggacatgatgaacacagtgtgaaaatcaccataagggtaaggcagtgcgtcttatgagaagacctcacaactcttactggcctttctccccagaggcctcagtttatctcaaatccctgctcctcatgggtggtgaatggagttgtgtcaggaaatgaccttttcgatccccaaaaggcatgggctcctttcaggggccactgaacacataggatggggcatgatgcaagctattgttcccctcccaccagccttggtttccttcttgcaccatcatgtgcttccacgggagcctagagcaatgacacgacttagggccaatgtcttccctttttaggagaccggcccctcgcctgagcagtgcgtctcccctctcctcctttcagctgtccttctcctgatctcatctgccattccacagcagacagctgtccctcgtagcctgatgatctagcctggccccttcctcctatgtcccagcctggagagggctgccctccccgagtggaaggacatcagtcccagggtcccagagccatgactactacagaaccatccttagcatcagtgtcccatggcagtggctgacctttgaaatgaagcttcaccacccatcgcagctggccctgaaacactttcttttctttttgtctcatttgagacaggccctcactgcgttgctcagcctgtagtgccgtggagaaatcatggctcacagtagccttgacctcccagactcaagcaatccttccatctcagcctcacaagtagctggaattacatgcatgctccaccatgcctgggtatatgcttttaaaattttttgtaaaacggggtctccctatgttgcccaggatggtcgtgaactctggggctgaaggaatcctcatgcctcgatgactcaacatgctgagatttgacgtctgagccaccttaccttgccgtgaaccattttctttcttttaaaattactattatactttaagttctgggatatgtgtgctgaacgtgtaggtttgttacacaggtatacacgtgccatgatggtttgctgcacccatcaagccgtcatctacattaggtatttctcctaatgctatccctcccatagacccccatcgcccaacaggccccagtgtgtgatgttcccctccctgtgtccacgtgttctcattgttcaactaccacttatgagtgagaacatggagtgtttggttttctgttcctgtgtcagtttgctgagaatgatggtttccaatttcatccatgtccctgcaaaggacatgaactcatcctttttcatggctgcatagtattccatggtgtatatgagccacattttctttatccagtctatcattgatgggcatttgggttggttccaagtctttgctattgtgaatagtgctgcaataaacatacgtgtgcatgtgtctttatagcagacacactgagtcaggcacaggcagggccgaccagggttttcctggtatccccacacccgaattccagggtgtttgtagtggaaacaaagggacgcgagagcttttgtgtgtgtgcttgtgtgtgtgtgtgtgtatgtgtgtctgtgtgtgtctgtgtttgtgtgtgtgtgtctgtctgtgtgtgtgtcttgtccaaccattctcctgcatccggaaacgttgggaacagagagtcccacgtcacccttagtgcggagtgtgtctcagaaagactttttgtgacagaaataaagaattttatgtctatatttacacatgcctttttctcagggtgtttttctgttgtgaagggtggagggcagtggcatgatcacgcctcactgcagcatccatcttctgggctcaagcaagcctcctcacactgaaacctcccaagtagctgggagtgcagatggccgccaccatgcccacctaatgtatttaattttttttttagatgaggtgtgtcagtgtgttgctcaggctgccttcaaacacacagcctcaagtgatcctcccatcttggccaatttttataaaggctttttatacatgctgtagactcaatcagttcacacttgtgtgcttttttaatattgtgttactccacctttgaacctgtcaactggtaactgatttccatgaaaacctgtaaggtgatcatggctcatcagtcagtgtgatttcagcgttgactcacagcagctaggaaagcctgcatgggaagtatgtcttgaggaaaactggagagtttccaggaacagttttgaaaaacagagactacttatgtcttccttccctcccttgcttctcctcatgtgccaggttttctgctttctccaattgttaacaaatcagcatggagtattatgtgatgaaacgcttttatctctttcatcatcccgtttcttcctcaaaactttttttttttttttctggaagggtggtaggcagaagggactaaacatattcagaaaaacacattgtaatataaatttcgtgaaaaaattcatcatatttaagaaatggtcaggatgaaatcctgaatttgtaataattgtaaaactcagtttgcataacctccaatccttttgtctctatcacttatccggtgagaagtgtagaaaagatgagttccttgcttgtgacagtggcattagttagtcaaactgctgcaccctgtccatcgatatcacacatccagatttaatagccacaaaatgcaaaggcattttacaactgtggcggttttctttatatcattgtaatttccattaaacccctagcactaaattcaatattcacacacttgcaagtaccatggccaagagagatcctgcctgaaatgttgagagggggctgcagcagtggcaacccggctgaagacgaggctggaatgtgtcttcacaaacctgcaaccccttttttgaggcagggtttctctcttttgcccaggctggagtacactggacgacttatagtgcaccacagcgtaggacttctgtgctcaagcgatcctcctgccttacgtttctgagtagatgggactacagacatgtgccacaatgcccaggtaattttaaaaattgtgtagagcaggggtctcactatgttgcccaagctggtcttgaactcctggcttcaagtgattctcctccctcagcctctcaaaatactgggattacaggcgtgagccactgcccgtggcctttttctcacttatttttcctttatctaagttttaaggtttatgtaaggctttgctccagcccaggaaactgaattttttccctcccacttggaggaaacagcaattcaaacgttcaggatttttgacctactgaaagttcattggcaacaattgtgtcctgtctctacctgcctgcaggagaaaacaaaaattaaagtcagcaccaggctgcacttttcctccatacattatcctgtgcagaacagcgtttgagggatccagtgagccagttctcttgcagttggagggattattgttaaatgctgggagtacatgtatttttcataacagacaacagctcggctgttgcttcatactatggggaaatgcatagtctcccaggagtgacagcttcatcatctctaccccttcactcttcctttactcaaagaaagctttcaccatattgtagtgagtcagggtcctgctggtgaatcacacggttgttgacactgtgtcagggacccccaaggccaccctcaccttcagtgattcatggacattctctgctgcccttctgcatacaatactcctaattgaagccagccccctcacctcaggtcagtataccatgcgtcccaccttgtcatgggctttgctcctgtagtgatcactcctctctcctgaaccatcgactgctccctctacattggatcattctccagctacgggaaaactcaccttcttcccccatgtccttctgtagctacgaacacatgtgtctgctgccctgcaaaggaaaactgcatgaacttatgcaacacacttcattggagtccattttcaaaattttctacaaaggaaaatgaaccagaatatctagaacaattctgaagtgtaacttgggggaattcaccccacacaatgtcaagattcacattaattctattttatttattgattgattatgttatcagtgagttggaagaagttgacatcccccttggcttgggggttgatccaatatagagggagccgttgatggttcaggggagaggaatgatcagtgcaggagcagaactcctgaaaaggtgggaggcatgggatcctcagctgaggtgagggtgctgccttgagttaggagcattgaatgaagctattgattatgatttttaatcatccagccccatatggcaattatgttacttctccagtattcaggacagtgtgatattgggggaaaatctacagatcaaaatagagtctagcaatagactcacaaacctaataagttgactttcagaaaagaggcaaaggcaatggacaaagattatcttttaaaaattgtgttattttctcctgcctcgtggccactacattaattgttttttattcctctggtttcctttcctgtgtttctcctttgcacttcaactgctgttctgtttgtctgtctgccccaccacagtgcgatatttcccacagcaaggaccaagtgtctttgtgatatttgctatgtccatctcatcaatgataaaccgaatcaagaaaatgtggtacacatgcaccatggaatactatgcagccatgaaatactatgcagccatgaaatgaatgagctcatgtccttggcagggaggtggatggtggtggcggccattatccttagcaaactaatgcaggaacagaaaaccaaataccggatgttctcacttataagtgggaggtaaatgatgaaaacacatggacacatgggagaaccatcactcactggggcgtactggagtgcgggggtgggaggagggagaggatcaggaagaacagctcacggatactgggcttaatatctgggtgatgtgatgatgtgtgcggtaaatcaccgtggcacacatttacttgtgtaagaaacctgcacatccttcacatgtacccctgaacttaaagtaaaatttggaaattaaaaaaaagtcaatatctcagaatccttatttctatgttttggtctttgtgtcatttatctaagcattatggtgacatgaaagctgaggcataacaacagttagtagattagcaatttagcaggattatagctcagtatgatataacatcaactactagtattgaattgcattcaactccttgaagtgcttaaggaaagttggtaagaaaaagtattcacacttgaaaacatttttaaaattcatgtaaattggattgacactgagtaccacagatgtcactggcactatgctaatgaattacataatagtgtagccagacgagccgcagacaaaacctctcagacaccgagttgtagaaggaagggctttattcagctgggagcatcggcaagctactgtcttaaaatccgagctctccgaatgcacaatttctgtcccttttaagggctcacaacactaaagatttcacatgaaagggtcgtgattgatttgagcaagcaatgggtatgtgacaggggctgcctgcaccggtggtcagagagaaacagaacagggcagggagtttcacaatgttcttctatacaatgtctggaatctatgaataacatcggtttctaagtcatgagttgatttttaactactaggtttaggccaggcaggcccgggtcaggttttgggcctggcgcggggctgcctgtctttggttttacttccttgttgttttttcttaaaaaagatactgaatataaaacaatataaaacaatatgagaggatctctctcttctctcaatagtaaccataagacccagtaaataataaaggagtaaataaaaggagacatatcaaagcatcatcagatgagtgcaggaacacacacatgaacacaccctgcagtcaaactgacaatttaaacatcactgagtgctatttcaagcattatgtagaaagctacagacaacagtgaacttattctgagcatgtcttaatccatcatcttcacagatggctatggaagtggcctgtaaacgttttgtctgataacccctgaagtagtgacgttcaaactcttttatgacaatgtgtgataaatacacagtttatatatagttgactaggcaaataaatatatgtatgtgtataggaatgtgcagtgtatttgtatattctctatgcagtgaacgctatttagtaatttattttacctccattttttaaaatgctgttctttaaaatgctgtttttggctgacaacattaatcttatgatcgaacatggactaaaaactagtttagatggcacatgtatacatatgtaactaacctgcacaatgtgcacatgtaccccagaacttaaagtataataataaaaaaaagaaataattaaagccttttcagagaacatcttggatggttggtaaatgttgctatagaataaatgcaaaaacacattagaacccaattttgtcgccctccttagcaattcagtgcttttagacaaaaatgtcatctttgatatgggccacaaaagccactacaaaatatacaattactgatgaaatatgtgtttcatctgcagatatcagtgtctgttttgcacaggtgaagtcttagttggacagatgggaactcacaggcaaaggggacagaaagtacatgtgacctcttctgttggtatcatgaggaggctttgcttgggctgcagcatagctgaatgtcatgcattgcatgcattcacggagacctccctgtgaatgcacagggacctccattcccttatggtgctccattttatgaggcaagtgggagagctacactgaaaatgttaggtagtaaataatttggcctcaaccaccaagcaatctgaggtcacgtgacagtgtttactctggtaccctgaaacttgccagctgctcagaatctgtagactttgtcccacccccccaccatcctgtggaaatctaagtttggtcgtagattcccatgcatggaggatgggaagctctggtcatgtgggaaattgagccctctcacaggtagactggctgtgttggtcccagctctgtttcctcccttagcagctagagagttgctagggtcatgtatcaagcaactcctcttgtctctacagtgtctttcatactttctgctgcttcctgtttgtcacaagggctccttcacaactttcccaatcccaatactataatgatcctttgaactcattcagcaggtccggagttacagtccacaggaatggcagcaggaagttcaaatttggcaagaaattcaagcctgccctttgaagctggagtgaggccactcaggaatcattaaagtccaggtctgcaggtgatgtttaatattaagtgtcaacttgattggatcaaagggtgcaaagtattgttcctgggtgtgtctgagaggttgttgccaaaggaattctctggctcttaaagaataactgcattttaaagccttcccgcagtgaagccttgaatgactgaatgataaaatggcaagagatcatcagatttctgtggccagtatagcagggagaatgcatgtaggtcagtgatgcttaaggtgggtgtaagatgcttctgctaagcatgctccctgccctcttgtcagtcagtcttcatgagctacttcgtgtaattagattaaagactcatatagtagagtcacctctaaccataccatacattacacattacaggtttctgccttgagacattagatgacagggtttaaagtacaataacagtaatgtgctaattcctgagtggttgacataaatatattttacacatattttccaaattggtgactgttaattagaatacctcttgaagttaaaagaaacactccatgtttaagggagaaattacctaaatgtttttactctcctctgctgaaccattccattagactgtttacgttaaaagatagttctcggacgatttccagcagcctattgaacaagactctgttttattttttgggagatcatagctttaaatgcaaatcttcttaaaataaatagctgattacatgataaaagaaaataatactatgaaataataataaaagagccacagaataaacttaaaggaaaaagaaagaggtaatgaataaaagacagttacaaatcatcagtaaaagaaaaaataattcaaatgtaatgcatttaaaagaatggtcttttgaaaaataggtatgaatagagtattcagtagtttacaccatcttgcagaaaatggaaaaagcacgacatggaatatgaacaagacagggtgatttaatatagggcattattgaaagtgaataaaatcttgaactctaatattttcagagcatgaatgaaatggttgataagctcggaaggcatcccatttactttcagaaactgattttgactttttcagatgtcttactattgttttccatttccatatccctccattttttcgtgtgtggcacagttcataatgctgtcacacattgatgacaaaactgatagtgatagcttaagagtaatgtgaccttatatttaattatacaaatgggaatactttcaagtgtaaaaagaggcatcattcatgttgacatcacggtagaagaaaactgggtacaaacggttactgtaccttaaaaaccacagtagggtaaacgagcccaaataaatatttttgcccttctgcacaatagagtaaaaataaatgcaatgctggcctttctattcacttccctgatgcagttcctaaggtgacattaaccattttcttccaagagagactatttccaggagcccatttggcatacagaccatagattcaagccagaacattaaaaagagtgtttgcaaaagattatacattttacattatacatcaaaaaggaagaaatacatcagaaacaaagaaatgaaataaagattttttctcaaataaatttcacgtttctggtgacttcactggataatcctgcaaaacatttgtgaaagaaataatgttgtttctacacaaactctttataattgaaaagagatcacacttttcaaaacattttacagagtccacatcaacctggtatcaaaaccagacaaacatcatgaaaaaacaacatgacagactaatataactcatgtctataaaagcatagatttatgtttatgctataataatagcaggtcaaaactaggaatatattaaaaatttacaacatcatagccaaatgagattcaccccatgacttgaatatatttatacatgtatatgtgagtttagcatggtaatatgtacaagagaagtttgactttcgcagcaacaaactattgaaaatttaaaatcaatgccacttaatatagcggcaaaatctcatgaaatgtttagtggtaacatttaacaaaatatgtgcaaaacctgtactcagaagcctaaaaaacattgctgtgaaatattaaagcaggctgaaatcagtggagaggtataccacgttaatggattgcaatactcaagattgtgaacatgtcagtttctcccaaatgaactacacattcaatgtaaccacaatcaaaatccatgcaactttttgtttctacaaattgataagctgaattcaaagtttatatggaaaagcaaagggactggaatagtctaacaattttataaagaacaaagaatattggaggaatcgttacctgttttcaagatgtatttcataactgtggtaatcaggacactgtgatattggcataaggaaagaaataagggccaaagctagacctatatattctcgttaatttttttccataaggtcccaagataatttagtgggaaaggatgctgtattcagagaatgatggtggaacaattggacattgacatgcaaacaagtgaacctgaacctttgtctcacaccatatacaaaagttaattcaaaatgcatcatagaacttatcacacttctagaagaaaatgtaggagaatctgtggcaacatgtaaaacaacgatagatgggatacaaaacacacaaactatgaaatagaaaattcataaaatttttaatatttatatatttacatgctatccttatccagtcactaattacttttccaagcattatacaaatcacatgaagaggtcattagacttctgatttcctagagaaatttccatttaaatttttcatacaagctcatgatgatgaaatcccagcattacatttaggctccacaataccctgtaaggagagctgaatatttattatgctcataaaaatatggcctcaccctgcccccacagactcagtccttgagtccctgaagaaatgaagtgataatcaaaagatcatggaaggggtcaaaggtagttgtgacattgtatctctggaacatgctcccagggaaatgtgggaacagcaacaatataaacagcaaaacagtaacagctagaattgattggaaattgaccatatgccagggactttcctgacaaccgtacatgttttcttcacacactcagtgctctaaactgccccaagaactacataaatttactagtagtatttctatggtactattggagaaaggagtcacagagatgttaagtaactttctcagtgtcaccagcactgagtggtggaggcacaggtcagaggcatcatggaaaactctattgtgctgcatatttgtgcaagggtaagatctgaagggtaagagccaaaggctatagcaaaatatttagaattttatagcatgggactgcacaggcaagagacatttgatttcttcagaaatagttaagagatggagacttgaaaggattggcctgggtatgatttggagacagtgccctgagtgtgtcattaccataacggcagcatgtcttcacctgaagatcttgggtttgtacatcagagaacacaaaaaaacctgtcccttctataccttcacaaaggagaaagaagctgtgcagctgggaaaggagactactcccctgctctactagttctcagacaagtttccatgaaagttggaatccaggatcctttaaaagtgaagattccatgattcacacccagtgagtctcatgtagtgtggtcggaatggtgccctaggatctgggaatttactgcccaggctagggaagtttcagaaaactgattaaatcccttaggttgcaaaactgtctgcaatatacccactcttcccaagacagacatgaggttgagaagagagacctcagagcacacaggaacacaagacatgatgaatgcagtgtgagactcaccataagggtagggcagagggacttttgagaaggcctcacaactccatctggcctttctccctgaagacctcagtttatctcaaatcccttctctttgtgggtggtgaatggagggaatgccagaaaataaccctttagattccaaaattgcatggacttccctaagggaccagtgaacacataagatgggaggtgatggaagctatcgtgctcctcccaccagccttggatctttctggtaccatcgtgtccatccatgggagcctagagcaatgtcaggacttagggcaaatgccttcccttcagtaacagacacctgcacctcctctgaggaggttgtctcccttctcctcccttcagctgtccttctcctgatctcatctgtgatcccacagcagacagctgtccctggtagcctgatgacctagcctggcaccttgctcttgtgtcccagcctggagagggctatcctcatcaagaaggacatcagtcccaggatctcagagctatgactaccacagaaccatctgagtattaatgttcatggcagtgattgacctttgaaatgaagcttcaccacccatcgcagctggccctgagacactttcttttatttctgttttatttgagatggggtcccactctgttgctcagcctggattacagtggagaaatcatggctcactcccacgctcaagcgatgcttccatctcagcctcccaagtagctgagactacaggcatgctccaccatgcctggctgtttttcaaaatttttagtagaaaaggggtctccctatgtcccccaagctggcgggagccaccacgcctatccctgaaccactttcttatcacagaaagcaaagcaagacagaggaggaaggtgcctgtaacccctcccagggacattgtgtcctcctccttggtgccctgttatttcctttgtaccgaccacaatatccctactctttttatgtaaacaagaagtttgaggatacttcttttcaatcataaacttgtggcttatagccagaatatcgttacctactgggccattttggacttttctgagtgcagctgtggttgttggaatgattggtaggggctgctggcatttggggaatgagtgttacagggaggcaaacatctttttccaaagtcttccataaactggattttccatacatgtcacttccctgtaaactgagggagacttgtatgttgcttcatctaagaacttataaagacttattgactgcttcagaaatcacatcactgcagggcattccattcttagattgcactccaacacaacattccagcatcagttttctttgtatctgtgcattcctggggaaaatagaataaggggaatccaacatacctacgaacacgatcatttccatgataagctctttgttgatggggaaatttatgtgggagatgttggtagtgtgatctctcatgagttggtgaacacactggctatgcccgttgctgttaccgctgttgcaggtgtatctccctcaccaggctccaaagtccttcttggaaggatggaaacatacccagtagatctctgtgccctcaggatggaacagaggacctcacatgcagaaggagggcagagaacacttgtagaattgtagtgacctctacatggttagatgaccaaaccctgagtcgcagtgacgagcagcatggatgtcagtgcatgggaggggaacaccacaggcctctgcgtttggagccatgcagcagagtgagatcaacctgcagtatcgatctcagttatgcactttaagggccccaaatataagcagcctattggttagggttcttctgtgtgtgtgtgtgtgtgtgtgtgtgtgtgtgtgtgtgtcgtggggtgggctgtgcacccaagtatttatgtgagtgagtagagagagagagagaaagattgagtttgaagacctagctcatgcagctgttgtgaccgggaagtccaaatctcgcagagcaggatgtcaggctggagacccggggaagagatgatatgagagctcaaatccaggggcagtgtggaggcagaatttcttcatcttgtggagaaccgcagtcttcttctctgaaggccttcaaggaactggatgaggcccacccacactggagagggcaattgggtttactgaaagtctgctcatttaaatgttagttctcctaaagaaaacccttcacagagcatctaccctggtcaaagtgaacatttctcatgcattgtggcgtagcaaagttgacacatcagctttcccatcatagccatcttatacaaatcctaataatgatgaaggcctatctgacaaaggcaggtgacttcctaactaagattctgtattatccatttttgtccaacccaagccagcatttcagggtcataacaactctggccaggaagccgaagctgatgtgaatgccttccagggatgaggcagtggtgggatagtcagggcatacaggtaagaacaatcccagagggcacaggtgatacccctggacaccaagagtttacccttgttaaggcacccccagcaggacatacagtcatcaggcaggagctggccaaggcccccaatgtggcctcccactgagggacctttccctctagggttctttgtccagtccaaacaattgatttgcatctttcatttagtggaactatcagcaggcagtcagttcagagtagtcattgacactagttcttcctattcacaagtgtgaatgacatccctaggtgttctatgtgggatgttcagcagctgggtcacccctgctgcccaatggtcacagctcggtcagatgtaagtttgggttcaggattcagtgtggtttcaaaattggccttaggttttgactgtgggctcctcacaggcagagagacccaccatctgtgctgttactgagtatctccaattcagtgtagtactgtgggagtagcgacacagtgttgacacaatgccgatcttgcttttgttccgtctgcaagtaatcaaccatttcgatccatttggcctcattgtcttcttacccaccaaatctatgaatatatgacaagacaaaataacaaccgcactggcgatccttgtgtccctgttagccaccacagggctgcttagggactgcctgagctcttgacacacgatgatattgagttgtgtggtgttgactgactggagtagacttattcttcatggcttcacacacaccaaacaagttttcagcacgtactactgacttagtgttggccttgtcacacctcggttatttacaaatcaacttcaaaagcaatgccatgtctgataccagctacaactgctatttaatttacatatttacatcaaatcagtttctgaagtcaaatgcattttaaaaggtagactaatattcctacttgaaattccaaagcacttatcacatactagagatgtagttgtaaaaaaaatgtgaaattttaaagggattaaggaaagataactagtaaatttatctgcaatgtaatgcctgcatcttatgttatttcatttattcttcaaagcaagtatttagtctaaatattctaatttctactttggaaatggggaaacagtcccacaggatgtaagtatcttgcccaacatcacaaggccagtgtttgagaggcaggatggacacccaaggctatgccatgccattgcctgtaaggagacagtgtaggtaggatccaagtaattttgcttcagcaaattgacctagtcgctttcctttttcttctgcctaggcgctagttctttcatccagctctatagtctagggaattctcacatatcttgtggcaaatgggatatcctaacgaaggatgcagatacagagatacacaggggaaggaatgaaggaagaggcagggggcttccatgccctctacgggcatgctaccctccatgtgttccgctaggcagaagctctatgaaccctgtccttttgggttttgatggaggttttcattataaaggcatgattgattaaactgttggcccgccattggcaatcaacttaaccttcagcccctctccctgtcctgaaggttggggatgcagctgaaagtgcgaaccctctaagctcccatcctagagctacctaggagctgccagccatcagtcaactcactagcatacaaaaagacgtcgctatgaggcgattctaaaacctgtaggagctgtatgacagtaagcagggtccaggaccaaatatatatatttcacaatatcacacatgtgtataccagctcaatcagaatgcaaagttgcaaaaatgatactatattttattcagacagagtcgcattcgcccaggctggagttgcagtggtgtgaacatgactacctgcatcctcgacctcctagactcaagggatcctcccatctcagcctccagagtagctggaactacacctacaaacatacatgcatacattcatgcattcattcatttatttttgtagagagggggttttgccatgttgcccaggcatgtctcactctcccaagctcaagcaatccccttgcctcagcatcccaatgtgcttggattacaggcatgagccactccacccggccaaaatttacaatagggtctaatatgcgagaataaatgaacaaaagatgtgtgatacttatttggagaaaactggaaatctttattgagatttttaaaagtcaaatatctcggataaatccagtttgcattctttcagcttgcctttgtttaaagctgtggttgcccttcccctgcaatagaaacacaacaggaaggaacattactagcagaactgtattcagatgaaattaaaggtatacaaaggacaccaaaattttagttttatacattggacaaaaaccagaagcctaagtaagagtcaccctatggctaacattccactagacctctgtagagactttgaacataacacctccaagcatacacattaaacaacattttttaaacacaccccgcttttggtgctagaaggaaaccaaaagacagtctgagaccagaacacattaaatcaagtgaacctattaaaaggggcttaaagtagatagcaaacattgtgtagagttttactcaaaatgcaactaaaacacaaaaaacctaagcaaccgaaggaatttgtgaaaaatatataatttaatgttttggcttgaaactatcacctggatgtccaataggctcctgcaaatagtctgagaagtatgttttgccataatgtaactgaaaacagttatgatacattaggaaatacgtaagtgaagtgaatagaaggtccagtattgcatttgttttttgtctattgtgcagaagtgcaataatattgctttgggctagtttacccttcttagtccttttttgacatacactaaccatttgcatccagttttcacctatagtcattatgtcaatatgaataatgatacatttttcaccggaaagtattcccatttgtataattaattaaatggtaatataagttttaagatatcactgtcattattgacattaaaacgtgaaacagttatacatcataagcaatgtggcaaagaaaaagaaatggagagggaaacaaaatcggagagtaacacatctggaaagctaaatatttgcttctaaaagtgactgtttttggctgggcgcagtggctcacgcctgtaatcccagcactttgggaggccgaggcaggcagatcaccaggtcaagagatcaagaccatcctggctaacacggtgaaaccccgtctctactaaaaatacaaaaaattagccaggcgtggtggctggtgcctgtagtcccagttgctcgggaggctgaggcaggagaatggcatgaacccgggaggcggggcttgcagtgagccaagattgtgccactgcactgcagcctgggcaacagagagagactccatctcaaaaaaaaaaaaaaaaggtgactgtgttttgaggtacaactggcaaatttcacgtccttccacagtctttgtgatgttcagatattcaggtatttcagggatatattaaatagtgtaggcattctgagcatatcaaccatatcatccacactctgaaaacattagtgttcaagaatgtattccctttcaattatgccctacattcaatatctgtgtcttgttcatattctgtgttgtgccttttccattttcttcaagattgtttaatctactggatgctcttcctagctatttctcaaaagaacattctattaaatttattaatatcaaattagttttccttttgttaatgatgcatacctttcatttactgcctttttcccttaagtttattctgtgactcttattattttgctctttcttaatattattttcttgtatcatggaatttgctatctattttaataagatatacatttaatgctatgactgtcctaagaatacaactgaggcttgttcagtagcctcctggaaatcatctgaaaacaatcttttaatgttaatagcctaatggagtggttcagaagtgtggagtaaaaacatttaggtaatttctcccctaaacatgcagtgcttcctttaaattcagaagttcttctaattaagtcagcaatttggaaaacatgtgtaaaagatacttacgtggactactcaggacttagtatgttatagtctttgaactttaaatcgtatcttctgatgactcaaggcagaaacctgtaatatataacctctgatatggttagaggttaccatatgtgtcttcaatctaattatacacagtagctcatgaagactgacaggagggcagggagcatgcttagcccaggcatcttacaaacaccttgagcatcactgacctacatgcatgctccctacttcttgggtcacaaaaacttgactgtctctttccattttattattcagtcattcaaggtctcactgcgggaagactttaaaatgcaatcactgggtccagcaagggaggtggctcatgcctataatcccagcactttgggaggctgaggcaggtggatcacttgagatcaggagttcgagcccagcctggccaacatggtgaaactctgtctctactagaaatacaaaaattagtccggcgtggtggcacacacctgtattcccagctacacaggagtctgaggcatgagaatcccttgaaaccgggaggtggagatcacagtgaaccgagatcagaccactgcactccagcctgggcgacagagtgagacccctactgaaaaaaaaaaagcaatcattgtttaagagcctgagagaattcaggatttgacaaaatccaagaacactcatgaaggtctccatacaggaaaacaaacatcaagtagagtgccagctcatttacttaggagcaatgaaatctcaactcggatattataattggactgaagctgatggttatgataaacaaatcacgaaaatgaaattatctttgtattttctccaacagaaccgaaacatgcagaaatcagcaatgaaatgattttaatctatctgatgtgcattcactactttcaataaaagcaaaaaccggtgcaggatttatgtgttttgtccagaatctcacaaattatcttagagctggtattagaatcttcttcagggtcagcatatttcatacgaagtggtattacaaatgtattatgtatttgtgaaaagcagaaagtagaaaataatctacaaatttttagctgttggttatactcagaagtaagaaaatgcttttcttttcttttcttttcttttcttttttcttttcctttcttttttttccccccgagatcggagtttcactctgttgcccaggctggagtacagtggcatgatctcggctcactgcaacctccacctcctgggttcaagcagttcctctgcctcaccatcccgagtagatgggattacaggtgcctgccatgaagcccggctaattttttgtatttttagtagagactgggtttcaccatttgccctggctggtctcgaactcctgacctcaaattatccacccgcctcggcctcccaaagtgctaggatgacaggcgtgagcccccgcttctatttgatgattcaatatggctttgacccagtttgtgtctgtatctgatagtctttcagttttgcagtcaggcttctggggtctcgactaccttcccgagaaagtctgcatttggactctgtttttaaaggggcagtaatgttctctcttttcattatcaaaagtgtaatattatggaatacagaaagcacgtaattttgaatcttaatggataacatacctccttctggcattttaaattgctctcattttgtcagaatcttccccctggacaccagggccaactccacattcatccccagtctttgactgagacagcttctggagatcagcttccaggtcaggtactaaaaaataccaaggatatcgactggagcagccaaaccagaatgataaataaggaaatgatcctattcttttcctcagtgtgatgcaataaaagcctgtaggctactgtggtaataaatgtgatgcaaagatgtccccgtttgttttcctgtattatgatatcttaactaacaatctgaggataaatcacaccacacctacatttcccatactttttaacattgtgtgttataaacactcagctacctaggaaatctgaagtatctcagctacctaggaaatctgaagactgccccgtggatagcattttaatcataccttaaatataatgttctgaatgattagatcaatgtactggtctgcttatgacaaatcttatagtcctgacactaattccctgttcaggtaccctgaaagtgttggggttaaacttaattaatgtttaggtccaaaggccctatatgtcattaagaaaaagtacctgatacaacagcaaaaccactgtcttccaatgagagtacgggaactgaagtgcagagaaattaatgggcattgttgacagtcatattctggaaaccccttaacagtgaattgctaaaataatccatggcccaaattctgtctatctttagttcgaaagtgctatctattcgttgaggaaacaatttctgtttcacgataatcttattgtacttggagttttctaattataaaaatattgaaacaacttttaaaagccccttcaaagtcctactgatatagttatctgtattccagtgtcctgaattatccaccttttaccaaacatactgtcaaaaataggcatcagaggaaacagtggctgtcatttattggcctcttttctggagacgctatcctacttcactgaactgcgttttgtcctgagtcaatgctgagtaccttacagtgcagacatatttgagtattaagcatttttaagcaaaatcattcacattttctgacatggatggtgggaagaatgcaaaccttggaacaaaatatgaattcctcctccatgagtcaagtgttcttggtaagtctcaatctctgagcctcatttttctgttatttatttatttatttatttatttatttatttattgacacagagtttcattctttttgcccaggctggagtgcaatggtgcagtcccggctcaccgcaacctccacctcctggattcaagcagtttctctgcctcagcctcccgagtagctgggattgcaggcatgtgccaccacgcccggctaatttttgtatttttagtagagacggggtttcgccatgttgcccaggctcgtctcgaactcctgaactcaggtgatccacccaccttggcctcccaaagtgctgggattacagatgtgagccactacgccttgtgcagcaaggggcatgcacactgagtcaggcacatgcagggccggccagggttttcctgctatccccacacccttatcccaggtagtttgtagtaggaagaaagggacatgagagattttttaaattttttttgtctcttgcccagccattctcaggcatccagaaacattgagaacagagagtcccatgtcacccttagtggagggtgtgtctcagaaagaccttttgtgacagaaataaagaattttatgtctatatttacacatactgttttctcagggtgtttttctgttgtccagggtggagggcagtggcatgaccatggctcactgcagcctccatctcttgggctcaagcaatcctcctcacacagcaacctcccctgtagctgggactgcagttggccgccaccacgccctcctaacgtatttaataattattatattttagatgcggggtgtcactgagttgctcaggctgctttcaaacacatggcctcaagtgatcctcccatgcctgccaatttttatacatgctgtagacaatcaattcacacctgtacttttttttaaggttgtgttattgcacttttatacctcttgactggtagctgatttccttgaatacctgtaaggtaatcaccggctcaccaatgaatgtggttttaacaatggctcacagtggcttggaaagccctcatgggaagtatttctgaggaaaagtggagagtgtgcaggaatagttttgaaaaacagagacaaccgatgtcctccttccctcccttgcctctcctcatgtgccaggttttctgttttctccactattacagaatcaccatgttgtatcctgtgatgaaaagtttttatctctttaatcatcccatttcgtcctccagacctttttttttctggaagggttgtaagcagaagggacgaaacatcttcagaaaaacacattatgatataaacttagtgaaaagattcatcatatttaagaaatggacaggatgaaatcctgaattcataaaaattttaaaaatcagtttacataacatccatcccttttgtctctatcccttatccagtgagaagtgtagaaaagatgaattcctcacttgtggcaactgcattaagtagtcaaactgctggaccctctccgtcagtatcacacatccagatgtaatagccacaaaacacaaagacattttacaactgtacctttttttttatctcattgtaatttccatcaaaaccctagcactgaactcagcattcacagagttatgattccatggccaagagaaatcctgcctcaaatgttgggaggaggctgcagcagtggcagtccagctgaagacaaggctgaaatgtgtcttcacacaccccactccctttttgagacagggtttctctctgtcatccaggctggaatacactggaggacttagagctcaccacaacctaggagtcctaggctcaagcaatcctcctgtgttaccttcctgagtagatgggactacagacatgtgccatgatacccagctaattttaaaaattgtgtagagcaggggtctcactatgttgcccaggctggtcttgaactcctggcttcaagtgattctcctccctcagcttctcaaaatactgggattacaggtgtgagccactgccagtggtctttttttctcactttttttcctttatctaagacttaagttttatctaaggctttgctttagcccaggaaactgattttttccctcccacttagaggaaagaacaattcaaaccttcaggatttttggcctactgaaagttcattggcaacaattgtatccagtctctacctgcctgcaggagaaaacaaaaattaaagactgcgctttccccccatatattatcatgcacagaacagcagttgagggatccagtgagccagttcccttgcagttggagggattattgtgaatgttgtgagtacaagtatttttcataatagacaacagctcagctgctgcttcatactatggggaaatccatagtctcccaggagtgacagcttcctcatctctaccccttcgctcttcccttactcaaagaaagtttcaccatgttgtagtgagtcagggtcctgctggtgaatcacacggttgctgacactgtgtcagggacccccaaggccaccctcaccttcagtgattcatggacattctctgctgcccttctgcatacaatactcctaactgaagccagccccctcacctcaggtcagtataccatgcctcccaccttgtcatgggctttgctcctacagtgatcactcctctctccagaaccatcaactgctccctctacattggatcattccccaagctaagggaaaactcaccctcttcccccatgtccttctctagctacgaacacatttaattcctgccctgcaaaggaaaactgcatgaacttatgcaacacacttcactggagtccattttcaaaattatctacaaaggaaaatgaatcagaatatccaaaacaattctgaagtttaactttggggaattcaccctacaggaggtcaagattcacattaattctattatatttattgattgattatgttatcagtgcattggaagaaggtgacttcccccttggcttggggattgatccagtatagaaggagccgttgatggttcaggagagaagagagatcagtgcaggagcggagcccctgagaaggtgggaggcatgggatcctcagctgaggtgagggtgctgccttgagttaggaagcattgcatgaagttgttgattatgattcttaatcatccagccccatatggcaattgtgttacttctccagtattcaagacagtgtggtattggagaaaagtcaacaaatcaaaatagagccagcaatagactcacaaaacctaataagttgattttcagaaaagtggcaaaggcaaaggagaaagattacctttttaaaatattgtgttgttttcccctgtctcatggccaatatattgttttttattcctctggttcccttccctgtgtttctcctttgctcttctactgctgttctgtttgtctgtctgccccaccacagtccgatatttcccacaacaaggaccaagtgtctttgtggtatttgagatgtccttcccatcaatgataaactgaatcaagaaaatgtggtacatatacaccatggaataccatgcagccataaaaaaatgagatcatgtccttggcagggacatggatggtggtggcagccattatccttagcaaactaatgcaggaacagaaaaccaaataccggatgttctcacttataagtgggaggtaaatgatgaaaacacatggacacatgggagaagcatcacacactgagcctactggactgcgggggtgggaggagggagagggtcaggtagagtagctcgtggatgctgggcttaatgccagggtgatgtgatgatgtgtgcagtaaatcacagtggcacatatttacctatgtaagaaacctgcacatcctgcacatgtacccctgagcttaaagtaaattttggaaataaaaaatgtcaatatttcagaatccttctttccatgtgttggtcattgtgccatttatctaagcattatggtgacataaaagctgaggcgtaacaacaattagtattatcagtaattttccaggattataccccagtatggtctaacatcaactactaatattgaattgcatttgactcctggaagtacttaaggaaagttggtaagaaaaaatattcatgcttgaaaatatttttaaaatttgtgtaaattggatcaacactgaataccacagatgtcgctgtcactggatgctaatgaagtacataataggaactataagacacagtcaataataaaggggcaaataaaagggaacatatcaaagcactgtcagacgagtgcagaagcacacacatggtcacacctgcagctgcagaaagacatggtaggaagtaaagccccacaactcatcagccttccttctcaccagctcatgagttcacaaatgagtttgctgagggtcaaatgcccacagtaaaactgaccagtttaagcatcactgagtgccatttcaagcattatgtagaaagccacagacaacagtgaacttattcttagcaaatcttaatccatcatcttcacagatggctaaagaaatggcctgtaaacattttttctaataaccactaaagtagtgacgttcaaactcttttatgacaatgtgtgagaaatacacagtttatatatagtcaactaggcaaataaatatacgtttgtacatggggatgtgtagtgtatttgtatattctatatgcagtgaacgctatttagtaatatattttatctccattctttaaaatgctgtttgtggctgacaacattaatcttacaacccactatggattaaaaaccagtttagaaatgattacagcttttcagagaacatcccccatggttgataaatgttgctatagaatatatgcaaatatgcatgagaacccaattttgtccacctcctttgcaattcagtgtttttagacaaaaatatcatctttgttatgggccacaaaggctactacaaaatatacaattactgatgaaatatgtgcttcatctgcagatatcagcgtctgttttgcacaggtgaagtcttacttggacagatgggaactcacaggcaaaaggaacagaaaatacatgtgacctcttgtcctcttgatatcatgtggaggctttgcttgggctgcagcatagctgaatgtcatgcattgcatgcattcacagggaggtccctgtgtgacctccattcccttatggtgctccattttatgaggcaagtgggagagctacactgaaaatggtaggtagtaaataatttggcctcaaccaccaagcaatctgaggtcacgtgacagtgtttactctggtaccctgaaacttgccagctgctcagaatctgtagactttgtcccacccacccaccatcctgtggaaatctatgtttggtcatagattcccatgcatggaggatgggaagctctggtcatgtgggaaattgagccctctcacaggtagactggctgtgttggtcccagctctgtttcctcccttagcagctagagagttgctagggtcatgtatcaggcaacgcttcttgtctctgcagtgtctttcatactgtctgctgcttcctgtttgtcacaagggctccttcacaactttcccaataccaacgcaattatgatcctttgaagtcatccagcaggtccggagttatggcccacaggaatggcagtgggaagttcaaatttggcaagaaattcaagcctgccctttgaagctggagtgaggccactcaggaatcattaaagtccaggtctgcaggtgatgtttaatattaagtgtcaacttgattggatcaaagggtgcaaagtattgtttctgggtgtgtctgagaggttgttgccaaaggagattaacatttgagtcagtggactgggagaggtagacccaccctcaatctgggtgggcaccatctaatcagttgccagcagcactagaataaactaagcagaagaacatggaaaactagacttgctgagtcttccagcctccaacttctcccgtgctgcatgcttcctgtcttcgaacatcagactccaggttcttctgcttttggactcttgaatttacaccagtgatctgctaggggatctcgggccttcagccacagactaaaggctgcaatgctggcttcaatacgtttgaggttttggaactcagactgccttttttgctcctcagcttgcagacagcctattttgggacttcgccttgtgattgtgtaagttaatactccttaacaaaccctgctgcacatacacatctatccatcagttctgtcctttacagatccctaactaatacagtgtgaaacagtaaaatctagccatctgatggctgcacatcctgcacatgtaccccatttttccaatcacagtattctgatttttgttttgttttgatttgctatggtttggtttggtttttttgagagggagtcttgctcttgttgcccaggctggagtgcaatggcgtgatctcggctggctgcaacatttgcccctgggttctatcgattctcctgcctcagcctcctgattagctgggattgcaagtacccgcaccatgcccagctaagtttttgtattgttagtagagacgatgtttcaccattttggccaagctggccttgaactcctgacctcaggtgatccacccacctcggcctcccaaagtgcacactattctgtttgcagactgaaatatgagttggcgaggaagatgatatagaccaagacgatgtttacgacttgctcagctgattgggcctatgcttgtgagtgacttaacatttgatgttttctattagcagaattttttttgtgtgatagtgttgttgaattagtatagatgcaatgataaaggtctcccatgttgacaaaaaaccattgcggcatctcatgaaggaaacagtaacccaagaggactacatactggtttttcctggatgtgggaatttgtgttccccagatttgactagtgatttcctcctcatgcttattcatagctcattacactagcacatagctagtgttgcagcatgtctttaaacatgcatatgatcagaagtatctatgtaatctgtatattcgtattattgacatgcattgataagaaaaattttttatctgcacgcgcacacacaaaaccctcttttcccaggagcccagtgtgccagagcctcaacaagaagaaccaccagcttaaagttgggatcgtacacctggtcagaagacagaagaagatcagggtgcagctgagattcaaggtggtgggaagggaaagaaagaatgtctatgggggggaggagacctatgtgtgcatcatgccttatgccatgaccagtaagaggaggaaagaaaacactaggaaaggatctcaaacatttgctgagggttggctggaaacgtgacgggtatagtttgcagcttcctgcagtccctggatatgattaatcttctctttttcttcgagatgcattttgtgggcttgaaaatacagtccttcctaaatcagatgaaaccatttaattggttgtataaaaatgtacattatttcactagtttaacttgatattcttaggatgttgcagtgagatcttctcagccatggtgttcacagtgttttaagcaccctttaatagcatgtggagtgccaagtcgccctaccttataataccctgaataaagcccatttgcaaagggatgttaacctcattttataaataaaactgaggcccggtgtggtggctcatgcctgtaatccctgtgctttgggaggccgaggcgggtggatcacttgaggtcaggagttcgagaccagcctggccaacatagtgaaaccctgtctctacgaaaaatacaaaaattagctgggcatggtggcacacactcataatcccagctgctaagcaggctgcagcagaagagttgcttgagcccgggtggcattggttgcagtgagccaagattgcaccaccgcactccaacctcggtgacacagcgagactccgtcttgaaaaataaaaataaaaataaaaaaataaataagaaaactgagaatcagaggttgagacttaccaagaacacgactcatggagaaggaattcatattttgtttcaaggtttgcattcttcccgccttctgttttagaaaatgtgaatgattttgcttaaaaatgcttaatacttaaatgtgtctgtactataaggtaatttggtattggctcagggcaaaacgcagttcagtgaagcaagatagcaactccagaaaagaggccaatggatgacagccactgtttcctttgatttatatttttgaccatatgtttagtaaaagctggataattcaggacaatggcatacaggtaactgtgtttgtaggattttgaaggggcttttaaaagttgttctaatatttttataattagaaaacttcaagtacgataagattatcatgaaacagaaactgtttcctcaacagatagcattttcagactaatcagagacagaatttgggccatggattattttagcaattccctgttaaggggtttccagaatatgactgtcaacaatgcccattaatttctttgcacttcagttcccatactctcactggaagacagtgattttgctgttatattttgtattttttcttaatgacattcatgtatggaaagtcacatatagggcctttcaacctaataattactttaattaaggttaacaacaacattttcaagatacctcaacaggagatgagtgtcaagactataggatttgtcataggctcaccaatacattgatctaatccttcagaaaattacatttaagttatgattaaaatgctatccacgaggccatcttcaggtttcctaggtagctgtgtgtttataatacacaatggtaaagtatgggaaatgcaggtgtgctgagacttatcctcagattgtcattaaaaataagatatcataatacaggaaaacaaacggggacatctttgcatcacatttattaccacagtagcctacaggcttttattgcacaacactgaggaaaagaataggatcatttccttatttatcattcttgtctggctgctccaatcgatttccttggtattttttagtgcctgacctggaagctgatctccaggagctgtctcagtcaaagactggggatgaatgcggagatggtcctgatgtccaggggaagattctgacaaagtcagagcaatttaaaatgccagaaggaggtatgttatccattaagattcaaaattatgtgctttctgtattccacaatattacacttttcataataaaaagagagaatattactgcccctttaaaaacagaattcaaatgcagactttatttgtaaggtggttcagaccccagaagcctgactgcaaagccgaaacactatcagatacagacacaaattgggtgaaagccatattgaaccatcaaataggaaagcattttgttacttctaagtataaccaacagctaacaattttcagattactttgtaatttctgtttctcacaaatatataatgcatttgtaataccactttgtatgaaatatactgatctctgaaggagattctagtaccagctccaacacgatttgtgagattctggacaaatcacatcaatcctacacccatttttgcttttattgaaagtagtgaatgcatatcaaatagattaaaatccatttcagtgctgatttctgcatgctatggttctgttggagagaatacacagatattctgattttcatgattttttcatcataacaatcagctttagtccaattaaaatatctgagttgagatttcattgctcctaagaaaatgagaaggcactctgcttgatgcttgttttcctgtatggagaccttcatgagtgtttttggattttgtcaaatcctgaattctctcaggctcttaaacaatgattgcattttttttttcagatggggtctcactctgtcacccaggatggagtgcagtgttccgatctcggttcactgcgacttctgcctcccggattcaagcaattctcatgccttagcctcccgtgtatttgggattacaggtgcctgccaccatgccaaccagtttttttatttttagtagagacgaggtttcaccatgttggccaggctgggctcgaactcctgacctcaagtgacccactcgtctcggcctcccaaaatgttgggagtgattacaggggtgaacctcctcctgcgccagacccaatgattacattttaaagtcttcccgcagtgaagccttgaatgactgagtaataaaatcgatagagacagtcaggtttttgtgacccatgaagtagggagaatgcatgtaggtcagtcatgctcaaggtggttgtaagatgcctgtgctaagcatgctccctgtcctcctgtcagtcttcatgagctactgtgtgtaattagattgaagacacatatggtaacctctaaccatatcagaggttatattacaggcttctgccttgagtcatcagatgatatgatttagagttcaaagtctataatgtactaagtcctgagtagtccacataagtatttttcatacatgttttccaaattgctgacttaattagaagaacttctgaatttaaaggaagcactgcacgtatagggaagaaattatctaaatgtttttactccacactgctgaaccattccattcgactatttacattaaaggatagtttacagacgatttccaggagcctattgaacaagcctgaattgtattcttaggacagtcatagcattatatgcgtatcctattaaaatagacagcaaattacatgatacaagaaaataatacttagaaataaaaaaaagagtcacaagagaaacttaagggaaaaggaaacaggcagtaaatgaaaggtacgaatcattaaccaaaggaaaagtaatccaaatgtaataaatttaatagatcgttcttttgtgaaatatctaggaagagagcatccagtagcttaaacattcttgaggaaaatggaaaaagcacaacacggaatatgaacaagacacagatattgaatataaggcatgattgaaagggaatacattcttgaacactaatattttcagagtatggatgaaatggttcacatactaggaacacctacattatttaacatatacctttaatacctgaatatctgaacatcacaaagactgtgcatgagcttgtgaaatttgctgttcgtccctcaaaacagttacttttagaagcaaatatttagcttttccagatgccttactctcagttttctttccctcttcatttttttttgccatactggatatgatgtataactctttcacattttaatatcaatcatgatcgtgataccttaaaacttatatgaccatttaattaaaactgaagcccttactggagtagagccaattaccctgttatgccctccacagtggaagaagctctccttaaaactgaatctgcaacagagattcccttataaaatggtcttcccagactccagctaaaatcaaccctactggagtgtcacatcccatgagcaaatagccacatgccctgcccataaggctaacttgccaaaccccagaaatggcttcatcccttgctcaaggggagccagagggaggaaggccagcactcaaaaaacaagagaagcaatgctttttttcctctcccaagtatattacctagacaatggagatataattagcaaatccctgtagttattttttatataataacctacgacaggatataaacttaaaaccacatttatcctgagtaggatccactatagttacaggtttggtgattataggaaatgtcaagacattagggaaattgaattttccttgcaggatccatgaacatcttcaaccaaagcagaaatagcctaatcagaagagaggtgagggttcaggtcaccaagtaaggttcagttgatttggggttggaggagcttcaaatcttctaaatcttcgcataatatagccctgataatttaaatgagacagtgcttcataaacttggttgaaataagaatttcaatggagtcatagtttatttaaaaagaaaaatttacctccaaggggcagatgaaagagtcagtgttcctcttctgactgaaggagaaaactcacaaatgtgagtttaatgtacatcttaaaagaaaacagaagctgtgatcggtggttcacatgtataatctcaacactttggaaagcagaggcaggaggatcgctttaactcaggagttcgagacatgttgtctgtcatatgtgggagctaaaaattttgatctaatggagtagaattttggtgaccagaggctgggaacagggggtgggtgggatgaagcgaagttggttaatgggtacatacaattaagtaaaaggaataacttctatttgatagcacagtagggtgactaatggtaacaataaattatcatatatttcaaaatggctagaagggaagatttgaaatgttcccagcacaaataaatgataaatgtttgaggtgatggatatcctaaataccctgatttagtcattgtcctttgtatacatatatcaaagtgtcacatgtaccccataaatatgtacaacaatgtatcaataaaaaagaaataagtaaacaaaatacaatctaatttacattggtgtatgtatacacaatggaatactattcagtcatataaaagaatgaaatcccatcatttgaggcaacatgtatgggcttcagatgtgtgagcctggaggacattaagtgaaataagccagacacagaaagataaatactgaatattctcattgatatgtggaagctaaaagcttttatttcatagatgtagagagcagaatagagaatagtagactctgggaagggtgggagatgaacaggtagagtttagctaatggatacaaaattaagactaaataggaggaataatctctagtcgtctatttagcactgtagggtgactatagttaacaataatctattgtatattttcaaatagctataaaagaggattttgaacatttccaacacaaagaaatgctaaatgtttgaggtggtggatatgctgattatcctgatttgatcattacaagttgtgtatgtgtatcaaaatatctcactgtaccctgtaaatatgtacaattattatgtatgaataggatatatgtacacacacacacacacacacatatgtcctcatttactaacaaaaagcaactagctaatcaaggcccccttcctctccttccctttcctatatgacctaccacgctcataagttatctaaaagtaagtaatgagaactgaaaccacacacacagcttactgcctatatgaacaagagtttactattccactggcttcattaacataacattattactacaagaatctcttgcctgggaagataaaagttgaacataactttattattgattctaggaactgcttaaaaggcctatccactgttcagtaaaaagtgccaaatgacaaacccacagccaatatcatactgaatggacaaaaactggaagcattccctttgaaaactggcacaagacagggatgccctctctcaccactcctattcaacatagtgttggaagttctggccagggcaatcaggcggcagaaagacataaagggtattcaattaggaaaagaggaagtcaaattgtccctgtttgcagatgacatgattgtatatctagaaaaccccatcgtctcagcccaaaatctccttaagctgataagcaacttcagcagtctcaagatacaaaatcaatgtgcaaacatcacaagcattcttatacaacaataacagacaaacagagagccaaatcatgagtgaactattcacagttgcttcaaagagaataaaatacctaggaatccaacttacaagggacgtgaaggacctcttcagggagaactacaaaccattgctcaatgaaataaaagaggatacaaacaaatggaagaacattccatgctcatgggtaggaagaatcaatgtcatgaaaatggccatactgcccaaggtaatttagagattcaatgccatccccatcaagctaccaatgattttcttcacagaattggaaaaaactactttaaagttcatatggaactaaaaaagagcccgcattgccaagtcaatcctaagccaaaagaacaaagctgggggcatcacactacctgacttcaaactatactacaaggatacagtaaccaaaacagcatggtactcttaccaaaacagagatatagaccaatggaacagaacagagccctcagaaataatgccacatatccacaactgtctggtctttgacaaacctgacaaaaacaagcaatgaggaaaggactccctatttaataaatggtgctgggaaaactggctagccatatgtagaaagctgaaactggatcccttccttacaacttatacaaaaatcaattcaagatggattaaagacttaaatgttagacctaaaaacataaaaatcctggaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtaaacaggcaacctacaaaatgggagaaaatttttgcaatctactcatctgacaaagggctaatatccagaatctacaatgaactcaaacaaatttacaggaaaaaaacaaacaaccccatcaacaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactggaaactggtttaaccgttgtggaagtcagtgtggcgattcctcagggatctagaactagaaataccatttgacccacccatcccattactgggtatatacccaaaggattataaattatgctgctacaaagacacacacacacatatgtttattgcggcactattcataatagcaaagacttggaaccaacccaaatgtccaacaacgatagactggattaagaaaatgtggcaaatatacaccatggaatactatgcagccataaaaaatgatgagttcatgtcctttgtagggacatggatgaagctggaaaccatcattctcagcaaactatcacaaggacaaaaaaccaaatattgcatgttcttactcataggtgggaattgaacaatgagaacacatggacacaggaaggggaacatcacacaccggcgactgttgtggggtcgggggagcggggagggatagcattaggagatatacctaatgggtgcagcacaccaacatggcacatgtatagaaagaaaagtactgtatgatctcacttatgtgtggaatcagaaagaaaggtggggggagaaagaaagagaatgagaaagggaaaaaaggaaagaaagaaggaaagaaagaaggaaaggaaggaagaagaaagaaagagagaaaaagaaagaaagaaagggcaagcaatagggagatagaagaaagagcaagcaatagggagatagagaataaattggtggtgatcagggacaggggaggatagaggaggaaatggggagatgaaggtccaaggatacaaagtagcaggtatgtaggatgaacaagtctagagagctaaggtacaacatgaagattgttgctattatattaggcactttgattaaataagtagattttagctgttcttgtcacacaaaagtcactgtgagatgatataataggttaatttccttcactacattagccacattactatctttatgtaacccataccatcatgttgtaaacctcaaatatacacaatgattttttttttaaagggacaaggttttcgaagcaatcagggtttcttgccaacgaagatgcccccaggcctccgtggattcctccagtcttcctcatgaatgccagatggtggtgtgcaggaaaaagctggcaagtgaatgtggattccacttgtgtctgagactttctgggattccagctctcccaattgcctgtgtttggcctttatgaatttgttacattttcaattacttccttcttatcccctcttatgactgtcacttcttccacatgtgctctgccagaggtgatgcagtttgtgtgtctcatctcccctcagagagactagccacccttggtatcagttcccatggctgccttgttaccccagctaatttatttttatttttttgtagaatcaaggtctcactatgttgccaggactggtctcaaactcctggcctcaagcaatcctctgacctggcctcccaaagtgctgggagtacaggtgtgagccactgtgccgggctttttgctcaggttttaatcagattatttgttttcttactgttgagttccttatatattttaggtcttcaccccttctcagatgtatggtttgcaaatgtattctctcattccataggttgtctttgcacactgttgattgtttcctttgctctgcagaagtttctgagtttgagataatctcattcgtttacttttgcttttgttccctgcactttggggattatatccaaaaactaattgcccagaccagcgtcatggagctttctccctatgttttcttctagtagtttcatagattcaggtcttacattatacaatgttaattcattttaagttgacttttgtatatggtgagagatgaggatggaatttcagtcctctgcatgtggatatatcattttccaaatacaatttattgaaggctgcccttcccttactgtgtgttcttggcacctctgtcaaaaaccaattgaccgtaagtgcatggatttacttctgggctctctattctgttcctttgggtcacatgtctattttggggatgccataatacttcagttctctttccggatttatattcctcaattttattgtccttgcttctctctgtcagttttcatgtattccttagctttgctctatattctttcctttggagaattgatccatcattataagtttaggtgttagaagttacggggaggcaaaaggatgctcaatagcctcttccctcaaaggatatgcaatttggttaaggacacatataaattaattaaagtttttctttctttgtttttgagacagggtctggctttgtcacataggctgcactgcagtggtgtgttgctacttcactgtagccttgagctcctgggcacaagtgatcctcctacctcgacctcccatgggaactgggattaccagtgtgaaccatcaaaacaaaacaaaacaaaaacaagtgtgaaccatcaaacccagcccagagacatgtaaatttatcattataatttttaaaattgcataattcaatttaatgttgtcataatttttttcaaaggaattgcgtccggagaaatttattgtttttaagactaaaatagtcattaaaaagatggatgctggctgggcacggtggctcacacctgtaatcccagcactttgggaggccgaggcaggcaggccacttgaggtcaagagttcgagatcagcctggccaaaatggtgaaacctcgtctctactaaaaatacaaaaattatccaggactggaggcaagtgcctgtaatcccagctactcaggaggctgaggcaggagaattacttgagcgtgggaggcagatgtttcagtgagctgattgcgccactgaactccagcccaggcagtagagtgagactgtcttaaaaaaaaatggatgctaaaaaaagaaaaaaacttaaaggcagaattaacattttggattaaaaatcaaagtacatgaggggatagattcctcatttgccctgatgggattattatgcattgtatgcctgtttcaaaatatctcatataccccataaatatatacaccttactatgtactcataaaaattaaaaattaaaaaatagaaaatttgcctgtgtttggcctttatgaatttgttacattttcagttcagaaaaaattctgagaaaaatcaaaaagaagaaagtaatgttcactttttgagggacaaagtttctcttaattgttaactgcttggagttacataatttagccattgctaattctatggtgttttcattccaattttaagtttaaaaatttcattaattatgttatccagtgggtctgaggtagaagaatcaatgttgttgatgctgctttcacagcaaagggactggttccagagtcattatagtggagaagattgggagttagtaaaggagccaacctaagtaagttttggacaaaaaaaatacgaaaatagccactttctgaacccctaaatgatgatagatgaggaaatatttggaagaggctaaggtaaatttacagatgacagactgctaaacggctactctaagaagcaaagatatcctctggcattcacattgatggacttttgcttcttgtctgatgactgagcaccatgattatttccctttgctgtaatgatgaaagaaataaagataaagatggtattgatgtcgtgaaatactattacagcaaatattgtagccttctttctttcacagaaagcagcattcattaactttcaccaagaaaaatggaaactaaggtcctctctatcctccacccctaaatgatacctaaaaaggaaaactgacataaccaagtgtgaccttaatagtgagtgtcaagttgattggattgaaggatgaaaattattgatcctgggtgtgtctgtgagggtgttgccaaaggagattaacatttgagtaagtgggctgggaaaggcagacccacccttaatctgggtgggtaccacctaatcagttgtcagtgcggctagaatataaagcaggcagaaaaatgtgaaaaggctagagcagtctagcctcccagcctacacctttctctcatgctggaatcttcctgcccttgaacattggactccaagttcttcagttttgggactcagactggctttccttgctcctccacttgcagatggcctattgtgggaccttgtgatcttgtgagttaatacttaataaactcatatatatatatgtatatatatgtatatatgtggatacatatgtgtatgtacatatatacgcacacacatatataggagatatatatatatacatatatatataggagctatatatatatatatctcttattagttctgaccctctagagaaccccagctaataggccaagaaaatgtattcaagatagcacactgctatttattttatcaaagatttgtgatagtatattctctctgagggaatttaatattgattttcctgatgtaaaataatatttcttttctgattaaaaaagtagtagatgctttttatagaaacttgtaaaatatggaatagcagaataaacactaacaaccacaatttctccagtctgaggtaaacaatgtgttgcacttctatccagtaccttttataactgatgcaactcttaagttgtatacatatatcaaaacatcacattgtaccccataaatacatataatagttgttaattaaacaggttttaaaaaagaaaaaatagtaagtcaacaaccttcgaacaatatatatacagaaaaattagtctttatataatatgtagagttgatattcttcacacagacaaaaaaactcttgaagtgaaaaataaatttaaagcactacataagtaacaagatgaataaataacacaataaaataaaaaattagtactaaaacaattcaaagtacaaagctatggaaataattatgcaatctagtaattttagaatgaaaaataaggcaaaattgagattaaaattttctccatcaaagtagaaaacacttaattttttaaaaacaaggaatacagtgaagctgatcctggaaaaggtcatgttggtagggaagttggattcccatcattctttcccccaggcatgcacaacgacaaagtaaactgatattggactgttgtgtcagagcagaatccaggaatggaatgccctgcagtgatgtaattttccaaagcagtcaataaatctttataagttcccagatgaagcaacataccagcctccctctgtttatgatttgtatatggtgagagatgagggtcaaatttcattcatctgcgtgtggatgtacaatttctccaataccatttattgaaagctgccctccccccactgtctgtgcttggcatctttgtcaaaaatcaatagagcgtaagtgtgtggatttatctctgggcttaatgatttttcattactcttttctttactgatgctgagcatgtaaaatttaacaataacaaataaattcatgataagaaatctaacaaatctgactttctcagttacactccacttgaaaacacatgaggtttgtctgtttgactagtacttcctttcctggtgaggttcagcaatagatgaactttgtgagcttcagtgactacttcctacctttccaggtaattgtaagaataaaataaatgatagtgacaatagtagtgaagatagtattaaaataaggctgggcttgttggttcatgcttgtaatcccagcactttgggaggccgaggcagaaggatcacttgagcacaggagttccagaccagcctgggaaaaatagtgggatgtcccatgtcaaaaaaaaaaaaaaaattaaaccattagcctggtgtgctgttacatgcctgtactaccagctaatagggagggtgacatggcaggatcccctggagcccaggagttgcaggctgcagtaacccacattaacatcactgcgctccaacctgggcaacagaatgagaccctgtctcagaaataaaaaacggtattaagataaagctaacagcaatactattatgggctgaattgtgtctgctcaaaattcatatggcgaagtcttaacccctagtgcctaagaatgtaactgtatgtgacataggtggggtctttaaagaggtaattaagagaaattaggtcattagactgggccctaaggcaatttgcccagtgcccttataagaagaggaaatgaggacacagacacacgtacagagggaggactaaggcagacacagggagaaaacagctgactacaaggcaaggaaggacgccttagaagaaaccaactctgctgacaccttgatctcagacatgtagcctccagaattgtgagaaaatacatttctgttgtttaagccacccagtcggtggtagttattgatggcagccctaacaaacgaataaaaatccttttagtgcccctcaggaggtgagcattatcatatctattttatgaactagcactactgctcctcctactaatttaatgaccgcataatgatgcctgtatctgagcaactgagcagtgataagaaaacttcaaaaccttctgaattattttaccttaagtccatgaccacgagagaattttctccctttcatgctcttcctacttccactactacaatactctcacaaaatgccaggaaccctcctccatttgaatgacctctcctaatgattcattcagaagacagaagcaatctgctgggaactcttagagcttcccaaacccagtctacctgtgctgttctggcattctctgcggcccttctgcatgcaattgctcctgactgaagccagcccctcacctcagctcaggatcacataacttccactttcccaggggctttgatcctgcaatgatcacttctgcccctgaaccatcaacggctccctctatactggattattccccaagctaaggaggaactcaccttattcccccatgtccttctgtagctactaacacatttatctgctgcccttcacagcaaaacttcatgaacttatacaacttcacttcattggagtccattttcatccattgctctagtttcagaaaaccacaggccttttccacaacttagggtacagctgttatcctaacttgttataaaactgctcactgctttagggtatggctgtgagctcctcacaggcagagagacccaccatctgtgctgtctgtcactgagtacctgctattcagtgttgtattatgggactagggacacggtgcctacacaatgctgctcttgcttttgttgtgtctgcaaacaatcaactacttggatccatttgggctcattatctccttattgaccaaatctatgaatatgttacacggcaaactaacaactgcagtggtgatccttgtggccagggctgcttagggactgcttgagcacttgacacactactgtattgagttgtgtggcattgcatgcccagaatattgatttattcttcatggcatcgcacacagcaaacaagttttctgcacggacaattgacttaggtttggccttgtcacacctcagttttttagaaatccactttagaatcgatcccgtgtctgacaccagctacactgctaattcattaacatattcattgaaatcaaataattttgtgaagtcaaatgcattttaaaaggtaacttgacattcctacttgaaattcaaaagcagatatcacatacaagagatgtagttttaaagaaatatggaaggaaaaagtttgaaatcttaaaggaaacaaggaaatctagtaaaccaaatttaactgcaaagcaatgcctacttggtatgttatttcattgattcttcatagcaagtaattagtgtaactattgtaatttctactttagaaatgaggaaatggtcccaaatattgcaagtatcttgcccaccatctcaaggccagtgtgtgggaggcaggatggaaacccatggctaattcatgccatagcctctaaagagacagtgtaggtaggacccaagtcatcttgcttcagcaagttgctctggttgctttcccctttcttctacctaagccctaattcttccatccagttctacagcctaggaacttcttacatattttgtggcaaattggatatcgtaacaaaggaagcagatgaggagacacataaggtgaggtacgggggaaggggcagggagcttccatgccctctatgcgcaagctgccctccatgtgttcagctagagggaagctctctgaaccatgtccttttcggttttcattatgtaggtgtcattgattaaactgttggcccgccatttgtgatcaacttaaccttcagcccttgtcccttccctgaaggttgtgggtggggctgaaaggcccaactctcttcttccccaacctagagctacctaggtgctgctagccatcagtcaattcactagcatacaaaaagacaccactttgtggagattctaaaaattgtaggcgttgtatgcctggaagcagggtctagaaccaaatatgtgtttcacaatatcacacctgtgcataccagctcaatcacaatacaaaatttcaaaaatgattcttaattttttttgaaattgagtctccattccaaaataatttaaccacatcctggacctcttgggggcccaagaggtcccaccttaacctccagattagctgggactacagctacatacatatatgcatacattcccaccttagtctccagagtacctgggactacagctacatacatatatgcatacattcatgtatttattcttttattttttaaaaaagggggtctctttctgttggccaggttggtctcatctcctgtgctcaatcagtcctcctgcctcagcatcccaaagtgctgggattagaggcttgagctaccacatcaagccacagttttcaatagtatcaaatacctgggaataaaatgaacaaaagatgtgcaagacttttttggtgaaagttgcaaaactttattgaaatatttttaattcaaatatctctaatataaaaccagtttgtgttgtttcagcttgtcttcgtttaaaactgtggttgcctttctcctataatagaaacataaaagttgggaacattactaggggaattatattcagatgaaattaaagatatgggaaggacaccaaaatcttagttttatacagtggacaaaaaccagaagtctaagagtcacccttttgcttacattgaggtagacctctgtagagacttcgacgataaacatccaagcatatgcattaaaaacatttttaaaacacaccctgctttctagtcctgcaaggaaaccaaaagatagtccaaggtccgaacatgtgcatagttttactcaaaatatcagcaccacacaaaatacctaagaaactaaaggaatttacaaataatgtgtactttttctgtaaacttgcttttaatgttttggcttcaaactacggtctggatgcctaataggctcctggaaataccctgaaaagtatctttggagaaatcagttaatgtcacattaggaactgcatacaatatggtgaaagccttgtttgaataaaggaagagtgaaggggtagacatgatgaagctgtcatgcctgggagaccatggatttacccataatatgaagcagcagccgaagctgttgtctattatgaaaaatacatgtactcacagcatttaacaatagtccctccaactgcaagagagctggatccctggatcccttaaccactgttctgctccagataatatatgggggaaaggtgcagcctcatgctaatgttaatttttgttttctcctgcaggcaggtagacaaaggactcaataattgccaaagagctttgcacaggccaaaaatcctgaacatttgaattgctctttcatccaagtgggaggaaaattatcagcttcctgggttggagcaaagcctcagaaaacccttaagccttagattttaaaaggcgggtaaaagtggctgcatgcactggctcacaccaggaattccagcattattggaggctgaggcaggagaatcacttgaggccaggagttcaagaccagcctggacagcatagtgagactcttgctctacacaatttaaaaaattagctgggcatggtgacacatgcctgtagtcccatctattcaggaaggtaaggcaggaggatcactttagctcaggagtttcatgtcgtagtgagttgtgagtcctccagtgtactccagcctgggcaacagagagaaatcctgtctgaaaaagggtggggggggttgtgaagacacattccagccttgtcttcagctgggcgcccactgctacagccccctcccaacatttgagccaggatctctcttagccacagtacttgtaactctttgaatgctgaatttactgctaggagtttgatggaaatttcaatgagatggatgaaatcagggaaagttttaaacaggccttgcattttgtggctattacatctggatatatgatattgatggaaggtggccagcagtttggctactcaacgcagcagccacaaataaggaattcatcttttctacacttctcactggataagtgatagagacaaaagggatggaggttatgtaaactgatttttacaatttttacaaattcaggatttcatcctgaccatttcttaaacatgatgaatcttttcactaaatttatattataatgtgtttttctgaaaatgcttttgttccttctgcataccacccttccagaaagaataaaaggtttggaggaagaaacgggatgattaaagggataaaaacttttcatcacagaatacttcatgctgattttctatcagctggaggaaacagaaaacctggcacatgaggagaggcaagggagggaaggatgacatcggttgtctttgtttttcaaaactgttcctggaaactctccacttttcctcaagcaatacttcccatgcaggctttccaagctgttgtgagccaacgttgaaatcacactgactgctgagcccatgatcaccttataggtattcagggaaattagttaccagtcgagagatttaaatgtgtaataacacaacctaaaaaaaagggtagaggtgtgaattgattgagtctacagaagtagttaaattcattgtacacatggttgaaaacccagaaccagataaggaagtgattaatcaaagcatgtataaaaattggccaaaatgggaaaatcacttgagcccatgtgtttgaaagcagcctgagcaacacagtaacaccctgcatctgaaaaaataattaaatacattaggtgtatttaattatatatcatattatattcaaaatacatgaggggaacacccatacatgagaaagaagatacaaacacatctgcacttatagtaggagatttcaacatttctctcagcaattggtagaaacagtgtacaagaaaatcaggatatatatatatatatatgcagaaggcttgaacaatggtatcaaccaactcggcctaattgttatttatagaacaacaacagaatatacattcttcacaagtgcacatggaatgttcaccgagatagaccttatttatgggccaaaaaacaaatctcaacaaattctaaaggaatgaaatcttacaaaacatgttttgtgaccacaaaagaattgaaatagaaattagttgtagaaagatatacggaatccctgaaatattggaaattaaacgacacttttaagtaacgcagggatgaaagaataaattgtagagaaaatttgaaaatgaaaacacagcctatcaaaaaatgcaagataacacagtaaagcagtgcacagagggaaatttatagcattcaatacttatatcagaaaggaagaaatgtctcaagtcaattacctaagcttccacattaagaaactagaaaaacagttggccgggcatggtggctcacgcctgtaatcccagtactttggtaggccgaggcaggcagatcacaaggtcaggagttcaagaccagcctgaccaacatggtgaaaccctggctctactaaaaatacaaaaattagctgggtgtgggggcacgcacctgtaatcccagctactcaagtggctgaggcagcaaaatcgcttgaactgaggaggcggaggttgcagtgagccaagatcgtgccattgcactccagcctgggtgaaggagtgagactctgtctcaaaaaaaaaaaaaaaaaaaaaaaattagctgggcatagtggctgaggcaggagaatctcttgagcccagtaggtggaggttgcagtgagctaaggtcgtgccactgcactccagtctaggtgacagtgccagactgtctatgaaaaaaaaaaaaaacctaaacaaataaataaaataagaaactggaaaaataaaatcaaattatacccaaaacaacaagaaggaaaaattaataaagatatgaatagaaataaattaaatagaaatgaaaaaatctattaaaaaaatcagtgaaaccagaagtcgcttgtttgggaggaacagtcaaattaataaacctttagacagactgatgagagaagtggagagagaatacaaatcacagatatcagtagcgccagagggcacatcaatacaaatcattcagatattaaatatatgatagggaacatggtgaaaagcactatccaaaatattattttttaaatggagtgggaagattccttgaaggacactagctagcaaacctcattccccccaaagaaatagatgacatatatagtgtttataccaattaaagaaattgaattcactaaaaccaacaaagaaatgaaacaaaatttttttctcaaataaaattcatgtttctggtgatttcactggttaattctgcaaacatttgtggaagaaatagtatcaattctacacaaaccctttatgataattgaaagagatcacacttttcaaagcattttacagagcccacatcagccttatatcaaaaccatacaaacattatgagaaaataacatgacagactaatataactcatgttcataaaagcatagatatatatatatgctataataatagcagttcagaactaagaatgtattaaaaatatacaacatcatggccaaatgagattcatcccatgacttgaatatatatacatatgtgagtttagcaaagtaatatggtacaagataagtatgcaaaagtcaatgtgatttttaaatatcatcaacaaataattgaaaattgaaaatcattaccacttaatatagcagcaaaaatccatgaaatatttactggtaaaatttaacaaaatatgcacacaaactatactcagaagcctaaaaaacattgctgtgaaatattaaagcaggctgaaattaatggaaaggtataccacgttaatggattgcaacactcaagattgtgaataagttagttactcccaaatgaactatacattcaatgtaaacacaatcaaaatccttgaagccttttgtttctacaaactgataagctggccttaaaatctatatggaaaagcaaagggactagaatagtctaacaattttataaagaacaaaattattggaggactcagtacctgttttcaagacgtatttcataactgtggtaattaggacagtgtgatatcggcatatgaaaagaaataaggggccaaagctagacctatatagtcacgttaaattgattttttccataaggtgccaagataatttagtgggaaaggatgttgtattcagagaatgatggtggaataattggacattgacatgcaaataagtgaacctcaacctttatctcacacgatataaaaaagttacctcaaaatgcattatagaacttaatgtaaaagctaaagttttgacacttctagaagaaaatgtaagagaacctgtggcatcgtgtaaaacaaagacagataggatacaaaaagcagaaactaagaaatagaaaattcataatcttttaaatatttatatccttatgtgctatccctatccagtcactagttacttttccaagcattatacaaatcacatgaagaggtcattagtgttccgatttcctagaaaaatttccattcgaatttttcgtgcaagctcatgatgatgaaatcccagcattacatttaggctccacaataccctgtaaggagagctgaatattcattatgctcttaaaaatatggcctcgccctgccccacagactcagtccttgagtccctgaggaaataaagtgataatcaaaagatcatcgaaggggtcaaaggtagtcgtgacattgtatctctggaacatgctccagggaaatgtgggaacaacaacaatataaacagcaaaacagtaacagctagaaatcattggaaactgacaatgtgccagggacagtcctgacaactgtgcatgtcttcacacagtcagtgatctaaactgccccaagaagtagatgcaattactagtagtatttcaatggtactaatggagaaaggaatcacagagatgttaagtaactttctcagtgtcacccagcagtgagtgctggagccacaggtcagagacatcatgtaaaactctactgtgctgcatatttgtggaatcaagagtaaggtccaaaggctattgcaaaatatttaggatttcatagcatgagactgcacaggcaagagacattcgatttcttcggaaatagttaagagatggagacttgaaaggatcggcctgggtatcatttggagatggtgccctgagtgtgtcattaccataacaggcagcacgtcagtgtcggtctcctcacctgaaggtcttggatttgtacatcagagaacacaccaaacctgtcccttctataccttcacaaaggagaaagaagctgtcttgctgggaaagcagattattctgctctgctactagttctcagacaagtttccattaaggttgcaagccaggatcctttaaaatgaagattccacgattcacacctggcgaatctcatgtagcgtggccacaatggtgtcctaggatcttggaatttactgctcaggcttgggaactttcagaaaccttattaaattgcttaggtagcaagactgtctgcaatatacctactcttcccaggacagacatgaggttgaggagatcgacatcagagcaaagaggaacacaggacaagatgagcgcagtgagactcaccataagggtggggcagacagacttttgagaaggcctcacaactccatctggcctttctccctgaaggcctcagtttatctcaaatcccttctcttcatgggcggtgaatggagggaatgtcaaaaaataacctttcagattccaaaatggcatgggctcctctcagggaccattgaacgcataggtgggaggtgttcccagctattctgctcctcccaccagccttggattctgcttggcaccatcatgtccttccatgggagcctagagcaatgtcaggacttagggccaatgtcttcccttcactaacaggcacctgctcctcaactgcagaagttgtctcccttctcctcctttcagctgttcttttcctgttctcatctgtgattctacagcagacagctgtccatggtagcttgacaacctagcctggcaccttcctcctgtgccccagcctggagagggctgtccttgccgagaaggacatcagtcctgggatctcagaactatgactaccaaggaaacatcctgagcatcaatgtccaatagcagtgattgacttttgaaatgaagcttcaccacagaccccagctggccctgaaacactttctcttatttttgttttgtttgaaatggggtcccactctctttctcagcctgcggtgcagtagagcaatcatggctcactcctaggctcaagtgatgcttccacctcagcctccaaagtagctgagactacaggcatgctccaccacgcctggctgttttttttaaatttctttaatatggtggtctccctatgttccccaggctggcttgagacaccatgcctatccctgaaccactttcttgtcactaaaagcaaagcaagacagaggagggagttgcctgtaacccctcctggagaacattgtgtcctcctccttggtgccttgttatttcctctgtactggccgcaatattcctactcttttgatgtaaataagaagtgtgaggatacttcttttcaatcctaaactcatggtttatagccagaatatcattgtctactttgaaacattttggttgtttccgagtgcagctgtggttgttggaatgatgggtaggagctactggcatttggggactgagcgttacagggaggcaaagatcattttccagagttttaagtaaactagattttccatacatgtcactcccctgcaaactgagggaggctggtatgttgcttcatctggaaagttatgaaagacttattgactgctttggaaaatcacatcactgcaggccattccattcttggatcccaccctgacacaacattccagtatcagtttgcttagtagctctgcatgcctggggtaaaaatgaagggaatccaacttacctagcaacagtatcttttccaggataagcttcccggcacaccccagctggccccaaaccacttgttgttgctgtttcagaccgggtctgtcactcagcctggaatgcagtggaaaaatcatgactcagtgcagccctaacctcccaggctgaagtgatccttccatctcagcctcccaagtagtttcactacatggaggctccaccgcccacggccaattttttttttgtagaggtggggtgtccttatgttgcccaggctgatctcacactcctgggttcaagcaatactcactcctcaacctctattagaggtaggagccacctcacctatccctgaacgactttcttatcacagaaagcaggacagaggaggaaggtgcctgcaaaccctcctggggaacattgtgtccttctccacgctaccctgctattttctctgtaccaacggcaacattcctattcttttgatgtaaataagaagtttgaggatacttcttttcaatcctaaacttgtggtttatagccagaatatcttcggccactttggggcattttagaaatttctgagggcagctgcagtttttggaatgattggcaggtgctacttgcatttgggtactgagtgttacaggcaggcaaacgtctttttccagagtcttcaataaactggatttcccatacatgtcactccctttaaactgagggaggcctgtatgttgcttcatctgggaacttataaagccttattgattgcttcgaaaatcacatcacagcaaggcattccattcttggatttcactctgacagaatattccagtatcagtttttttgtatctgtgcatattgggggccaatagaataaggggaatccaacttacctacgaacatgataatttcaggataagctgttagttgatggggaaacttaagtgggagatgttggtaatgtgatctctcatgagtttgtgaacacactggctatgccccttgctgttactgctgctgcaggtgtatctccctcaccaggctcctggctccttcctggaagactggaaacatacccagtagatctctgtgtcctcaggatgggacagaggacctcataggcagaaggagggcagggaacacttgtggaattgtagtgacctctgcatggttggatgaccaaaccctgagtcacagtgatgagccacatggatgtcagtctgcagagggtgggaggggaacgcaacaggcctctgccttagaagccatgcagcagagtgagaccaaccttcagtactgatctcagttatgcccttcaagggtcccagatataagcaccctatttgttagggttcctctgggtgtgtgtgtgtgtgtgtgtggagagagagagagagagagacgggggagcggttttgaagacctagctcatgcagctgttgcgactggcaagtccaaatctcccagagcaggatgtcaggctggagagccagggcagaggtgatatgagagcccaaatccaagggcagggtggaggcagaatttcttcaacttgaggaggaccccagtcttcttctctgaaggccttcaagggactggatgaggcccacccacattgggtaaggcaattaggtttacttgaagtctgctgatttaaatgctagttctcatgtaaagaaaacccttcacagagacatataccctggtcaaagtgaacatttctcatgtatcgtggcctagcaaagttgacacatcagatttcccatcacagccatcttatacaaatcctattaatggtgaaggtctatctgacaaagacaggtgacttcctaactaagattctgtatttttgtccagcccaagccaccatttcaggctcagcacagctcttgccaggaagctgaagctgatgtgaatgccttccagggatgaggcagtgatgggctagtcagggaatacaggtaagaacaatcccacggggcacaggtgatacccctggacaccaagagtttacccttgttagggcacccccagcaggacatacagtcatcaggcaggagctggccaaggcccccgatatggcctcccactgagggacctttccctctaaggttcctcgtccagtccaaacaactgatttgcatctttggtttaggggaactgtcagaaggcagtcatttcagggaggataagtctcagcacacctacatttcccatactttaccattgtatattatacacacacagctaccttggaaatctgaagactgccccatggataacattttaatcaaaacttaaatgtaaatttctatgattagatcgatgtattggtgggcctaggaaaaatcttatagttctgacactcataccctgttgaggtaccttgaaaatgttggggttaaacttaattaaagtaatgcttaggtccaaatgcccttcatgtaactttccatacatgaatgtcactaagaaaaatgtatgcaatgtaacagcaaaatcactgtcttccagtgagagtatgggaactgaagtgcaaagaaatcaatgggtattgttgacaggcatattctggaaaccccttaacagtgaattgctaaaataatccatggcccaaattctgtctatctttagtttgaaaatgctatccgttgaaaaaacaatttctgtttcatgataatcttatcgtactttgagttttctaattataaaaatattgaaacaacttttaaaagccccttgaaaatcctactaatatagttacctgtatgccagtgtcctgaattatccagctttttaccaaacatactgtcaaaaatacacctcaaagaaacagtggctttcattcactgccctagtttctggagttgcttcactgaactgcattttgtcctgagccaatagtgaagtaccttacaatacagatgcttttgagtattaaatatttttaagcaaaatcattcacattttctaacatagatggtaggaagaatgcaaaccttggaacaaaaatatgaattccttctccatgagtcaattgttcttggtaagtctcaatctctgaggctcagttttcttattcattttttattcatttatttatgtatttattttgaaacggagtctttgtcacccacttgctctggagtgcagtggcacaatcttggctcactgcaacctccgtcgcccaggctcaggggattctcctgcctcagcctgcttaatagctgggattacgggggtgtgccaccatgcccagctaatttttgtattttcagtagagacggggtttcaccatattggccaggctgatctcggactcctgacctcaggttatcccgcataggcctctcaaagtgctgggattacaggcgtgagccactgcgctgtctggcctcatttttcttatttataaaatgaagctaacatccctttgcaagtgggctttattcagggtgttataaggtagggtgacttggcactccacatgctattaaagggtgcttacaacactgtggacagcatggctgaggaggtcacactgcaacatcctaagaagatcaaattaaactagtgaaataatgtacatttttatacaaccaattaaatggttttatctgatttaggaaggactgtattttcaagcctacaaaatgcatctcgaagaaaaagagaagaatcatcatatccagggactgcaggaagctgcaaactatgcctgtcacctttccagccaactctcagcaaatgtttgagatcctttcctcatgttttctttcctcctgttactggtcatggcataagccatgatgcccatataggcctccttctcccaataaacattctttttttcccttcccagcaccttgaatctcagctgcaccctgatcttcttctctcttctgaccaggtgtaggatcccaactttcagctggtggttcttcttgttgaggctctggcacactgggctcctgggacaaggggtgtgtgtgtgcgcatgcacacgtgttcgtgtgtgtgtttgtgtgtgtgtgcgtgtgtgtgtgcaaataaaaaatttcttatcaatgcctgtgaataatatgaatacagattacatagatacttctaatcatatgcatgtttaaagacatgctccaacactatcccaacactattccacatacttattcttcataaagttactcttcccatagagaggttactctaagactgttaccctcaacagcttgggtagccatttttatttatgttgggttgaatgtgtgtaatgctctatgaataagcatgaggaggaaatcaccagtcaaatctggggaaaacaagttcacacattcaggcaaaaccaggatgtagacctcttgggttactctttccttcatgagacgccacaatcactttttatcaacatgggagaactttatcagtgtatctatactggttcaacaacactaccacaaaaagaaattgctcctagtagaaaacattgaatattaagtcactcataaggagaagcccaatcatgtgaagaggttgtaaatattactttggtgtaagcctatatgttgatcttcctcaccaactcatatttcactctgcaaacagagtactgtgattgggaaaatgcacttgagaggatagctatatttgtccacatccgtggacaaatgttaacttgttttttttttgaagaatggaaatactttgaaagtatgttttagagcagttataagtgtgtgagccttctgaatagaatgcttgcacaatcatttaagttggtcaagctagttgagcaatgtcttaaggcttctggcaagagacacacagtatttccaatcaggtttggtttcacaactggactttccattgtggagacatttaagtttacacacctagagaattaaaattggagtgaccactgctttcatcacacacccattttctaggcccattttacacctcccccaaaatcaagtttcattggaatgcacagccctgcccattagaaactccagggtggagttgagaagctgtcacacagcactgggcgctccttactggacacctttatcagaagctctgcagaccttggagccatggtcattagcctgcagcgttccgagtttccaggctccttccttagtgcccacgccaccctttcgtgggtccccaccgaggaatgtggaatctgtcctctgtcgggggttccaggcccttctggcactcagatacccacaacagcacccccatgttcacctgaccccacatcccctgtctgcagccttccttcctccctcattctgacactccccacaatagggcccatggcggcgcccccacaagaggaggacgatgaacttgaaactcttctccctgtaagccagggaccacatcacccgacccttccaaagcttactgactcctcctcacactcattcacacttcaacttctgggaggactggcctgcagacctaccagctgagtctcagtaggggagaaagagtccagactgctggaacggtgacctttacaccttcacagcttccccgcgttcaccacgtgggtgaaggggcccacgggaagacacataatgaacatgtgccctgaggccagcccccaagaagcatgcacagtgagattggtgcctgccttgtgggctctggtgacccacctcacaatactctatcccccgctgccgtcctctgctctctcccaggtcccaaatgagcatttctgaatctgtcctctgtgagcagtttcatatgcctctggtactcaaataacacacatagtttccctgctcaaaactcactctaccaggagtttgagactagcctgggcaacatggtgaaaccccttctccactaaaaatacaaaaaattagctgagcatggttgtgcctgccagcagttccagctatgtgggaggctgaggtggaaggatcacctgagcccaggaggttgaggctgcagtgaaccatgatcatgcccctgcactctagcctaggtggcacagtgagaccctgtctcaaaaacaaaaacaaacaacaacagcaaaaatactccatgttcacttgacattcctcccctctatggccctccttactcccgcgtctgggctgcccatgacaccaagcccatggctgcatcactgcctgttaggagaaggataaggacctcaaggcccttctccctaggaagccatggaccacacccacgggctcctcctcacactcactcacacttcaactttctggtaggattgacgtgagcatctaccgacttatttgtagttggtacaacagaaggaagtcacgacatctcctcgcccagctctgcagggacagaaggcagacagcacagtgcacgggcaacaagggagttgggcagcaaggagcatgcacattgagtcaggcacatgcagggccggccagggctttcctgctgtctccagacccacatccccaggttgtttgtagtagaaagaaaggaagttgagattttgtttttgtttttagagtcttgctctgttgcccagctggagtgcggtggcatgatctcagctcactgcaacctctgcttcctgggctcaagcaattctcctgcctcagcctccagagtagctgggaatacaggtgtgcgccaccacgcccggctaattttttgtcttttagtagagacggggtttcaccatgttggccaggctggtcttgaactcctgacaggtgatccccctgccttggccctccaaagtgctgggattacaagcatgagtcaccacacccggccagtttttttttctccctcttgcccaactattctcatgcatccagaaactttgggaacagacagtcctatgtcacccttagtggaggatgtgtctcagatctgtgacagaaataaggaattttatgtccatatttacacatgcttttttttcagggtgttgctttcttgcccaggctggagagcggtggcatgaccatacctcattgcagcttccatctcctgggctcaagcaatcctcatgctgcagcctcctgagtagttgggaatacaggtggacgccaccatgcccagctaatttatttaatgtttattatttttattatttatttatttatttttttagatgcggggcctcactgtgttgctcaggctggtctcaaatacgtgggctcaagtgatcttcccacctgggccaatttttatacatgcgttgattaatcacttccttctccggttctgggttttcttccatgcatacaatgaatttaactatatttctgtagactcaatacattcatgcctctttacttttttacattgtgttattgcacatttaaatctctggactggtaactgaaatccctgaatacctgtaggtgattgtgggctcagcagtcagtgtgatttcaacgttggctcacagtggcttggaaagcctgtatggaaagtatttattgaggaaaagtggagagtttttagcaacaattttgaaaaacagagacaactaatgtcctccctccctcctttgcctctccttattgccaggtttcatgttttctccaattgttaaaaatcaccatataccattttgtgatgcaaacattttacttctttaatcatccccttcctttctctagacctctttttctggaagagttctctgcaagagggacaaaaggattttcagaaaaaagtattttaatataatttaggtgaaaagattcatcatgtttaagaaatagtcaagatgaaatcttgaatttgtcaaaattcaaaaaatgggtttacagaaactccatcccttttttctctatcatttatccagtgagaagcatggaaaacatcactccctggtttgtggctgcttcactgagtagtcaaactgccggacctcttccgtcaatatcatcacacatccagatgtaatagccacaagatgcaaggccagtttaaaacttcccccttttttcttctcatggaaatttccttcaaactgctagcactaaattcagcattacagagtcacaagtaccatggccaagagggatcctggctcaaatgtttgggagggggctgcagcagcggtagcccagctgaagacaaggccggaatgtgtcttcacactcccccaacctcctttttgaaacagggtttccctctgttgcccaggctggggtgcactggcgggatcataacttaagctacctcgggcttctgggctccagcaatcctcccgcctcacattcctgagtaggtgggactacaggctatgccaccatgcccagctaatttttaaaattttggcctggcctcactatgttgcccaggctggtcttgaactcctggtctcaagtgattctcatgcttcagcctcccaaaatgctgggattacaggtgtgagccattgcatgcggccttccccccgccccgctccctgctttttttcatttatctaaggcttaaggttgatctaaggctttacagaagtccaggaaactgattattttcctcccacttggaggaaagagaaattcaaacttttaacatttttggcctacacaaagctcacctttggtaacgtatgggtcctttccttacctgcctttagaagaaaagaaaagccaaagtcagcatctggctgcacttttcccccttaaattatccagcacagaactgcggacgagggatccagtgagccccctctcttgcagttggagggattattgttaaatgctgggagtacatgtgtttctaacagatagcaggtcggcagctgcttcacattatggggaaatccatagtctccaaggtgttacagcttcatcatctctaccccttcactcttcctttattggaagaaggatttcacattttatagtgagtcatggtcttgctggtgaatcacactgctgctgctattgtgtcagggatccccaagaccaccctcgctttcagtgattccctcaaattatctcccatccttctgcatagaatgctcctaactgaagccagccccctcacctcagctcaggatcccacgcctcccaccttctcaggggctctgctcctgcagtgatctacttctctctcctgaagcatcaactgctccctctatattggatcattcctcaagctaaggtggaactcaccttcttcccccgtgtcactcagtagctactaatgcatttatctgctgccattgaaggaagaactgcatcaatgtaaacaacccactacattgaagtaaattatctagaaaggaaaatgaaccaggacaaaacaattttgaagcataactttgggaaactcacactacaaaatgacaagattcatattaattttatttatttatttacttattattttattatgatgattttaatcatccagcctcatacatcaattatgttaattctatagtaatcaagacagtgtggtattgggaaaaatcccaacagattagaatagagtccagcaatagactcacagacattaaaaattgattttcagaagaggtgcaaaggcaaaggagaaagattatcttttcaagaaattgtattgttttcttcctgcttcatggccactgcatttactgtttatttattctcctgggtcccttccctgtgtttctcctttgtatttcagctgcttttctctgtaagggtctgtctgccccatcacaatatgatagccctcacagcaagtaccacgtgttattgtgattacttgatgtatcaatcccatcagtggtggactggataaagaaaatatggtacatatacaccataaaatactattcagccataaaaatgaatcagatcatattctttgcagggatatggttggaggtaaaggccattatccttagcaaactaaagcaggaacagaaaaccaaatactgcatgttctcacttaaaagtgagagccaaatgatgaaaacacatggacacatctgggggaacaacatgcattgattgggtcctagcaaagagcagggagtgagcagatggagaggatcaggaagaatagctaatggatgctggtcttaatacctgggtgatgggatgatctgtgcaggcaaccaccatggcacacatttacctatgtaacaaacctgcacctcctcctgcatttgtatgcctgaacttaaaagtaggaaatttaaaaagtgaatatctcagaatcttacaactatgtcttggtcaatgtgttatatatcgaagcattatggtgacataaaagcttgggtgtagcaacacttagtatgattggaaatttagcaggattatagcccagtaagatctaacatcaaatactaatattgaattgcactggacttctccaagtacttaaaggaaagttggtaaaaataaatattcatgcttgaaaatattttgaaatacatgtaaaatggatcaacactgaataccacagatgtcattgtcactggatgctaatgaagtacataataggaaccataagacacagtcaacaataacaggagggaaatgaaagaagcacatcaaagcaccatcagatgagtgcagaagcacacacatgaacacaccctgcagctgcagaaacacatggtaggaagtagagccccacaactcatcagccttccttctcaccaactcaggagttcacaaatttgtttactgagggtcaaatgaccacagtaaaactgaccaatataaacataactgagatatatttcaagcattatgtagaaagctacagacaacagtgaacttattctgagcaggtcttaatccatcatcttcacagaagcctaaagaactggcttctagacattttgtctgataatggctaaagtagtgaacttcaaaatgtttattgcaatgcatgagaaatacacagttacaatgcatgagaaatacaccatttgtgtatattctactaggcaaataaatatgtgcatgtgtatgttggtgtgcagtctatttaaatattctatatgcaataaatgctatttactattttattttatctcatttctttaaaatgctgtttgtggctggcaacatgtgtcttaggaaccactatggatgacaaaccagcatggaaaatatttaatccttttcacagaacatcctcaatggctaataaatgctgttatagaagtatatgcaggccgggtgcagtggctcacgcctgtaatcccagcactttgggaggccaaggcaggcagatcacgagatcaagagatcgaaaccatcctggccaaaatggtgaaaccccacctctactaagaatataaaaattagctgggcatggtgacacgtgcctgtagtcccagctactcaggaggctgaggcaggagaatcgcttgaactcgggacgtggaggttgcagtgagccgagatcccgccattgcactccagcctgggcaacagagccagattccatctcaaaaaaaaaaaaaaaagtataggcaaatacacacgggaacccaattttgccccctccttgggaattcagtcttttcagacaaaaaggtcgtcttttatgtggaccacaaaggctaccacaaaatatgtaattactgatgaaatgtgtgttccatctgcagataactgtgtctgttttgtacatgtgaagtgttacttggacagacaagaactcacagacaaaagagacagcaagtacatgtgacctcttgtcctctcggcctcatgtggaggcttcacttgggctgcagcatagctaaatgcatttattcacagggacctccatttccctactctgctccccttttatgaggcaagtaggagacttccacttaacatgataggtagtaaataatttgacctcaatcaccaagcattctgagttcaggtgacaatgttcactacaatactctgaaaattgctaactcctcagaatctgtagactttgtccacttaccatcctgttgaaatccaaatttgttcagagattcctgtgcttgaagtatgggaagctctagtcatgtgggaaattgagccctcccacaggtagaccggctgtgctggtcccagctctgactcttcccttagcagctagagttgctagggtcatgtattagacaactcttcttgtctctacagtatctttcatattttctgctgtttcctgtgtgttgcaagggctacttcacaacttgctcccatcccaatccattatgatcctttaacccatccacttggtcctgggttgtctcccacaggaatggcaggaggaagctcacatttggcatgaggttaaagcctggcctttgaagctggagtggagccattcagcaatcattaaattccaggtccttgtgaagcagaaccgtccagccatctgatgacatgaccttgaccatttgctaatgagttgctcacagaaagtctaaatccattctttgagaacctatgagtgcactatactaaaaactagagttaatacgggacaaaagaaagtaaaatttaatggtgttcttgccaaaaaagaaccaaaaagataaaagacaaattaataatagatcaggattatgactactctcactccttaaaaaaactttgaagaaccacaattcttactcaagctgctttttacagagagggagggagggactgaggaaccacacatttccttctcaaggtatttccttaaaaggagcccagctagatggaatatataggagtcaattcaacaatatatcctaatttgtttacaacaagctacattctgatcagggcccccttcttatccttctcttctatatactatttctcatataaaactgggaataatataaaagtaataagaagaggaatcatgcacacagcttactatctacataaatgagagtttatactccactggcttcatcaatgtaactttagtaatacaggaatcccttgccaaggaaaataaaagttgtaaaaaaaaaaaaaacaaaactattgttcattccagcaactgcctgaaagatccatcaactcctcagtaaaatgtgtcaaacgacatttctcaatgccaaagctctttgaaccctttgtctaaaaatcctcctcttgttgtgttcaccaatcctcaattattatgattcctaccgaattctaaccaaaccatcccccactttaaaaaatgcacttcacaccagactccaaaatcagaataaatatacctaaagcccttccacatgtgtgacatacgagtgtctctgtcgaggtagtgctctttcttacagcgttatgcaaataatgtcagtactgtcttatgaacaggttgtttggctgatatttgggagtatatgatgagcatagtcaccactgctgtgcatcatatcacagtagactgagcctagaagctacgatcaatatctatggatatttcagaaccctattgcctgaatgatctacaggaaaattcagaaaaaaacagttaccagtctagagatgtaaatgtgcaacaacacaaccttaaaaagtaaaatggtgtgaatttattgagtatacagatagtcaaactcattgtgcacatgacagaaaaccctgaaccagagaaggaagtgattaatcagggcatgtataaaaattggcggaggtgggaggatcacttgagtccatgtatttgagaccagcctgagcaacacagtgagaccttgcatctaaaaaaataaataaattagctgggcatggtggcacccacccatattcccaactactcagagggctgcagcatgaggattgcttgagcccaggagatagaggttgcagtgaggtatggtcatgccacctccctccagcctgggtgacagagcaatacactgaggaaaaagcacatatatatatatacataaaattccttatttttgtcacagatatttctgagacacatcctccactaagagtgacatgggactgtctgttcccaaagtttctggttggacaagagagagagacaaaaaaaatctcctaagtccctttctttctactacaaacagcctggggatgtgggtgtggggacagcgggaaaaccctggcctgccctgtatgtgcctgactcagcgtgcacgccccttgctgcccaagtcccttgttgcccgtgcgccttgctgtcttctgcagagctgtgcaagtagacatcatgacttccttctgtctcactgactacgactaagtcagtagatcctcagatcaatcctcccagaagttgaagtgtgagtgaatgtgaggaggagcccgtagtcatggtccaggacctcctagggagaagggctttgaggtccccgtttttctcctaacagtcagtgacgcagctatggccttgctgtggtggggggcctggacaggggaggaaggaaagtcatagagcagaggaggttctggtgaacatggagtgagttttgaagggggaaattatttgtggtggttgaatcctggaggcatatgaaaccccccacagaggatggattccaaagtcctcaatggggacctgaaagggggtgaaagagtgcaggactacagggtgccaaatggactggtgtgaggctgggcaccaggcaccaatctcactttgcatgctccttgaatgcccacctcaatgcatgttcactggacatcttccaattgatccctttgccagcgtggtgaactctgtggagctgtgagggtgtgagggttgcattcctgcattctggatcctttttccccaatttggacccagctggtagaacctcagaccagtcctcccaggagttgaagtctgaatgagtgtggggaggagccagtgagcttctggagtgttgggcagcatagtccctgaccttggagggtgaagagtcttcgtccttttcctggtgtaatagcattgccatgggccttgtgggacactcagaatgaaggaggaaggtgggccacagagtggagggggtgcaggtgaagatgaggagagtgctagggggagctattggagttttcttagtcctgaaagcacctggaaccctcaacagaagacacattccagaccccttggtggagacctgggaaacagggaggtggatggttaggaaagggcctgggaactgggaaccccgcgggctggtgaccaggcccgagatctcttgagcaccctgaagagctgtccagtgaggagtgccctgttctgtgtgccaacttcacaactccaccctggatgtccaaatgggactgtgtgttccaacaaaacttgattgtacagaggaaatgggcctagcaaatggatgtgtgacaaaagccgtggtcactgtagttttaattctctaactgtattttcctaaatgtctccacagagcagagttcagttgtgaaatcaaacctcatcggaaatatcctgtcttttgccaggagccttaagacattgctcagctagcttgaccacattaagtggctttacaaatatttgattcagaaggcacacacacttatacttgccctgggactttcaaagtgtttgcaaatttttaaaaaaattttgcaagttaacatttgtccatgaaagtggtcaaatatagctgtcctctcaagcgcattttcccaatcatagtattgtgtttgcagagtgaaatatgagttggcgaggaagatcaacatataggcctagaccaagatgatatttacaacctcttcagctgattgggcctatgcatgtgagtgacttaacattcaatgttttctattagcagaaatttctttttgtggtagtgttgttgcactattatagatgcagtgataaaagtatcccattctgataaaaaatgatcatagcatctcataaggaaacactagcccaagaatattatgttctggttttgcctggatggatgatctgtgctccccagattttgcacctgaatctctcctcatgtttattgataacagattacacaaattcatcccaacataaattaaaatggcttccgaagcccttgagtgtaactgtcttagagtaacctctctgtgggaagaataactttatgaagaataggtttatggaatagtgttgtagaaatgtctttagacttattcatgatcagggaaaactctgtattctgcatatttatattattgacatgtattaatgaaaaaaaccttttatctgcacacacacatatatacccctagcccctggagcccagtcatgaagagcctcaagaagaggaaccacaaactaaaaatcaggatcctacacctgttcatgacagagatcagggtacaactgaaattcaaggtgctgggaagggaaagaaagaatgtctatgggggaaggaggcctatgtgtgcatcatgcattatgccatgaccagtaacaggcggaaacaaaatattaggaaaggatctcaaacatttgctgacagttggctggaaaagggaagaggatattttgcagcttcatgcagtccctgaatataatgaatcttctctttttgtttgagatgtattttgtatgcttgaaaatatagtcctttctatataataaataagaaaactgaggcttagagattgaggcctatgaagaagagttgactcatggagacagaactcatattacattccaagatttgcgttgttcctaccatctatgttgttagaaaacatgaatgattttgcttaaaatgtttaatactcgaatgtgtctgtatggtaaagtacttcaatattgcctcacaagaaaacacagttcagtgaagcaggatagcaactccagaaaagagctcaatgaatggcagccactgttccctttctttggtatttctggcagtatatgtggaaaagctggataattcaggacactggcatgcagatagatatattagtgtgattttaagggacttttaaaggttgtttaaatactattataattagaaaattcagattgtgataagattatcttgagacaaattatttcctcaatgggtagcattttcaagctaaacattgacagaatttgggccatgaattattttagcaattcactcttaagaggtttccagaataagatcgtcaacaatgcccagtaatttctttgaactcaggttctcatactttcactggaagacagtggttttgctattatatttagtacttttttcttaatgggatttatatatggaaagtcacatataggacagttggacctaagcataactttaattaattttaactaaaacattttcaacaggggatgggcatcaggactatgtttgtcatagacccaccaataccttcatctaatccttcagaaaattatatttaaatcatgattaaaatgctattcatgaagcaggcttcagattcctagatagctgatactcactgttcataacattgtacttttgataattcaaagagagaacattactgctcctttaaaaacagagttcaggccaggtgtggtggctcatgcctgtaattccagcactttgggaggctgaggtgggcagatcacttgaggtcaggagtttgataccagcctggccaacatggcgaaaccccgtctatactaaaaatacaaaaattagccgggcatggtggcacacgcctgtagtcccagctacttggggggctgaggcaggagacatcagataatagcatttaaagttcaaaaaccataaggaactaattcccgagtagtagatataagtatcttttacacatattttccaaattgctgactgttaattagaagagcttctgaatgtaaaggaaggactccatgtttagggaagaaattacctaaatgcgtttactctgcactgctgaaccattccgttagacatttacattaaaagatagttttcagacgatttccaggagtctattgaacaaggctccattgtattcttaggaagatcatagccttaagtgcatatcttattaaaatagcaaattacaggataaatgaaagtgataataataaataaaaatagtaatagaagacccacagaataaacttaagggaaaaggaaagcaggagtgaataaaaggtatgaatcattaggaaaaggaaacgtaatccaaaagcaataaattgaaatgttgttctttttaaaaatagctatgaatagagtatctaatagtttacataatcctgaagaaaatggtaaaagctcaacacagaatatgaacaagaccctaacagaactcaatatacggtataattgaaagtgaatatattcttgaactctagtattttcaaaatatggacgaaatggttgataaactaggaatgcatacattagtaaatatatctcaggaatacctgaatatctaaacatcacaaacactgtggaggaacttctgaaattttccagttgacactcagaaacacttacttctagaaacaaatatttgccttttaaagatgtcttactctccttttccattttcctctccctccatttctttttttttttgccccattgttcatgatatatgcctctatctaaaatgatagtgatagattaaaacgaatgtgaccatgtaatttattttacaaaagggaatactttcaggtgtaaaaagaggcactcttcatattgacatcataatgataggtgaaaaccttggacaaatagttactgtaccttgaaatccacagaagtgtaaactagctaaagctacatttttgcacttttgtgccacagagacaaacaaatacagtatgggcttttccattcaatgtacttatgcagttcctgatgtgacattaactgtttcccaggagcttgtcaaacatccagtctattatttcaagccaaaacactaaattatacaattttgtaaattcctttttttcttagatgttttgtgtatcagtgatatttttagtaaatgtatacacaatgtttgctttccactttgagccactttttattaggttcacttgatttaatgtgttctgaccttagactgtcttttggttttcttgtagagcacagaaagcagggtgggttcaaaaaaagttaatactgtatatgcatggaagtctatcttcaaagtccctacaggggtcttattgaatgttagccatagggtgacacttaggcttacagttttagtcttttgcataaaaccaaaactttgcatacctttaatgtcatctaaatacagttctgctagtaatattccctcctgttatgtttctgttacacgtgaagggcaaccacagttttaaatgaagagaagctgaaagaatgcaaacggtttttatatttgatatttgacttaaaaatatctcaataaagttttacagttttattcaaagaagacttgcacatcttttgttaattttatttcacatattttatactactgaaaagtgtggccaggtgcagtggcttacacctgtaatctgaggactttgggatgctgaggcaggaggattgcttgagctcaggagactgacaccagattgggcaaaatagtgagaccctgttctctacaaaagtaaatgattgactgaatgtatgtatttatgtagctgtagttcaagctactccagatgctgaggtgggaggatcacttgagcccaggaggtagaggatgcagtgcatgttcatgccactgcaactccagcctgagtgacagagggagattttttcaagagtaaaggtatcatttctttaaattttgtatttcaaagttttgaaattttgaaaattgagttggtatacaagtgttggtatggtttggctgggtgtcaccacccaaatctcatgtttaattgttcccagtgtttggagagggacctggtgggaggtgattggatcatgggagtggatttcctccttgttgttctcctgacagtcagttagtactcaagggttggggctgaaagttccaaccctctaatggtttaaaagtgtgtggcacttctcgcttcatgctttctcctgcctccatttgaagaggtgcttgctttcccttcctccatgattgtaagcttcctgaggccttccaattatgcttgctgtcaagcctgtggaactgtgagtcaattaaaccttcatcagttccccagactcaggtagttctttatagcagtgtgaaaatggtctaatacaggtgtgattttgtgaaatgtgtatttggtccttgaccctgcttactggcatacagtttttaaaatgtttagaatctccaaaaaatgatatcttattgtatgctaattagttggctgatggctggcagcccctaagtagctctaggatgggggattagagggttgggactttcagccccacccctaaccttcagggaaatgagagggactcaaggttaacttggtcaaaaatggctagccattggtttcatcaatcatagctacataatgaaaacctccaaaaaacccaaaatgacagggttcagagagcttctggctagctgaacacaaagagggcagcatgcctgtagagggcatggaagctccttgcccctttccccattccttactctatgcatctctttatctgcatcctttctaatatcctgttttaataaacccataaacgtatgtgtttccctgagtcttgtgagatgctgtaggaaattaactgactgaacctgagtaggactcatggaaaactcaatttatagctggtgggtcagaaacacaggtgaaacaacctagggcttgtagtgagggaaatcttatgggactgagcccttaacctgtgcaatcttactctatgtcaaggtagcttgtgtcagaattgaatgagaggacacccagctggtgtgtgctgcaaaactcattgcttgtttggtgtgtgtagaaaagcccccacacatttgatcacaaaactcttccatgttaattgttgtgaggtaagaacagagaaaaaacttttttaatccattcaatggattcagtgtttgtttattggttttctatccagtaaccttgctaaatatacttattccaaatttatctctagatcctttctgaatttcaacttacacaatcatatcatctttgaataacaacagcttgtttctgacatttcaaacagtacgctttgtcctttttcctattttacaacattggacagacccacccaatagaatgctgaatagaaccagtaattgtggccatccttctcttatgcctaataggcactggaaagttttttttaacattttacaatgtttcctgtgttttttaatatagatacactttatcacaatagagagttccattgtattcctcatttcctaggagtatttatcttcaatagatgttgaatttcatcaagcacttgtagtgcatccacacagatgatcataggactttttcttttattaatctgttaacgtggtgaatttcattggtaagttgctatgtttaaacaaaccttgcctttctaggggaaaaaaatgggtcacaacatattatccttttttaataatctatgccttactaatttgtttaggatttttatgtatgtcctcataagtggcattagcctatatttttatttcatgtacagatgctccttaacttaccatgacattatgtcccaataaatccatcataaattgaaaattgtgtaagttgaagatgcattcagtacactaacttagcaaacattatagcttagcttagcctaccttaaaagtgcccattaccctacagttacagttacgttgacattaccctacagttgtgcattaccctacagttatattaccatacagttacagttacacttacattactctacagttgtgcaaaatcatctaacacaaagcctattttatcataacattgaatgtctcatgtaatttattgaatattttcctggagatgaaaaacacagtggttatatggctactcaaaaaactgtttccactgaacgcatttcattttcacactatcatgaagtcaagaaattttaaatggcggcatcaggagtcaggggccatctgtattctctttgttggactttggtatcaaggttacactggcttcatgaaatgaattgggatataaaacctctttctattctcaggaactgaaatgtctgcaagagtgaatcacttacagataggatttcccatgtgtgtttgtttgagattgcatatcttttttaactttggacactacttaaaagaaagacagaaggggcagctccagatttccatgcctttaaactttgtaaggcacctctcttccccacaaagatgcctctaatgatgatgtcactctgaaaacaatctgctcctgtttctgtactgacattatcctctgtacacagaaagttaaaaattgccactctattaatttgcttacataagttttttcagagatgtgttcttgctaagttgcccaggctgatcttgaactcttgagctcaagtgattctccctcctcagcctccaaaagtgcttggattacaggtgactgccaccgtggctggtctgtctacctgatgttgatctgtggtatgtgattgtgaatggattggctaaaccaaagctgtgaatagttaggacaatagctccatttatttagttctttaagaagaataggaataataactcacatttatagagtgttcagtatctgttagccagttttctgagctatgtttcattgtttctgacctcatttaatcctttaaaaaggggagtcagagttttcataaaatttacaacaaatgactctagtaagaagcaaatatgaggattcaagttctaagttcacagtctgtgttttctcaaagtaaatacttctgaaagtgttgaatacagaactagtgttgtatatgttgattttattggtaattgcatattttcatacacatctatggtaatatataaaatatatatatttttcatttttcaacataaaagattttggtcttatcttgaagaaggtgtttcccaaaatatggcacatagagctaacagacattaccagatgaaaccattggtacaaaaacatttttaaaaattaataataacatgcctattttactctgctacagaaaaatagaacactaaagccatttggaatagtttgtgggaacacagagagaagggatttctcagtccccatggaaaaatgccacaataacttctgcaaacgcttctgacctttctttaaaagttattaagaggcagggagggagaagcaccaagcctctttttccatctgcataaaactccatcaccctgacagtcaccacatctcattcagaagcccctggagctgcctggatccagcctgatatcccttttactgtaaataatacaccaattgcaactctgagctccatgtgtatcctcacacccaaaaagatatttttccaacaaaggtccctactcagaatccacagtgtttagggagtagcaggggattataatcagcaattatttctccctcttacagagattttaatgtatattctgatccaaaatgactgaaaagatagagttgaaaaaaaaagtgagactaagtgtaggggatcccatttgacataaaatatgtgagaagtcccaaggctgtaaggttggttgaaagaattagggtgtaggtagaagaaaggggagagcaaccaggggagcttgctaaggcaaaatgacttgggtcctagctaccctgtctccttatagggtatagcatgaaattggcatgggtttccatcgtggctctaacactcgggcttcaagatggtgggcaaggcacttataccctgtgggactatttccacatttctaaagtagaaattagaatatttacagtaaatgattgctatggagaataaatgaaataatatactaagtaggcattacattgcagataatgttgtttactagttatatatttttcttttacaatttattttttcatttgacttgtctttacagctacatctatagtaagtgataactgctttggaattgtaagaaaataccaaattgcattttaaaatgcatttgacctcccaagattatttgatttacataaatatgttcattaatgctgtcattagtatgtgctagtcagtagtatgtgctgcaaactgttctcctggatcagtgtgatttcacaaggaataagtcaatattctggtcaggcaacacaacacacacctcaatacaatagtgtgtaaagtgctcaagaaatccctaagcagccctgcggtggctaaaagggccacaggtatcaccattgcagttcttagtttgatttgtcatatatccatagatttggccagtaagaacaaaatgagcccaagtggatccaagtgattgattgcttgaaggcacagccaaagcaagatcagcattgtgtcagcactgtgtccctagtctcacagtatgacactgaattggaggtacaaaataacagcacaggtggtgggtctccttgcctgcgaggagcccacaaccataccctaaagccaatgctggaaccacactgaatactgagatcacgatcacacctgacagctgtgactatgggacagcaggggtgacccagctcctgaacattccatgtagaacacttagggatgtcatccaggcttgtgaagaggaggaacaagtgtcaatgaccaccctgaactgactgccttctgagagtcccactaaaaccaaagatgcaaatgaattatttggaccggacgaggaacccctagagggaaaggtcacacagtgggaggccacagtgggggccttggccagctcctgcctgacaactgtatgtcctgctggggggtgccctatcaagggtaaactcttggagtccaggggtatcacctatgccctctgagatttttcttacatgtgcgccctgactatcccttcactgcctcatccctggaaggcattcacatcagcttcagcttcctggccagagttgtgctgagcctgaaatggtggcttggcctggccaaaaaaaaagtttaatacagaatcttaggtaggaagtaatctgccttcctaaggtagacatccatcattaataggatttgtataagatggctgtgatgggaagtttgatatgtcaactttgctaggccacgatacacacaaaaaatgttcaccttgagcagagtagatgtctctgtgaaaggtattttttacatgagaactaacatttaaatcagcagactttgggtaagcttaattgccctccacaatgtggagtggccttcgtccaatcacttgaaggccttcagagaaaaagactggggtcctcctcaagatcaagaatttcaggctccatgctgcccttagatttgaggtatcatatcacctctgccttgggtctccagcctgacatcctgctctgcaaggtttgggtatgccagcacacagagttccatgagccagttcctcaaaatcaatcaatcaatcaatcaatctctctctttcttcccatgcacacacccacagaagaagcctaatcaataggctgcttacatctgggatccataaagggtgtaaccaagatcagtaatgcaggtaggtgtcactctcctacatggctcctaagacagaggtctctcccaccctctgcagactgacatccatgtggctcatcactgtgacactgggtttggtcatccaaccatgtagagatcactacaattccacaagtgttccctgccttctgcctgtcacattctatgctccatcctgaggacactgggatctactgtgtatgtttccaaccttccaggaaagacctgggagcctagtgagggagatacacctgcaaagagaacttcagtgcagtaatagcaatgggcatagccgatgttgttcaccaactcatgagacttcatactgtgaacatctcccacttaagtttccccatcaactaacaacttatcctggaaaagaccccattggtcagtaaattgaattcccctcactatttgccccagggatgcacagctacaaagcaaactgatactggtatattgtgacagagtggaatccaagaaaaaaatgccctgcagtgatgtgatttccacagcagtaaataagtctttatatgttcccagatgaagcaatatgcaagcctccctcagtttacaaggaagtgacatgtatggaaaatctagtttatgtaaaattctggaacaagacgtttgcctcacttaacactcagtccccaaatgccagtagctcctgccaattattccaacaacagcagcagcccacagatatttccaaaatgcctcaaagtgggcgatgatattctggctataaatcacaagtttaggattgaaaataagtatcctcaaacttcttatttacatcaaaagaataggaatgttgtggttggcacagaggaaataacacggcaccaggaaggagaacacaatgctccccaggaagggctgcaggaaccttcctcctatgtcttgttttctgtgataagaatgtgattccagaataggtgtggtggctcacatcagcctgggaacatagggagaccccgtctctacaaaaaattttataaaacatagccagggttggtggaacatgcctgtagtcctatgtactagggaggctgagatggaagcattgcttgagcttgaaagtgagccatgatttgtccactgcactccaagctgagcgacagaaagagatcctgtctcaattaaaacaacaaagaaagagagattgcagcactgactcggatggacagagcagtgtgtggaggctcacatcatgaatttttgctccagaacaactgcaggaataaattgggaaatctgagaggacccacagaccctctgaaggaagcggattgctcctgtaggacctgggagacatcccaaatactgtgagtgcccaaactgtggaagtgggaaagggagatcacccaaccctgagcacacactcccactggggaaactgaaggtctagattactgaagaagattctggccttacctggagctgagtcagtttagagagctaagcaaaatacaggagtagaggaagcagcagaaaaagccctgtgagtgtgctgtgttccctagcaagtcgtctctgcttggcctcacaagagtccttcaggagggcagccagaggcactgggaaaaggccacagaaagaaggaaatctccagctgaacttagtaacaatttgaactgatccaagtgtcctggccagaacttgggggagggtgtgaatccggtgtgcagattccataggcaggggaagaaggaaagccaacttactttcacagctaggaggcaggtagcctgggacaagttctcagccctgctcacccactgcctggaaacagacttggtgctgttgggtgggggacggtgggagtgagaccagcccttcagattgtgtgggaactgggtgaggcctgtgactgcaagctttccctgactcctctaacaacctgcgtgacacagtagagacagccataatcctcctaggaacatcacatcacaggatggttcacatcacaggactctgtgcagacaacccccagtaccagcgtagagcctggtagacttgctgggtgtcttgatccagaagagagataacaatcactacagatcagctctcaggaagccacatccataggaaggtgagagagtactacatcaagggaataccccgtggtacaaaagaatctgaacaacagccttcagtcctagaccctccctctgacagagccagcctaaatgagaaggaagcagaaaaccagctctggaaatatgacaaaacaaggctctttaacacaccccagaaatcaacctagctcaccagcaatggatccaaaccaagaagaaacccctgatttacctgaaaaagcattcaagaggctagttattaagctaatgaggcaggcaccagagaaaggcaaagcccaatgtaaggaaatccaaaaagtgatacaagaagtgaagggagaaatattcaatgaaatagatagcataaataaaaaacaatcaaaacttcaggaaacaatggacacacagaaatacaaaatgctttggaaagtctcagcagtagaattgaacaagtagaagaaagaaattcagagctcaaagacaaggtctttgaattaacccaatccaacaaagacaaagaaaaaagaataagaaaatatgaacaaagcctccaagaagtctgggattatgttaaatgaccaaacctaagaatagttggtgttcctgaggaagaagagaaatctaaaagtttggaaaacatatttgggggaaccatcgaggaaaagttccccagccttgctagagaactagacatccaaatacaagaagcacaaagaacacctgggaaatccatcacaaaaagatcaccgccaaggcatattgtcatcaggttatctaaagttaagacaaaggaaagaatcttaagagctgtgagaaaaaagtgccaagtaacctataaaggaaaacctatcagattaacaacagatttctcagcagaaagcctacaagctagaagagatcagggctctatcttcagcctcctcaaacaaaacaattatcagccaagaattttgtatccagagaaactaagcttcatatatgaaggaaaaatacagtctttttcagacaaacaaatgctgagataattcagcacgatcaagccaccactacaagaactactaaaaggaactctaaatcttgaaacaaatcctggaaacacatcagaacagaacctcttaaagcattaatctcacaggacttataaaacaaaaatacaatctaaaaaacaaaaacacaaaacaaaaaatcaaggtatacaggcaacgaatagcacaatgaatggaatgacacctcacatctcaatactaacgttgaatgtaaatggcccaaatactccacataaaagatacagaattgcacaatggataagaactcaccaaccaactatctgctgccttcaagagactcacctaatatagaaggactcgcacaaatttgaggtaaaggggtggaaaaagacatttcacacaaatggacaccaaaagtgagcaggggtagctattcttatatcagacaaaacaaactttaaagcaacagaagtttaaaaagacaaagagggacattatataatgataaaagaccttgtccaacaggaaaatatcacaatcataaacatgtatgcacctaacgctggagctcccaaatttataaaacaattagcaatagacctaagaaatgagatagacagcaacacagtaatggtgggggacttcaacactccactaacagcactagacaggtcattaagacagaaagtcaacaaagaaacaatggatttaagttataccctggaacaaatgttcttaaccaatacatacagaacattccatccaataactgcagaatacacattctattcaacagcacatggaacttgctccaagatagaccataggataggccacaaaatgagcctcaataaatttaaggaaattgaaattttatcaagcactgtctcaggccacagtggaataaaactgaaaatcaactccaaaaggaaccttcaaaatcatgcaaatacatggaaattaaataacttgctatgaatgatcattgggtcaaaaatgaaatcaagatggaaatttaaaaattcttcaaactgaacaacaataaagacacaacctatcaaaacccctgggatacagcaaaggcagtgctaagaggaaagttcgtagcctaaacacctccatccaagagtctgaaagagcacagacaatctaaggtcacacctcaaggaactagagaaacaagaacaaaccaaacccacacccaggagaagaaaggaaataaccaagatcagagcagaactaaatgaaattgaaacaaaaaaatacaaaagataaatgaaaaaaaatccggttctttgaaaagataaaattgatagaccattagcaagcttaaccaagaaaagaagagagaaaatcctaataagctcaataagaaatgaaactggagatattacaactgacatcacagaaatacaaaagatcatttaaggctattatgaacacctttacatgcataaactataaaaccttgaagagatggataagttcctggaaagatacaaccctactcacttaaatcaggaagaattagataccgtgaacagaccaataagaagcatcgagattgaaatggtaattaaaatattaccaacaacaaaagaaaaatccaggaccagaaggattcacagcagacttctaccagacattcaacgaattggtgccaatcctgctgacactattccacaagataaagagggaatcctccctaaatcattctatgaaaccagtatcatcctaataccaaaaccagaaagggacataaccaaaaaagaaaactgcagaccaatacccttatgaacatagatgctaggagaaatacctaatgtaaatgacgagttaatgggtgcagcaaaccaacatggcacatgtatacctatgtaacaaacctgcatgttgtgcacatgtaccctagaacttaaagtttaataataaaaaaatactagctaaccaaatccaacaacataccaaaaagatattccaccatgatcaagtgggtttcatagcagggatgcagggatggtttaacatatgcaagtcaataaatgtgatacaccacataaacagaataaaaaataaatatcacatgatcatctcaatagatgcagaaaaagcattgacaaaatcgagcatccctttatgattataactctcagaaaaatcggcatacaaaggacatactttaatgtaataaaagccattcatgaaaaacccacagccaacataatactgaatgggagaaagttgaaagcattccctctgagaactggaacaagacaaagatgcccactctcaccactcctcttcaacatagtactggaagtcctagccagagcaatgagagaagagaaagaaattaagggcatcaaaattggtaaagaggaagtcaaactgtcactgtatgctgttgatacgattgtttacatagaatacctaaagatttctccagaaagctcctagaactgataaaagaattcagcccaatttctggatacaaaattaatctacacaaatcatagctcttttatacaccaacagtgaccaagctgagaatcaaattaagaactcaaccccttttacaatagctgcaaaaaaataaaatacttaggaatatacctaaccaagaaggtaaaagacctctacaaggaaaactacaaaacactgttgaaagaaatcaaggatgacgaacaaatggaaacacatcccatgatcatagatgggtagaatccatattgtgaaaatgaccatactgccaaaagcaatctacaaattcaacgcaatttccatcaaaataccaccatcatgcttcacagaattagaaaaaaattctaaaattcatatggaaccaaaaaaggagcccatgtagccaaagcaagaacaagcaaaaagaacaaatctggaggcatcacatatctgatttcaaactatactataaggccatagtcaccaaaacagcataatactggtgtaaaaataggcacatagaccaatggaacagaatacaaaacccagaaataaacccaaatacttacagccaactgctcttcaacaaagcaaacaaaacataaagtggggaaagacacccttttcaacaaatggtgctgggataattggctagccacatgtaggagaatgaaactatatcctcatctctcaccttgtacaaaaatcagctgaagatggcttaaggacttaaatctaagacctgaaactataaacattttagaagataacattaaaaaaccctcctagacattggctaagggaaggatttcatgaccaagaacccaaaagcaaatgcaataaaaacaaagataaatagctgggacttaattaaactaaagagcttttgcatggcaaaaggaacagttggcagattaaacagacaacctatagagtgggagaaaatcttcatgatctatacatctgacaaaggactaatatccagaatctacaacaatctcaaacaaatcagcaagaaaaaatcgaacaatcccatcaaaaagtgggctaaggacatgaatagacaattctcaaaagaagatatacaaatggtcaacaaacatatgaaaaaatgatcattgttcgattcccacctatgagtgagaacatgcggtgtttggttttttgtccttgctatagcttgctgagaatgatggtttccagcttcacacaccggggcctgttgtggggtggggggaggggtgaggggtgagggatagcattaggaggtatacctaatgttaaatgacgagttaatgggtgcagcacactaacatggcacatgtatacatatgtaactaacctgcacgttgtgcacatgtaccctaaaacttaaagtataattaaaaaaaagaaaaaatgatcaacatcactaatgatcagggaaatgcaaatcaaaaccacaatatgataccaccttactcctgcaagaatggccataatttaaaaataaaaaaatagtagatgttggcatggatgcagtgaacagggaacacttctacactcctggtaggaatgtaaactaatacaaccactatagaaaacagtgtgcagattgcttaaaaaactaaaagtagaactaccatttgattcagcaatcccactactgggtatctacccagaggaaaagaagtcgttatatgaaaaagatacttgcacactcctgtttgtagcagcacgattcgcagttgcaaaaaaatgtggaaccaacccaaatgcccatcaatcgatgaataaagaaatatatatatgatggaatactactcagtcataaaaaggaatgaattaatggaattcataatgacctggatgaggttggagactattattctaagtgaagtaactcaggaatggaaaaataaatatcatatgttctcactcatgagtggaagctaagctatgaggatgcaaatgcataagaatgatagaatggactttgtggactcagggggaaaggatgggaaggaggtgaaggataaaagactacaaattgggtgcagtgtataatgcttgggtcatgggtgcaccaaaatctcacaaataaccacgaaagaacttactcatgtgaacaaacaccaccagtttcccaatattttttcattaaaaataaataaataaataaataacaaagtctttcaacctaaaaacaaagtgtttcagtgccagctggggtgtgtggtgaagcttcatttcaaagatcaaccactgccataggacattgacgctcagtatggttctgtggtagtcatggctctgggatcctgggactggtgtttttctcctcagcaaagacagccttctccaggctgggacacaggaggtaggggccaggctaggtcatcaggctactagggacagctgtttgctgtgggatcacagatgagatcaggagaaggatagctgaaaggagaagggagatgatctcctcaggtgaggtgcaggtaggtgtctgctagtgaagagaagacattggccctaagtcctggcattgctccagattcctgtggaaggacatgacagtgcaagaaagaaatcaaggctggtgggagggagatggtagattacatgacctcccatcctatgtgttcaatggttgctgataggagcccataccctttgggtatctaaaaggtcatttcttgacacccttccattcactgtgcatgacaagaagaggcctttgggaagaaagaccagtaggagttataaggtcttctcaaaagatgcactaccttacccttatggtgactcttacactgtgtccatcatgtcttgtgttcctgtgtgctctcaggtcggtcttctcaacctcacgtcagtcttgggaagagtgggtatattggaggcagtcatgaaaccaaagggatttaataaggtttctgaatgtttcctaggctgggcagtaaattcccagatcctaaggcaccactgtggccacactacatgagattcaccgggtgtgaatagtggaatctgcatttttaaaagatcctgggttaaaattttcatggaaatttgtctgagaactactggagcaggggaatagtctcctttccaagctacacagcttctttctcctttgtgaaggtatagaagggacaggtttggtgtgttctctgatggacgaacccacggccttcaggtgaggagactaaaactgacatgctgcctgttattctaatgatgctctcagggcctgtctccaaatcatacccagaccaatcctttcaagtctccatctcttaaatatttctgaagaaatcaaatgtctctagcctgtgcaatctcatactgtaaaattctaaatattttgcaatagcctttggatcttactcttggttacataaatatgcaacacagtagagtttttcatgacgcctctgacctgtggctccaccactcattgctgggtgacactgagaaacatccttaacatctctgtgactcctttctccattagtaccatggaaatactactagtaaagtcatctacttcttgggcagtttagaacactgactgttaagacatgtacagttgtcaggacagcgcctgccatatgataaatttccaatcaattctagctgttattgttttgctgtttatatcgttgttgttcccacatttccctggagcatgttccagagagacaacgtcaagagtacatttgaccctttggatgatcttttgattatcactttagcccttcagggactcaagaactgaagctaggtagcttgggggacagcttatttttataagcgtaatgaatattcagctctcctcacagggttattgtgaagcctaaatgcaatgctggggtttcatcatcatgaacttgtgtggaaaatttgaatggaaatttctctaggaaattagaactctaatgacctcttcatgcgatttgtatagcgcttggaaaagtaactagtgactggataaggatagtacataagtatataaatactaaaaagatcatgatttttctatttcatagtttgtgcatttcatatcctacctatcttagttttacatgatgctacagattctcctacgttttcgtctagcagtttgataacgttggcttttacatttagttctatgatgcattttaaggcaacttttgtatatgatgtgagacaaaggttgaggttcatttgtttgcatgtcaatttccaattgttccagcaccattccctgaataaatcattttttcccactgaattatcttggcaccctatagaaaaatcaatttaatctgaatatataggtctagatttggacccttatttcttttcttatgccattatcatgctgtcctgattaccatagttgtgaaaacgtcttgaaacaggtaatgagtcctccaatattctttgttctttataaaattgttagactattctagtccccttgcttttccacgtaaattttgaagtcagcttgccaatttcttaaaacaaaaggctgcatggaatttggttgggtttacactgaatgtatagattatttgagagaaactgacatttcacaatcttgcaatccattaacgtagcataccgctccatttgtttcagcctgctttaatatttctctgcagtgaggttgcagtgagccaagattgcgccactgcactccagcctgggtgacagagcgagactctgtctctctctctacatatatatatatatatatatatatatacacacacacatatttctccacagtgatttttaagcttctgagtactggtcttgcacatattttgttaaattttaccactaaatatttcttggggttttttgctgctatattaagtaatactgattttcaatttccaattgtttgttgctggtatataaaaatagcattgacttttgcatacttatcttgtgccatattactttgctaaactcatatatatatatatatatatatatatatatatatatatatatatatattcaagtcatggagtaaatcccatttggctacgatgttgtgtagaagtggcgttattagtattatttccctctgtgacactgccctagtgtcatcttgcaaatgttgatatattgttgatacaagagtggggcagggaagtgctgggaggagtagaggagggtccctggtgaaggctccatcctcgggcctgtgcccatggacctaggtgaggacaggcatttctattttcatgtcaaaacgttgcattttccaagaccaccctggcccaccatgctcccatcctgtgcctataaaagccccgagatcctaccaggcagagacacaggtggctggacatcgagaggaacacaccggcagaacacaccggcagaagaacacaacagcagacagcagcaaatgctggtaggccattgaatggctgagtgatgtggttgccgacaggaatttggccacagtggtcaaaggagagttcggccactgatcggcctgactccaggggaagaccaccttcccactccctccaccttctagctccccatcaatctgagagctacttccaccattcaataaaaccttgcactgattttccaagcccacgtgtgatgcgatttttccagttcactaaggcaagttccccaggatacagaaagccccctgttttatatatatatatatatatatatatatatatatatatatatatatatatatatatcctgatttttctctacattctttgtaccgattgctgggatgaatgttgaagtcttctactataaatgcacatgtgtctatttatttcttctttctgatgtatcagtttttccctcatgtattttgatggtgcatacatactcatggtgtttctgtcttctgaatcaatgcacctctctatgattattatgtaatgttccactttgtccattgtaataatctccactataaagtgtgttttgtgaggtattaattgagcacctccagtttctacgtgattcatatttgcagggtatatcttttaactgtttactttgaacttacttttaacatcctttacttttaacttctttatttttaaactgtggttctttttaacagcatataatttgttcttgctctttttatccattcttacaatctctaacgttttacatttgagacagggtctcgctctgtcacccaagctggagtacagtcatgtgatcgtagctcactgcagcctcaacctcctgggctcaagctatcttcccacctcagctcccccaggagctggaactacaggtgtgcaccaccatgcctgcctcatttttaatatttgtagagacagggtctgactatgttgccctggctggtatggccttggcctctcgaagtgctgggattagaggcatgagccactgggcccggccaaactctgacttttaatagacaagtgtaagcaaattaaatttaatgtggaaccagtttacctttaaattaccaacttgctttatatttttatttatcatatctgttttttattcaggtttttctgtttcctcccttctcttagacgagttgaacattttatactacaccatgttaatctccactattggcttattagttacatatctttgttttctagggattgctctatggattactacatgcatctttaagtaacagtaagccttcaaataatattactccactacatgtacaggatgtagtggcgtaatatttgtttacatttgtttttcttccctgtgcttttgggatcatatccaaaaaatcgctgcccagaccaatgtcatggagttgtcttcttgtgttttcttctagtagtttcatagattcgggtcttacattataagattttaattcatcttaagtttacctttacatatggtaagagatgatggtagaatttcattcttctgtatgtggatatacagttttcctgataccacttattgaaggctgctcttctctcactctgtgtttttgataactttgtcaaaaatcaattggctgtaagtgcatggatttttttctgggcttgatgagtcttcattactattttatttattgatgctgaacataatgacaaataaattcactataataaatctaacaaatctgactttcgtagttaaactccactcaaaaacacaaacgtgagttttgtatgtttgactagtacttccattcctggtgaggttcaacaagagatgaactttctgagcttcagtaactacttcctaccttgcaagataattgcaagaatgaaataaatgacagtgacaatagtagtaaagatctcacaggatataagtaccttgtctaccatctcaaggcctgtatgtcagagccatgatggaaacccatggttattttgtgccataaggggacaatgtagctaggacccaaataattttgcttcagcaagttgtggtggttgctttcccctttcttctacctagggcctaattcttcatctggctctgtagcctagggacttctcacatattccatggcaaatgggatcccctacatttagtctcactttttatttgaaccctagcttttcagtccttttggatccaaaaatgttttaaaatctttgtaacagggagaaataattgctgtgtatattcttctgcccctccctaagcagcgtggattctgagtagggcccattgttggagaattatccttttgggtgtgaggatataaatggagctcagggttgttagtcgtgtattatgtacaagaagaggcatattaggctggatccaggcagctgcaggggcttctgattgagatgtggtgactgtcaggctcagaagaaaaagaaaggtttggtgtttctccctctctgccttgtatcatttaaagaaaggacatgtttgcaggagatgttgtggcatttttccatggggattgagacatcagttcttttctccatcccacaaactatttcaaaagaatttagtattcttattatattttttctgttgcacagtaaaacaggtatgttattattaatttttaaaatgctttcataacaatgatttcatctgggaacccgtgttaggtttatgttccacattttgacaaatacttcgagagaacaacaaatccttttatgttaaacaataaaatatatgtattttatatattaccatggatttacatgaaaacatcagattaccactaaagtcaatatacacaacaccagttctgcattcaacactttcagaagcatttactttcaggaagcacaaagactgtgaacttagaccttgaatccccatatctgcttcttactagagtcatttattgtaaattttatgaaaactctggctcacctttttagtggatttaataatgaggtcagaaataatgaaacacagctcagataaccggttaacagatactagacaatctataaatatgagttattatttccattaaagaactcaataaatgcagttatcatcctaactattcacagctttggtgtagtcaatccattcaaaaacatacaccacagatcaaaatcaggtaggcaggccaggcaaggtggctgtcacctgtaatcccagcacttttggaggatgaggagggagaattgcttgagtccaagagttcaagatcagcctgggcaacttagcaagaatgtatctccgaaaaaacttacgtaagcaaattaatagagtggcaacttttaactggctgtatacagaggttaatgtcagtacagaaacaggagcaggtagttttcagagtgacggcataattagaggcatctttgtagggaagagaggcaccttacaaagtttaaaggcatggaaacctggagctgccccttctatctttcttttaagtagtgtccaaagctgaaacaaaacaaaacaaaacaaaacaaaaagacctgcaatctggaaacaaacacacatgggaaaccctatctccaagtgattcattcttgcagggatttcagttccagagcatagaaagaggttttatatcccaattcatttcatgaagctagtgtaaccttgataccaaagtccaacaaagagaatacagatggcgcccacttatgattctgcttcttggttatactcagaagaaaatgctttaatatttgatgattcaatatagctttgacccaatttgtgtctccatctggtggtgtttaaatcttgcagttaggcatctgtggtctgaactaactttcaaagtaagtctgcatttgaactctgctttctgtttttaaaggggcagtaatgttctctctttgtattatcaaaattataatattgtggaaaacagaaagcacataattttgcatcttaatggacagcataccgccttctggcattttaaattgatctgattttggcagaatcttcccctggacatcggactatctccccattcatcccccgtctttgactgagacagctccttgagatcagcttccaggtcaggcactaagaaatattaaagggtatcaattgaagcaggcaaacaagaatgataaataaggaaattataatattgtttttctcagtgttaggaaataaaatcctgtaggctattgtggtaataaatgtgatgcaaagatctcatgtctttgttttcctatattatgaaatcttattttaaatgacaatctgagggtaaatcacactacacctccatttcctatactttaccattgtgtattataaacagtgagtatcagatatctaggaaatctgaagcctgctgcatggatagcattttaatcataaattaaatgtaactttctgaaggattagatcaatgtagtggcaggtttatgacaaatcttatagccctgacatccatcccctgtttaggtaacttgaaaattttggggtaaaaattagtgaaagttatgcttaggtccaaaggccccatatataactttttttcccactttttttttattattattatactttaagttttagggtacatgtgcacaatgtgcaggtttgttacatatgtatacatgtgccatgctggtgtgctgtacccactaactcgtcatctagcattaggtatatctcccaatgctatccctcccccctcctccccacccaacaacagtccccagagtgtgatgttccccttcctgtgtccatgtgttctcattgttcaattcccacctatgagtgagaatatgcggtgtttggttttttatccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcaccacactgacttccacaagggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcgtttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcgcatttgtcaattttggcttttgttgccattgcttttggtgttttagacatgaagcccttgcccatgcctatgtcctgaatggtaatgcctaggttttcttctagggtttttatggttttaggtctaacatttaagtctttaatccatcttgaattgatttttgtgtaaggtgtaaggaagggatccaaaagtaccaaatataacatcaaaatcactgtcttcagtgagagtatgggaacctgagggcaaacaaattaatgggcattgttgacagtcatattctggaaaccttttaacagtgaattgctaaaataatccatggcccaaatttggtcagtatttagcttgaaaatgctaccctttgaggaaataatttctgtttcatgacaatcttattatactttaaactgtctaattataaaagtattgaagcaacttttaaaagtcccttaaaaaccatactaatatagccaatatagtaatatacctgtatgccagtatcctgaattatccagcttttcccaaacatactgtaaaaaatattgatcgaagggaacagtggctgtttcctttggtcagtattcttttgattgagctcgtttctggagttgctatcctgtatcactgaactgtgccttttcctgagccaatactgaagtaccttacaggagaagcacattcgagtattaagcattttaagcaaaatcagtcatgttttctaataacatagacagtaggacaaatacaaactttgaaatgtaatttgaattctttgtccgtgagtcaagggttcttggtaagcctcaatctctaagcctcagttttcttatttataaagtggggctaacatccctatgcaaatgggctttattcatggtgttacagggtagggttacttggcactctacatgctattaaagggtgcttacaacaccattgacaccatggctgagataatcatacaacaacattctaagaacatcaaattaaactagtgaaataatgtacatttgtatatataaaattaaatggtttcatctgatttagcaaggactgtatttttaagcatgcaaaataaacctcaaaaaaagagagaagattcgttgcatccagggacttcatgaagctgcaaactacactcttcacttttccagccacatttcagcaagtgtttgagaaccttttctaatgttttctttcttctgttactgtttatggcataatgcatgatgcacatataggcctcctctgcccccaccgccaccatagacattctttctttcccttcccagcacctttaatctcagcagcaccctgatcttcttctctctcctgaccatgtgtaggatcttgactttcagtgggtggtttctcttcttgaggttcttcatcactgggctgctgggacgaggggtgtgtgtttatgcagattagaaagttctgttatcaatatatgtcaataatataaatgtacagaatacatatttttcatcataagtctaaagacatttctccaacactattccatatccttattcttcataaagttactcttcccacagggaggtcatactctaagacagttaccttcaagggctttggaagccattttaatttatgttgggaggaatgtgtgtaatctgttatgaataaacatggggaggaaatcatgggtgaaatctggggaacacaagatcattcatccacacaaaaccagaatgtaatcctcttgggcttgcctttccttcatgagatgccatgatcatttttcagcagcagacctttattagtatatgtacgctagttcaacaagactatcacaaatagaaatttctgctaacagaaaacatggaatgttaaggcactaatgagcataagcccaatcagtccaggaaactgtaaacttcctcttggtctaggcttatatgttgatcttccttgccaactcatatttcattctgcaaacagaatactgtgattgggaaagtgcacttgagaggattgctgtatttgaccacttccatcgccatatgtaaacttgtaattttattaaaatttggaaatactttgaaagtaagtcccaggacaagtttaagtgtgtgtgccttctgaatcgaatgcttgcaaagccacttaaggtggtcaagttagcagtgtcttaaggctcctggcaaaagacacagggtatttctgatgaggtttagtttcacaactggactttccatagtggagacatataggaaaatacagctacagaattcaaattggagtgaacacagctttcgttacacatctgttagctaggcccattttccctctaaaatcaagttttgttgaaatgcacaacccagcccattcgaacatccatgggggagttgaagttgccacacagcactggccactcctcactggacacctatgtgggcactctacagacctcggggcctgggtcaccagcccacagcattcccacttcccaggcctgttccttcccacccaccctgccccttcctggttccccaccgaggagtctggaatctgtcttctactggggtttccaggggcttccaggactcagatacctccaacattaccttcagcactcgccccatcttcacctgagctacctccactctgtggtccaccttactcatgacgtcgaaggctttcacctgctgaggccagggactaggctgcctgaagctcaggaagtctgctggcttctcctcacattcactcacactacacctcctggggggactggccttcgcacctaccagctgtgtctcagtagaggagagagtctagaccacaggaccgccaccctcccaccctcacagctccacggcattcaccatgtggtcgaaggggccgactggaccatgcccagtgaacatgcccactgaggtacaaggagcatgtgcagtgagatgggtgcctgccttgtaggctgtggtaccctgcctcactgcattctccacttcctccaaggtatccactaaggactctggaatccatcctttttgggcagttagttccatatgctctaaggattcaaatacctcaaatagtgtcccccttcataactcactgtatgctcaccaggccctcctcccctctatggccctccttcttcccttatccggcacccccaagcagtgcatcgctgcctgttaggaggacaacaacctcaaggcccttctgcctaggaggctatagactgtgcccgcgggctcctcctcacactcactcacactgaaacttctgggacaactgatctgacagcagggcacatgggcaacaaggggtgtacacacagagtcaggcacatgcagggccagccagggttttcccgctgtccccagacccacatccacaggctatttctagtagaaagaaaatgacttaagagatctttttttttctctcttgccaaaccattctcagggggcccatggaaacatcgccacatgaacctcactgtccaggaagcttctttcacaacatagaccatggaaaaccctggcaggtataatttccacaagcatttgaacaacaggcactcccatctcttctgctctcccttgtatggctactgctagaatcttgataaatacccgtcccaggatcccttgcagagggtggtgtgccacagcttcccaggtgatgctaataatatgcacctcttaaaagatttgggaagtagaagtcattttcttatttcaccccaaaatggtcaaaggtgtgtatggtcaatacgggaatgtttgggcaggtgtgaatggtgaatctgaaaatgcttgggaggtgtgaatggtaaatggaatgtttgggcaggtgtgaatggcgaacatgagaatgcttaagcaggtgtgaatggtgaatgtgggaacgtttgggcaggtgtgaatggtgaatgctggaatattttggcaggtgtgaatggtgaatgtgtgagtgtttgcagtggcttcaggattctcctactaatcatctgtctcaggacttcaaggggcagataggtttggcagacgtctcctgcagttgcctgaacaggcatatttcactgtactccaaatctagtatgatttccatgataactgtgtattttatgagacttgattattcttccatactatttttttactgatgctgaacacatataatttaataacaagtgacttcatgataagaaatttccaatactataatactctcacaaaatacctcattcaaatcgaggaggggttttggcatttagtgagagtaatatggtattggaaacaggatgagagtgaaagtgagaagtaattctctcttggtcatgaattcaggttttgaagttctctcatcactgctcagttgctcagatatagacatcattacatggttattacattagtagaagaagcaggagtgctagcttataaaatagatacaataatacctccacaagggcactaaaagtatttctatctgtttgttaaggctgccatcaaaaactaccacagactgggtggcttaaacaacagacatgtattttctcacaattctggaggctacacgtctgagatcaaggtgtcagcagaattggtttcttctaaggcctccctccttgccttgtagtctgctgttttctcccggtgtccgccttagtcctccctctgtacatgtgtgtgtcatcatttcctcttcttataagggcaccaggcaaattgccttaggaccactctaatgaccccatttcacttaattacctctttaaagaccacacctatctcaaatatagttacattctgtggcactaggggttcagacttcaccatatgaattttgagcagacacaactcagcctatatggtactaaagacagtattaaaataaggctgggcgtggtatgaattttgagcagagacaactcagcctataacagtatgactgttagttttatattaacactgtttatttttgagacatagtgattcattcagaggacagaagcaatctgctgggaattatcagaggttcccaaacccagtctacccgtgtctgccctggcattctctgttgcccttctacatacaatgctcttaactgaagccagcccctcacctcagctcaggatccataccccccaccttcccaggggctttgctcctacagtgatcactcccctctcctgaaccatcaatggctccctctacattggatcattcccaaagctaagggggaactcaccttcttctcccatgtccttctgtagctactaacatgtttatctgctgcccttcaaaggaaaactgcctcaacttatacaactaacttcactggagtaaattttcaaagttacctagaaaggaaaatgagccagaacagccaaaaccattctgaagtataactttggggaactcacactacctaatatcaagagtcatgttaattctatagtaatcaagagaatgtggtattggggaaaaatcaacagatcagcaggaagtccagtaatggactcacagacatgataaactgattttcagaaaaggcacaaaggcaatggagaaattatcttttcgagaaactgtcttgttttactcctgctacttggccaccacattcattgtttttatccccctgggtcccttccctgtgtttctcctttgcacttcagctgctcttctgtttaagggtcttctgtaaaggtgccctcctccccccaccaacagtgtgacagcctccacagcaagtaccacatattgttggttggtcttctcatttccagcatccaagacatttcctataacatggcagtcatcaatgcatatctgttgaattaaattatcagtcttttgtaatgaccctaacagaaaagcatcccctctatttaggagtcattattggagatggtatgtttctaggcaccttacatatggttttgtgtcagacactatagggcaaaggctctgccatggtgtcttggagatcttgcaggtcaccacataggacacgtaggcaaagccagactgcaggctaacctgaatgttggaagaatacctggattccttttgttgcaaggggagataggcagcgtggtgggagctgccacaggtattttctcaccagctccctatctggttggaggttgacacgagaccattctttatccattttcctagtttccattaagcacgggcctttcctcatcttagggtacaactgtggagtataaaactgctcactgtcttagggtacagctgtgggctcctcacaggcagagagacccaccgtctgtgctgtcattgtatacctccgattcagtgtcatactgtgggactagggacacagtgctgacacaatgctgaccttgcttttactttgcctgcaatcaatcaaccatttggacccatttgggctcattgtcttcttattggtcaaatctatggatgtgtgacaagccaaactaacaacggcagtggggctccttgctgccgttagccactacaggtgtactgcttgaacacttgacacactattgtgttgtgtggtgttggctgaccagaaggacttattcttcacggcatcacacacagcaaagggcacagtgttcggcacattccattgacttagggttggccttgtcagactgcgtttattcacaaaccaactttagaattgatgtcatgtctgacaccagctaccctggtttttaattaatatatttatttaaattaagtaagtctcagaagtcaaattcatttaaaaaggtaacttgatacccctacttgaaatttaagagcagttattacttactaaacatgtggttgtaaaggcaaagggaatgaaaaaaattgaaattttaaaagaagaaatataataaaccaaatttatctacagtgtattgcctaatccatatgttatttcatttattcttcataacaagtatttagtgtaaatattctaattcctactttagaaatggggacattgcctcacagattataatatcttgcccaccccctcaaggccagtgtgtaagaggcaggatggaatcccatgggtatttcatgccatagcctataaggagacagtgtaggtaggacccgtcatcttgcttcagcaagttgccctggttccttgccgcttactcctacctaggccctaattctttcatctagctccatagcctagggacttctcacatattttgtggcaaatggaacacccttagaaaagatgcagatgaggggacacatagggtgaggtatgcagggaggggcagggagtttccatggcctctacgggcatgctaccctccatgtgttcagctagccagaagctctctgaaccgtgtccttttgggtttcatggaggttttcattatgtaggcatgactgattaaaatgttggcttgccattggtgaacaacttaaccttcagccccaaccttccctgaagtttgggcatggggctgaaagtcccaaccctctaattcctcatcctagagctcctagggactgccagacattggtcaactcactagcatacaaaaagacatcactttataggagttgtatgccagtaagcacagtcaatgaccaaatatacatttcaccataccacacttgtgtatcagctaactcagaatacaaaatatcaaaaatgatacttttttttgaaacagagtcttgctctgtcatggaggttggagttgcaagtggcgtgaacatgactaccagcatcctcgaccacctgggctcaagggatcctcccacctatgcctccagagtagctgagactatagttgcattcattcattcactcattgtagtagagaggggttcctatattccccagactggtgtcactttcctgagctctagcaatcctcctacctcagcatcccaaggtactgggattacaggtgtgagccattacacctggccacaattctcaatagtatcaaaatacctgggaatgaaattaacagaagaggctgggcacggtggctcatgcctgtaatcccagcactttgggagaccaaggcaggcagatcacgaggtcaggagattgagaccatcctggccaacatggtgaaaccccatctctactaaaaatacaaaaattagccaggtgtggtggaacgtgcctgtagtcccagctactcaggagtctgaggcaggagaattgcttgaacccaggaggcaaaggttgcagtgagccaatatcatgccactgcactccagcctggcgacagagcaaaattccatctagaaaaaaaaaaaaaagaaagaaaaaaagaaattaacagaagatgtgcaagacttctttggagaaaagcttaaaactttattaagatattttaaagtaaaatatctaatataaaaacagtttgtgttgtttcagcttatcttcctttaaacctgtgatttcccttcacctgtaatagaaacataacaggtggaacattactagcagaactgtatttagatcacattaagatatgcaaatgacaccaaagtttttgtttcgtacagtggactaagaccataaacccaagagtcaccctctggcttacattcaattagacctctgtggagactttggagataaacttccaaacatatacattattaatattttttaaacacaccctgctttctagtgctacaaggaaaccaaaagacagtccgaggtcagaacacattaaatcaagtgaaactcttaaaaagggatttaatgtataaagcaaaaattgtgtataattttactaaaaatataacaaatacacacaaaaaaactaagaaacaaaggaatttataaaaaatgtacaatttaatattttggcttgaaactatggtctggatgtcaaataggctcctggaaatagtatgaaaactatcttttaagaaaagagttaatgtcacattagaagctgcatatgcgtggtgaatagaaaggacagtattgcatttgttttttcctctattgtgccaaagtgcaaaaatgttgctttgggttagtttacccttctgtagatattaaggtatggtaaacatctgtccccagttttcacctatagtcctgatgttaatacaaatatctctttttacacttgaaaaaattcccctttgtataattaattatatgatcgcattacttttaatctatcattatcattattgatatcaaaatatgaaagaggtatatatcatgaacagtatggcacgaaaaaaaagaaacggaaagggaaatggagatgtagaggaagacatctagaataactaaatatttatttctaaaagtaaatattatcaagggacaactagcaaatttcacaagttcatgcacagtctttgtgatgaatagatattcaggtactactgggatatatttaataatgcatgcattcctagcttatcaaccatttcatctatattccgaaaatattagagtttaagaacgtattcactttcagctgggcgtggtggctcacatctgtaatcccagcactttgggaggccaaggcaagtggatcacccgaggtcaggagttcgagaacagcttgtccaacatggcgaaacctcgtctctactaaaaatacaaaaaatagccaggcatggtggtgcatgcctgtactcctagctactcagctgaggcaggagaatcacttgaacctgggaagtggaggttgcagtcagccaagatcatgctgctgcactccagcctgggtgacagagcgagactctgtctcaaaagtaaaacaaaagaaaacaaaagaatgtatttactttcagttatactacatattcaatatctgtgtcttcttcatattctgtattgtgcttttcccattttcttcaagactggagaaacaaatagatagtctattcatagctatttttaaaataaacaatgtgttaaatgtattacttttggattagttttcctaatccaaaatccaggttcctacctgtctgttattaagtacctctttccttttccattaggtttattctgttgctcttttattattatattgattattactttatcatgtaatttgctatctattctaataagatgtgcatttaaggctgtgatcttcctaagaatacaactgaggcttgttcaatcggctcctgaaaactatcttttaatgtaaatagtttaatggaatggttcagcagtgcagagtaaaacatttaggtaatttcttccctaaacatggagttcttcctttaaattcagaagctcttctcattaacagtcagcaatttataaaaaaaaatgtgtaaaagatacttatgttgactactcaagaattagtacattatagtctttgaactttaagtcctatcatctgatgtctcaaggcagaaacctgtaatatgtaacctatgatatggttagaggtgattatatcatgtgtgtctttattacacacagtagctcatgaagactgacaggagagcaaaaagcatgcttagcacaggcatcttacacccaccttgagcatgactgacctacatgcattctccctacttcattggccacagaaagtagactgtctcttgccattttattattcagtcattcaaggcttcacggtgggaaggctttaaaatacaattattctttaaaagccagataattcagaatttgacaaaatccaagaacactcattcaagtctccatgctggaaaacaaacatcaagcagagtgcctgctcattttcttaggagcaatgaaatctcagctcagatattgtaattggactgaagctgattgttaggaaaaacaaatcatgggaatcagaatatctttctattctctccaacagaaccagagcatgcagaaatcagcattgaaacggattttaatacatttgatctgcattcaccattttcaataacagcaaagatgggtgtagaatttatggaatttgtccagattctcacaaattgtcatagagctgctactagaatctccttcagtactcagcatatttcacacagtctggtattacaaatgcattatgtatttgttaaaagcagaaattagaaaagaatctgaaaattgttagctgttggttatactcagaagtaagaaaatgctgtcatatttgatgattcaatatggctttgacccaatttgtgtctgtatctgagagcatttaagtcttgcagtcaggcattgggatctgaagtacctttcaaagaaagtgtgtatttgaacactgttattaaagtggcagtaatattatctctctatgatcaaaagtataatattgtaaaaaatagaaatcacataactttgtgtcttaatgaataacacacctgcttctggcattttaaagtgctctgcttttggtagaatcttccccttgacatcagtaccaccttcacatccatccccagtctttgtctgacatagctcctggagatcggcttccaggtcaggcactaaaaaatacaaaggttattgaacttgagtacaaaaacatgaagtataaataaggaagtaataatattctattccacagagttatgacataaaagcctgtaggctagtgtgataataaatgtgatgcaaagctgtcacacttttgttttcctgtattatgaattcctattttatttgttttttaatacagggtttcactctgtcatccaggctggagtacaggggtgcagtcacaggtgactgcagccctgacctcctgagctcaagttatccccctgtctcagccttgtgagaggctgagactataggcacatgccaccaccaaggctaatttttgtatttttttggcagagaaaattttctggtgtttccccatgtttcccaggctagttcctaactctcaggctcaagggacccaccagcctcggccttccaaagtgctgggattacaggtgtgagccaatgtacctggcctgaaatctaatataaaatgacaatctaaggataaatcacactacaccttcatttcctatactttgccagtgtgcattataaacagtgagtatcaactatgtaagatatctgaagtttgctgcatgaatagcattttaataataactcaaagataattttctgaaagactagatcaatgtattcctgggcttatgacaaaaacttacaattgtgacaaccatatcttgctgaggtaatttgaaaattatttggttaaaattaattaaaattatgcttaggtccaaaggccctaaatgtaacttttcataaataaatcctattgagaatatagtaccaaaaataagaggaaaaaaagtcacagttttcccatgagaattcaggaaattgagtgaaagaaagtaatgagtgttgttgacagtcatattctggaaacctcttaaccgtgaactgctaaaataatccatggtccaaattccgtcaactttagcttgaaaatgctatctgttgaggacacaatttctgtttcatgataattgtatcatactttgagttttctaattataaaagtatttaggcaacttttaaaagttccttaaaaagcatactaatatacctacctgtatgccagtgtcctgaactatccaccttttaccaaacatactgtcaaaaaatactgatcaaagggaacagtggctgtcattcattgagcccttttccggatttgctatcctgcttcactgaatttgttttctcctgagccaatactcaagtaccttacagtacagacacattcgagtattaagcgttttaagcaaaataattcacgttttctaataacgtagatgttaggaagaacacagaccttggaacgtaatatgaattctgcctccatgactcaagcgttcttggtaagcctctatctctgagcaaccatttcctttttataaaatagggctaatatccctatgcaaatgggctttattcagggtgttataaggtagggtgacttggcactctatatgctataaaagggtgcttataacactgtggacaccatggctgagccaatcatacagcaacattctaagaagatcaaattaatcaagtgaaataatgtacattttgatacatcaaattaaacagtttcatctgatttagcaagggatgtattttcaagcatacaaaataaatcttgaaaaaaagagaagatttattatatccagggactgcatgaagctgcaaactatactcttcacttttccagcctactttgagcaagtgcttgagatcctttcctaatgttttctttcctcctattactggtcatggcataaggcatgatggacacataggcctccttccccctataggcattatttctttcctttcccagcaccttgaatctcagctgcaccctgatcatcttctctcttctgatcaggtgtaggattccgacttttagtgggtggtttctcttctttaggctcttcatcagtgggttcctgggacaaaggggaggcagtatgtgtgcagataaaaagttttgttagtaatacatgtcaataatacaaatatacagaatacacaggtatttctaatcacaagtaagtctaaagacacttctccaacactgttccacatacttattcttcacaaagttactcttcccaaagagaggttactctaagacagttaccctcaaaggctttggaaaccattttaatctatgttgggttggatgtgtgcaatctgttatcagtaagcatgaggaggaagtcatgatggggaacacaagattatccatgaaggcaaaatcagattgtaatactcttggattagtctttccttcatgagatgcatgatcatttttatcaacatggaagacctttatcagtgtatctatactagttcaacaacactatcacaaaagaaatttctgctaataaaaaacatcaaaatattaaagcactcacaagcatagccccaatcagctcaggaggctgtaaacttcttcttggcctaggcctatatgttgatcttcctcgccaactcatatttcactctgcaaacagaatactgtgattgggaaagtgtgtttgagaggatagctgtatttgaccactttcatggccaaatgttaaatttcagtttttaaaaaagtttggaaataatttgaaagtaagtcccagggcaactagaagtgtgtacatcttctgaatcgaatgcttgcatagccacttaagttgggcaatctagcagagcaatgtcttaatgctcctggcaaaagatacaggatatttctgatgagatttggtttcacagttggattctccatagtggagacatttaagtttatacagctagagaattaaaactgcagtgaccacggctttcgtcacacacccatttgtttggacgatttccctccctaaaatcaaggttttgttggaaagcacagtcccgcccattcgaacctccagggtggagttgagaagttgtgacacatcactggacgctcctcgctggacatttctacccggagctctacagacctcggggtcgcggtcaccagctcatagcattcccacttcccaggcccctttcttaccgcttacacagcccattcctgggtccctaccaagaagtctggaatctgtcccattgggagttccaggcactttcgggactcagatacctccaacagcaccccgagcattcaccctatcttcatctggctccccttcactccgcggcccaccttccttatgacctggaagctttttactctctgaggccacagaccacgccgcctgaccctctggaagcccgctcactcctcctcacattcactcacatttcagttcctgggaggactggcctgcggacctataggctgcgtctcagtaggagagaaagagtccagacggctggaacgtgcccctcacactctcacagctccccagcggtcaccacgtgggcaaaggggtcgaagggaagatgcccagtgaacatgcacactgaggcaggtgtccaaggaacatgcacactgaagtcggtgcctgcgttgtgtgctgcagtgccccgcctcgccccaccccatcccgcgtcatgcagtcctccctcccctccctggttcccactgaggactctggaatgcatcgtctgtaagcagtttcatatgcctcgcggactcaaataccacaaatagtttcccccttcaaaactcactgcttgtttacctgaccctcctcccatctatggtccttctccctcccttgtccggcacccccaccacagcaaggccatggctgcatcgctgcgtgttagaaggacggggacctcaaagcccttccacctaggaggccatggatcgtgcccgcaggctcctcctcacactcactcacactcaaacttctaggactactgaactgcagacctactggctgactcctagtcggcaagacagaaggaagtcacgatgtctctttgcacagctctgctgggacagaaggcagacagtaaggcgcatgggcaacaagggacttgggcagtaaggggcgttcacactgagtcaggcacatgcaaggccagccagggttttcccactgtcccaaaaccagaatccccagtatgtttgtagtagaaagaaagggacttaagagatatttttttttctctctctcttgtcctaccattctcatgcatccagaaactttgggaacagagagtcccatgtcacccttagtggttgatgtgtctcagaaagaccttttgtgacagaaataaattattttaatgtttatatttatacatgctttttttttccagacagggtgttactttgtcgccctggatggagggcaatggcatgactttacctcactgcagcctggatctcctgggcataagcaatactcaagacgcagcctccgaagtagttgggactacaggtgtgtgccaccatgcccagctattttatttatttatttacttagagacagaatctcactacattgtccaggctggtctcaatttctgggatcgagtgatcctcccaccttggccaatttttattcatactttgattaatcacttccttctctggtctgaggttttctgccatgctaccaatgaatagaaccacttctgtagactaaataaattcacacctcttccttttttaggtggtattattgcacattttaatctctggactggtaactgatttccctgaatatacctgtaggtcattcagacagtgtatggttcagaaatatccatacatatgatgtggtttgactctgtccccacccaaatctctccttgaattgtagttcccataatccccacatgtcatggaaaggaccctgtgggaggtaatgtaatcatggggtggttaccttcatgctgttcccctgatagtgagtaagttttcacaagatctaatggttttataaggggcttttccccttttgctcactcttctctctcctgctgccatgtgaagaaggatgtgtttgcttccacttcttccatgattgttaagtttccagaggcctccccagccctgcagaactatgagtcaattaaacctctttcctttataaattacccactctcaggtatgtccttatagcagcatgagaacggactaatacaacattggtcctaggatttaaacttagtttattgtgacatgatgtacagcagtggtgactgtgctcatcatatactctactccccaaatagcagccaaataacctgttcataagacagcgctgacattatttaaataaagctataaggtagagcactacctccacagaggcactagtatgtcagatgtggaagggctttgggtatatttgttgtgcttttcatgtccggtataaagtgggtattttaaagtgggggatggtttggttagaattgggtaggaatgacaatgatttaggattggtggatgcaacaagactttttaggcaatgggttcaaagagttttgggattgaaaaatgtcatttgacactttttattgaggagttgatggatctttcaggcaattgctggaaagaacaataaagtttttttgaaacttttattttccttggtaagagattcctgtattagtaaaattatgataatgaagacagtggaatataaactcttgttaatgtagacagtaaactatgtccatgactcctgttcttattacttttatattacctagcagttaatgtggggaatagtatatggaagggaaggataggaagggagccctgatcagaatgtagccttttataaataaattaggatatattgttgaactgacatctatatattctatctagttgagcttctttttttttttcttttgagacggagtctcactctattatccagactggagtgcagtggcatgatctttggctaactgcaatatctgccccccagattcaagtgattctcctgcttcaggctcgcaagtagctgggattataggcacgtgccaatacacccagctaatttttgtatttttagtagagacggagtttcaccatgtgggccaggctggtctcgaactcctgacctcaagtgatccgcccacctcggcctcccaaagtgctgggattacaggtgtgagccaccgtgcctggccacagctgcactccttttaaggaaataccctgagtaggaaaaaagagattcctcaatctctgtctccaaaaagtggcttgagtagtcattgtagttctcaaagtttatttaaggagtgagggcactcataaactattatttagtttatctgttatcttttttgttttttcttggcaaggacattgtcattactaaattttacttgcatttttcccttattaactccggtttttagtatagtgcactcagaaatgttcaaagaatgagagatagtgacatctgggtttagattttctgtgagcatcgaattagcaaatggtcaaagtcatgccatcagatggctggatggatgtgcttcacaaggacctggattttaatgattcctgagtggacacactccagcttcaaagggcaggttttaacttcctcccaaatttgagcttcctcctgttattcccatggcaggtgaccctggtccagctggatgagttcaaaggatcataattggattgggatgggagcaagttgtgaagtagcccttgtgacactcacaggaagcagcagaaagtatgagaaactctttagaggcaagaagacttgcctgatacatgacgctagcaactctgagggctgctaaaggagaagttggagctgggaccaacacagcccatctacctgtgggtgggctcaatttcaccacatgacaagaccttcccatcctccaagcactggaatatgaacaaactgagatttccacaggactgtggctgggtgggacaaagtctacagattctgagcagctggcagttttcagagtaccatagtaaacactgtcacctgagctcttcagattgcttgttggttgaggtcaaattatttactacctaccatgttaattgcaactcccctatttgcctcataaagcgggagcacaaaagggaaatggaggtccctgtgcattcacagggaggtccgcgtgaatggatgcaattcatgacattcagctatgctgcagcccaaacaaagcctcctcatgataccaagaggacaagaggtcacatgtactttctgtcccttttgcatgtgattttatgtctgtccaagtaacacttcacctgtgcaaaacagacatggttatctgctgatggaacacacatttcctctgtaattacatatttcgtggtagcctttgtggcccatatcaaagaccacgtttttggccaagtgcagttgcacacacctgtattcccagcaatttgggaggccgagaagggtggatcacttgaggtcaggaattcgagatcagcctggccaacattgtgaaaccccatctctactaaaaatacaaaagttggccaggtgaggtagtgcagtcctgtaatcccagctactcggcaggctaaggtgggagaatcgcttgaacctgggaggcagaggttgcagtgagccaagactggggtgacagagggagactctgtctcaaaacaaaaaaaaaaaaaacaaacaaaaacgaccattttttttctgaaaagactgaattccgaaggaggaagacaacattgggttctcatgtgtcttttcatatacttctataataacacttattaaccattgaggatatcttgtgaaaaggctttaatcttttccatactggtttgtcatccatagtggttcataagattaacgttgtcctccacaaacagcattttgaagaaatgagataaaataaattagtaaatagcattcactgcatatagaatattcaaacagactgcacacacacatacacatacatatatttatttccctactgaattatatacaaactatgtatttcccatgaattgtaatttaaaaagtttgaaggtcattactttagaagttattggacaaaatgtctagggacaatttctttagccattgatgaggatgatagattaagacttgctaagagcaagttcactgttgtctgtagctttctacataatgcttgaaatagctctgagtgatgtttaaatttgtcagttttactgtgagcatttgactctcagcaaactcacttgtggactcatgagttggtgagaaggaaggctgatgagttgtggggctttacttcccaccatgtctttctgcagctgcagggtgtgttcatgtgtgtgcttctgcactcgtgtgatggtgctttgatatgttcccttttatttccccctttattattgattgtgtcttatggttcctattatgtactttattggcatccagtgacagcaacatctgtggtattcagttttgatccattttacatgtattcaaagatattttcaagcacgaatatttattcttaaaaacttttccttacataattggaggagttcaatgcaattaaatatcagtatttgatgttagatcttattgggcaataatcctgctaaatttttaatcatactaattcctgttacacctgagcttttatgtcgccataatgcttagataaatgacacattgactatgacaaagatgaaagatttttaacaaatcaacttgagaaatatgcaatcatggaatatttggaagcgttctcctcttataactgatgcaagacaggtgagcccagatttggagcttagcccaggagggttcttggctttgcccaggagagaattcaagtgtgagctggtggtgttagacagcaatacttttattgaacagtacttctcctttccaagtagggctaagtcacaggcagtgagccagaagtcagcaacctatgggctcttggcaactgtatttatactcgtttatacctactttaaattatgagtcagtttaacgcaaattgaggggtgggttatttagaactttctaggaaaagggtgccagcttctgtgtcattgccatggaaagtggtagtaactaacttctgggtggttgccatggaaaggggtggtaacttctggaatgctgccatgtcgtgtaaactgtcatgagtctgttttatgctgataagcaatgaatgcagctagggattgctcttatcgccatctgctgcttcatgcgggtttcttcacttcatcctctcgggaccaggaattaagtcctgcgtttcttctacttcaaaactacagagggaatgtagtgttttctttctcattaaaatcaggtatccctttaattattggcatatttctcattgcatacagtcattcaaagtttgcattttatacaaagtcttgtcctaaatcttctattcagcttcactttcagcttaggatgtttaggaagaccaagtagccaaatttgatgccaacaagatttccgggatccctgtactaggtgtgatccttatcattcttatgtgaccatcatatctaatcaatgacacatcatcagtactataagcaagccataacacttggagttgtggttatcatgtgagcatttgctttcaatgataggtaatatttttagatgtaactctgaataaaaatctatttatatgctaaatatgttgctatactgctactccgtgaaagtacaaatgtatatttgtcataagtagagtagcattctgaaataattaatgatgattataaaaactcctaatattatgtttagaaacaaagaaaaaggtttcaaatgattagttgggaaatagattgacagttccataaaatattaagagagcgaatgcgagtttgaaaatatttggaagaatgttatgtgctttttaagtggaccaatgtttctaaaatgtatgcatgataacataaatatgtctttacattaatataaattattttaaacataattaaaaacattcttttgtatcttgagtttttcatgttgcttgttgaaaaattataaaacagaaaattataaacaaaaaaatttcagcaatgggtgatttataaaaatacccattttactgcatcattatgaaaaacatccattgggtatttcttgttttttcaaaaataattaagggttttctaatttgactgagaaaatttaatgtcatttttactttattttttattctcagattactagaaagtgtgtaagtgatcatatatctttgtaatttgaactgtttgggttctaattttctactttatttttatatttacttttattatttccactgagctttaatttttttttcatttcaagggtttttttttttgttttcttttttgagacaggatctcactttatcacccagtctggggctcaccatgtaaacatgactcactgcaccttatacctccagggcttaatcttcctgtctctgctccccaagtagctgggacaacaggtgcacaccaccacgctcggctaatttttgtatagctagggtttcaccatgttgcctagactggtctcgaactactgagctaaagcaatccacgcccctcaccctcccaaagtgttgggattacaggcgtgagccaccgcgcccggcccatttcaagacttttgtgtgtgtgtacaaagaatatttacactgtcatattatataaagaataatttttctgtttatatattgttttaaggttgttgatggctttcattatttttttcttttttaagaaatgtttcattaataaataataattatatatatatttatggggtacaatatgatgttttgatatatgtgtacaatttaagagatgagtaaattataaaagactggatagaagtgcaacaaattgtttaccacagagtggtgaaattgtggatgttagttttgattctgctattccatattttataattttctaaaaaaaccatctactactttttaatcagaaaagaaataatatttaacatcaagaaaattaatattaagtttctttacagagtatacaaccacaaatctttgatgaaataaatagtaatgtgctatcttgagtacattttcttggtaaagacaattttcctttttaggtatcatttggtgggtggaggatagagagtaccttggattctgattttgcttggttaaagttaatggaatgtagctttttgtgccagaaagaaggctatgatatttgctgtaatagcatgtcctgacatctatcccatctttatctttattcgttttatcactgcagtgaaggcaaggaatcatggtgttcagtcagcagacaagaaacaaaagttcatcactctgaatgctcaaggatatctctgcttttcagagtagccacttaggagtctgtcatctgtaaatgtgccttagtctcttccaaatatatttatattttctcatctatcattatgtacatggggttcagaagttggctatttttatataactctttttgtgcaaaacttacataggttggctcctttactaactcccaaacttctccactatcatgactatggagccagtcccttttctgtgaaagcaacatcaatgacattgattcttctactaatgggttctctggtttaactattacaacaacctgaaggaaccaaaaacctgtggcatgtgtcttagtgggcactgagctaagagatgaaagaaattccctcttatttttttctaccttatactcattgaatatcacatttaaaagaaatttctaaaattaaaattggaataaaaacattataaaactggcattggctacactatgcaactccaagcagttaacaattgtgagaaactttctccccaaaaaagtgaaaattacctttttactttgctgtttttaatagcaaaggtgcgtttctgtagtcccagctactcaggaggctgaggtgggaagatcacttgagtttagaaggtcgaaactgcagttagccttgatcatatgacatagattgagaccttatttcaaaacaaaagcaggacaaaacaaggcaaaagatctgaatagatatttctcagaagaagatatacaaagggccaagaggtatatgaaaaaatgctcaacatcactaatcatcagggaaatccaaatgaagaccaccaatgagatctcatctcacacccgttagagtgcctattatcaaaaggatgaaagttctggtgagaaaatggaacacttgtacattattactgggaaaagaatatggaggttccccctcaaaattgctagcccactactggatatatatccaaaggacatgaaatcagtatgttgaaaagttatctgcactcccatgtttatgaagcattatttacaacagccaaggtatgaaactgctgcaggacaagtgagcctcaatattgtggcttaatctaggatgattcttgacttcacccaggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaatttctttaattggtataaacactatatatgtcatctatttctttggggggaatgaggtttgctagctagtgtccttcaaggaatcttcccactccatttaaaaaataatattttggatagtgcttttcaccatgttccctatcatatatttaatatctgaatgatttgtattgatgtgccctctggcgctactgatatctgtgatttgtattctctctccacttctctcatcagtctgtctaaaggtttattaatttgactgttcctcccaaacaagcgacttctggtttcactgatttttttaatagattttttcatttctatttaatttatttctattcatatctttattaatttttccttcttgttgttttgggtataatttgattttatttttccagtttcttattttatttatttgtttaggttttttttttttttcatagacagtctggcactgtcacctagactggagtgcagtggcacgaccttagctcactgcaacctccacctactgggctcaagagattctcctgcctcagccactatgcccagctaattttttttttttttttttttttttgagacagagtctcactccttcacccaggctggagtgcaatggcacgatcttggctcactgcaacctccgcctcctcagttcaagcgattttgctgcctcagccacttgagtagctgggattacaggtgcgtgcccccacacccagctaatttttgtatttttagtagagccagggtttcaccatgttggtcaggctggtcttgaactcctgaccttgtgatctgcctgcctcggcctaccaaagtactgggattacaggcgtgagccaccatgcccggccaactgtttttctagtttcttaatgtggaagcttaggtaattgacttgagacatttcttcctttctgatataagtattgaatgctataaatttccctctgtgcactgctttactgtgttatcttgcattttttgataggctgtgttttcattttcaaattttctctacaatttattctttcatccctgcgttacttaaaagtgtcgtttaatttccaatatttcagggattccgtatatctttctacaactaatttctatttcaattcttttgtggtcacaaaacatgttttgtaagatttcattcctttagaatttgttgagatttgttttttggcccataaataaggtctatctcggtgaacattccatgtgcacttgtgaagaatgtatattctgttgttgttctataaataacaattaggccgagttggttgataccattgttcaagccttctgcatatatatatatatatatcctgattttcttgtacactgtttctaccaattgctgagagaaatgttgaaatctcctactataagtgcagatgtgtttgtatcttctttctcatgtatgggtgttcccctcatgtattttgaatataatatgatatataattaaatacacctaatgtatttaattattttttcagatgcagggtgttactgtgttgctcaggctgctttcaaacacatgggctcaagtgattttcccattttggccaatttttatacatgctttgattaatcacttccttatctggttctgggttttcaaccatgtgtacaatgaatttaactacttctgtagactcaatcaattcacacctctacccttttttttaggttgtgttattacacatttaaatctctcgactggtaactaatttccctgaatacctataaggtgatcatgggctcagcagtcagtgtgatttcaacgttggctcacaacagcttggaaagcctgcatgggaagtattgcttgaggaaaagtggagagtttccaggaacagttttgaaaaacaaagacaaccgatgtcatccttccctcccttgcctctcctcatgtgccaggttttctgtttcctccagctgatagaaaatcagcatgaagtattctgtgatgaaaagtttttatccctttaatcatcccgtttcttcctccaaaccttttattctttctggaagggtggtatgcagaaggaacaaaagcattttcagaaaaacacattataatataaatttagtgaaaagattcatcatgtttaagaaatggtcaggatgaaatcctgaatttgtaaaaattgtaaaaatcagtttacataacctccatcccttttgtctctatcacttatccagtgagaagtgtagaaaagatgaattccttatttgtggctgctgcgttgagtagccaaactgctggccaccttccatcaatatcatatatccagatgtaatagccacaaaatgcaaggcctgtttaaaactttccctgatttcatccatctcattgaaatttccatcaaactcctagcagtaaattcagcattcaaagagttacaagtactgtggctaagagagatcctggctcaaatgttgggagggggctgtagcagtgggcgcccagctgaagacaaggctggaatgtgtcttcacaaccccccccaccctttttcagacaggatttctctctgttgcccaggctggagtacactggaggactcacaactcactacgacatgaaactcctgagctaaagtgatcctcctgccttaccttcctgaatagatgggactacaggcatgtgtcaccatgcccagctaattttttaaattgtgtagagcaagagtctcactatgctgtccaggctggtcttgaactcctggcctcaagtgattctcctgcctcagcctccaataatgctggaattcctggtgtgagccagtgcatgcagccacttttacccgccttttaaaatctaaggcttaagggttttctgaggctttgctccaacccaggaagctgataattttcctcccacttggatgaaagagcaattcaaatgttcaggatttttggcctgtgcaaagctctttggcaattattgagtcctttgtctacctgcctgcaggagaaaacaaaaattaacattagcatgaggctgcacctttcccccatatattatctggagcagaacagtggttaagggatccagggatccagctctcttgcagttggagggactattgttaaatgctgtgagtacatgtatttttcataatagacaacagcttcggctgctgcttcatattatgggtaaatccatggtctcccaggcatgacagcttcatcatgtctaccccttcactcttcctttattcaaacaaggctttcaccatattgtatgcagttcctaatgtgacattaactgatttctccaaagatacttttcagggtatttccaggagcctattaggcatccagaccgtagtttgaagccaaaacattaaaagcaagtttacagaaaaagtacacattatttgtaaattcctttagtttcttaggtattttgtgtggtgctgatattttgagtaaaactatgcacatgttcggaccttggactatcttttggtttccttgcaggactagaaagcagggtgtgttttaaaaatgtttttaatgcatatgcttggatgtttatcgtcgaagtctctacagaggtctacctcaatgtaagcaaaagggtgactcttagacttctggtttttgtccactgtataaaactaagattttggtgtccttcccatatctttaatttcatctgaatataattcccctagtaatgttcccaacttttatgtttctattataggagaaaggcaaccacagttttaaacgaagacaagctgaaacaacacaaactggttttatattagagatatttgaattaaaaatatttcaataaagttttgcaactttcaccaaaaaagtcttgcacatcttttgttcattttattcccaggtatttgatactattgaaaactgtggcttgatgtggtagctcaagcctctaatcccagcactttgggatgctgaggcaggaggactgattgagcacaggagatgagaccaacctggccaacagaaagagacccccttttttaaaaaataaaagaataaatacatgaatgtatgcatatatgtatgtagctgtagtcccaggtactctggagactaaggtgggaatgtatgcatatatgtatgtagctgtagtcccagctaatctggaggttaaggtgggacctcttgggcccccaagaggtccaggatgtggttaaattattttggaatggagactcaatttcaaaaaaaattaagaatcatttttgaaattttgtattgtgattgagctggtatgcacaggtgtgatattgtgaaacacatatttggttctagaccctgcttccaggcatacaacgcctacaatttttagaatctccacaaagtggtgtctttttgtatgctagtgaattgactgatggctagcagcacctaggtagctctaggttggggaagaagagagttgggcctttcagccccacccacaaccttcagggaagggacaagggctgaaggttaagttgatcacaaatggcgggccaacagtttaatcaatgacacctacataatgaaaaccgaaaaggacatggttcagagagcttccctctagctgaacacatggagggcagcttgcgcatagagggcatggaagctccctgccccttcccccgtacctcaccttatgtgtctcctcatctgcttcctttgttacgatatccaatttgccacaaaatatgtaagaagttcctaggctgtagaactggatggaagaattagggcttaggtagaagaaaggggaaagcaaccagagcaacttgctgaagcaagatgacttgggtcctacctacactgtctctttagaggctatggcatgaattagccatgggtttccatcctgcctcccacacactggccttgagatggtgggcaagatacttgcaatatttgggaccatttcctcatttctaaagtagaaattacaatagttacactaattacttgctatgaagaatcaatgaaataacataccaagtaggcattgctttgcagttaaatttggtttactagatttccttgtttcctttaagatttcaaactttttccttccatatttctttaaaactacatctcttgtatgtgatatctgcttttgaatttcaagtaggaatgtcaagttaccttttaaaatgcatttgacttcacaaaattatttgatttcaatgaatatgttaatgaattagcagtgtagctggtgtcagacacgggatcgattctaaagtggatttctaaaaaactgaggtgtgacaaggccaaacctaagtcaattgtccgtgcagaaaacttgtttgctgtgtgcgatgccatgaagaataaatcaatattctgggcatgcaatgccacacaactcaatacagtagtgtgtcaagtgctcaagcagtccctaagcagccctggccacaaggatcaccactgcagttgttagtttgccgtgtaacatattcatagatttggtcaataaggagataatgagcccaaatggatccaagtagttgattgtttgcagacacaacaaaagcaagagcagcattgtgtaggcaccgtgtccctagtcccataatacaacactgaatagcaggtactcagtgacagacagcacagatggtgggtctctctgcctgtgaggagctcacagccataccctaaagcagtgagcagttttataacaagttaggataacagctgtaccctaagttgtggaaaaggcctgtggttttctgaaactagagcaatggatgaaaatggactccaatgaagtgaagttgtataagttcatgaagttttgctgtgaagggcagcagataaatgtgttagtagctacagaaggacatgggggaataaggtgagttcctccttagcttggggaataatccagtatagagggagccgttgatggttcaggggcagaagtgatcattgcaggatcaaagcccctgggaaagtggaagttatgtgatcctgagctgaggtgaggggctggcttcagtcaggagcaattgcatgcagaagggccgcagagaatgccagaacagcacaggtagactgggtttgggaagctctaagagttcccagcagattgcttctgtcttctgaatgaatcattaggagaggtcattcaaatggaggagggttcctggcattttgtgagagtattgtagtagtggaagtaggaagagcatgaaagggagaaaattctctcgtggtcatggacttaaggtaaaataattcagaaggttttgaagttttcttatcactgctcagttgctcagatacaggcatcattatgcggtcattaaattagtaggaggagcagtagtgctagttcataaaatagatatgataatgctcacctcctgaggggcactaaaaggatttttattcgtttgttagggctgccatcaataactaccaccgactgggtggcttaaacaacagaaatgtattttctcacaattctggaggctacatgtctgagatcaaggtgtcagcagagttggtttcttctaaggcgtccttccttgccttgtagtcagctgttttctccctgtgtctgccttagtcctccctctgtacgtgtgtctgtgtcctcatttcctcttcttataagggcactgggcaaattgccttagggcccagtctaatgacctaatttctcttaattacctctttaaagaccccacctatgtcacatacagttacattcttaggcactaggggttaagacttcgccatatgaattttgagcagacacaattcagcccataatagtattgctgttagctttatcttaataccgttttttatttctgagacagggtctcattctgttgcccaggttggagcgcagtgatgttaatgtgggttactgcagcctgcaactcctgggctccaggggatcctgccatgtcaccctccctattagctggtagtacaggcatgtaacagcacaccaggctaatggtttaattttttttttttttttgacatgggacatcccactatttttcccaggctggtctggaactcctgtgctcaagtgatccttctgcctcggcctcccaaagtgctgggattacaagcatgaaccaacaagcccagccttattttaatactatcttcactactattgtcactatcatttattttattcttacaattacctggaaaggtaggaagtagtcactgaagctcacaaagttcatctattgctgaacctcaccaggaaaggaagtactagtcaaacagacaaacctcatgtgttttcaagtggagtgtaactgagaaagtcagatttgttagatttcttatcatgaatttatttgttattgttaaattttacatgctcagcatcagtaaagaaaagagtaatgaaaaatcattaagcccagagataaatccacacacttacgctctattgatttttgacaaagatgccaagcacagacagtggggggagggcagctttcaataaatggtattggagaaattgtacatccacacgcagatgaatgaaatttgaccctcatctctcaccatatacaaatcataaacagagggaggctggtatgttgcttcatctgggaacttataaagatttattgactgctttggaaaattacatcactgcagggcattccattcctggattctgctctgacacaacagtccaatatcagtttactttgtcgttgtgcatgcctgggggaaagaatgatgggaatccaacttccctaccaacatgaccttttccaggatcagcttcactgtattccttgtttttaaaaaattaagtgttttctactttgatggagaaaattttaatctcaattttgccttatttttcattctaaaattactagattgcataattatttccatagctttgtactttgaattgttttagtactaattttttattttattgtgttatttattcatcttgttacttatgtagtgctttaaatttatttttcacttcaagagtttttttgtctgtgtgaagaatatcaactctacatattatataaagactaatttttctgtatatatattgttcgaaggttgttgacttactattttttcttttttaaaacctgtttaattaacaactattatatgtatttatggggtacaatgtgatgttttgatatatgtatacaacttaagagttgcatcagttataaaaggtactggatagaagtgcaacacattgtttacctcagactggagaaattgtggttgttagtgtttattctgctattccatattttacaagtttctataaaaagcatctactacttttttaatcagaaaagaaatattattttacatcaggaaaatcaatattaaattccctcagagagaatatactatcacaaatctttgataaaataaatagcagtgtgctatcttgaatacattttcttggcctattagctggggttctctagagggtcagaactaataagagatatatatatatatagctcctatatatatatgtatatatatatatctcctatatatgtgtgtgcgtatatatgtacatacacatatgtatccacatatatacatatatatacatatatatatatgagtttattaagtattaactcacaagatcacaaggtcccacaataggccatctgcaagtggaggagcaaggaaagccagtctgagtcccaaaactgaagaacttggagtccaatgttcaagggcaggaagattccagcatgagagaaaggtgtaggctgggaggctagactgctctagccttttcacatttttctgcctgctttatattctagccgcactgacaactgattaggtggtacccacccagattaagggtgggtctgcctttcccagcccacttactcaaatgttaatctcctttggcaacaccctcacagacacacccaggatcaataattttcatccttcaatccaatcaacttgacactcactattaaggtcacacttggttatgtcagttttcctttttaggtatcatttaggggtggaggatagagaggaccttagtttccatttttcttggtgaaagttaatgaatgctgctttctgtgaaagaaagaaggctacaatatttgctgtaatagtatttcacgacatcaataccatctttatctttatttctttcatcattacagcaaagggaaataatcatggtgctcagtcatcagacaagaagcaaaagtccatcaatgtgaatgccagaggatatctttgcttcttagagtagccgtttagcagtctgtcatctgtaaatttaccttagcctcttccaaatatttcctcatctatcatcatttaggggttcagaaagtggctattttcgtattttttttgtccaaaacttacttaggttggctcctttactaactcccaatcttctccactataatgactctggaaccagtccctttgctgtgaaagcagcatcaacaacattgattcttctacctcagacccactggataacataattaatgaaatttttaaacttaaaattggaatgaaaacaccatagaattagcaatggctaaattatgtaactccaagcagttaacaattaagagaaactttgtccctcaaaaagtgaacattactttcttctttttgatttttctcagaattttttctgaactgaaaatgtaacaaattcataaaggccaaacacaggcaaattttctattttttaatttttaatttttatgagtacatagtaaggtgtatatatttatggggtatatgagatattttgaaacaggcatacaatgcataataatcccatcagggcaaatgaggaatctatcccctcatgtactttgatttttaatccaaaatgttaattctgcctttaagtttttttctttttttagcatccatttttttttaagacagtctcactctactgcctgggctggagttcagtggcgcaatcagctcactgaaacatctgcctcccacgctcaagtaattctcctgcctcagcctcctgagtagctgggattacaggcacttgcctccagtcctggataatttttgtatttttagtagagacgaggtttcaccattttggccaggctgatctcgaactcttgacctcaagtggcctgcctgcctcggcctcccaaagtgctgggattacaggtgtgagccaccgtgcccagccagcatccatctttttaatgactattttagtcttaaaaacaataaatttctccggacgcaattcctttgaaaaaaattatgacaacattaaattgaattatgcaattttaaaaattataatgataaatttacatgtctctgggctgggtttgatggttcacacttgtttttgttttgttttgttttgatggttcacactggtaatcccagttcccatgggaggtcgaggtaggaggatcacttgtgcccaggagctcaaggctacagtgaagtagcaacacaccactgcagtgcagcctatgtgacaaagccagaccctgtctcaaaaacaaagaaagaaaaactttaattaatttatatgtgtccttaaccaaattgcatatcctttgagggaagaggctattgagcatccttttgcctccccgtaacttctaacacctaaacttataatgatggatcaattctccaaaggaaagaatatagagcaaagctaaggaatacatgaaaactgacagagagaagcaaggacaataaaattgaggaatataaatccggaaagagaactgaagtattatggcatccccaaaatagacatgtgacccaaaggaacagaatagagagcccagaagtaaatccatgcacttacggtcaattggtttttgacagaggtgccaagaacacacagtaagggaagggcagccttcaataaattgtatttggaaaatgatatatccacatgcagaggactgaaattccatcctcatctctcaccatatacaaaagtcaacttaaaatgaattaacattgtataatgtaagacctgaatctatgaaactactagaagaaaacatagggagaaagctccatgacgctggtctgggcaattagtttttggatataatccccaaagtgcagggaacaaaagcaaaagtaaacgaatgagattatctcaaactcagaaacttctgcagagcaaaggaaacaatcaacagtgtgcaaagacaacctatggaatgagagaatacatttgcaaaccatacatctgagaaggggtgaagacctaaaatatataaggaactcaacagtaagaaaacaaataatctgattaaaacctgagcaaaaagcccggcacagtggctcacacctgtactcccagcactttgggaggccaggtcagaggattgcttgaggccaggagtttgagaccagtcctggcaacatagtgagaccttgattctacaaaaaaataaaaataaattagctggggtaacaaggcagccatgggaactgataccaagggtggctagtctctctgaggggagatgagacacacaaactgcatcacctctggcagagcacatgtggaagaagtgacagtcataagaggggataagaaggaagtaattgaaaatgtaacaaattcataaaggccaaacacaggcaattgggagagctggaatcccagaaagtctcagacacaagtggaatccacattcacttgccagctttttcctgcacaccaccatctggcattcatgaggaagactggaggaatccacggaggcctgggggcatcttcgttggcaagaaaccctgattgcttcgaaaaccttgtccctttaaaaaaaaaatcattgtgtatatttgaggtttacaacatgatggtatgggttacataaagatagtaatgtggctaatgtagtgaaggaaattaacctattatatcatctcacagtgacttttgtgtgacaagaacagctaaaatctacttatttaatcaaagtgcctaatataatagcaacaatcttcatgttgtaccttagctctctagacttgttcatcctacatacctgctactttgtatccttggaccttcatctccccatttcctcctctatcctcccctgtccctgatcaccaccaatttattctctatctccctattgcttgctctttcttctatctccctattgcttgccctttctttctttctttttctctctttctttcttcttccttcctttccttctttctttccttctttctttccttttttccctttctcattctctttctttctccccccacctttctttctgattccacacataagtgagatcatacagtacttttctttctatacatgtgccatgttggtgtgctgcacccattaggtatatctcctaatgctatccctccccgctcccccgaccccacaacagtcgccggtgtgtgatgttccccttcctgtgtccatgtgttctcattgttcaattcccacctatgagtaagaacatgcaatatttggttttttgtccttgtgatagtttgctgagaatgatggtttccagcttcatccatgtccctacaaaggacatgaactcatcattttttatggctgcatagtattccatggtgtatatttgccacattttcttaatccagtctatcgttgttggacatttgggttggttccaagtctttgctattatgaatagtgccgcaataaacatatgtgtgtgtgtgtctttgtagcagcataatttataatcctttgggtatatacccagtaatgggatgggtgggtcaaatggtatttctagttctagatccctgaggaatcgccacactgacttccacaacggttaaaccagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccacttgttgatggggttgtttgtttttttcctgtaaatttgtttgagttcattgtagattctggatattagccctttgtcagatgagtagattgcaaaaattttctcccattttgtaggttgcctgtttactctgatggtggtttcttttgctgtgcagaagctcttgagtttaattagatcccatttgtcaattttggcttttgttgccattgcttttggtgttttagacatgaagtccttgcccatgcctatgtcctgaatggtattgcctaggttttcttccaggatttttatgtttttaggtctaacatttaagtctttaatccatcttgaattgatttttgtataagttgtaaggaagggatccagtttcagctttctacatatggctagccagttttcccagcaccatttattaaatagggagtcctttcctcattgcttgtttttgtcaggtttgtcaaagaccagacagttgtggatatgtggcattatttctgagggctctgttctgttccattggtctatatctctgttttggtaagagtaccatgctgttttggttactgtatccttgtagtatagtttgaagtcaggtagtgtgatgcccccagctttgttcttttggcttaggattgacttggcaatgcgggctcttttttagttccatatgaactttaaagtagttttttccaattctgtgaagaaaatcattggtagcttgatggggatggcattgaatctctaaattaccttgggcagtatggccattttcatgacattgattcttcctacccatgagcatggaatgttcttccatttgtttgtatcctcttttatttcattgagcaatggtttgtagttctccctgaagaggtccttcacgtcccttgtaagttggattcctaggtattttattctctttgaagcaactgtgaatagttcactcatgatttggctctctgtttgtctgttattgttgtataagaatgcttgtgatgtttgcacattgattttgtatcttgagactgctgaagttgcttatcagcttaaggagattttgggctgagacgatggggttttctagatatacaatcatgtcatctgcaaacagggacaatttgacttcctcttttcctaattgaataccctttatgtctttctgccgcctgattgccctggccagaacttccaacactatgttgaataggagtggtgagagagggcatccctgtcttgtgccagttttcaaagggaatgcttccagtttttgtccattcagtatgatattggctgtgggtttgtcatttggcactttttactgaacagtggataggccttttaagcagttcctagaatcaataataaagttatgttcaacttttatcttcccaggcaagagattcttgtagtaataatgttatgttaatgaagccagtggaatagtaaactcttgttcatataggcagtaagctgtgtgtgtggtttcagttctcattacttacttttagataacttatgagcgtggtaggtcatataggaaagggaaggagaggaagggggccttgattagctagttgctttttgttagtaaatgaggacatatgtgtgtgtgtgtgtgtgtgtacatatatcctattcatacataataattgtacatatttacagggtacagtgagatattttgatacacatacacaacttgtaatgatcaaatcaggataatcagcatatccaccacctcaaacatttagcatttctttgtgttggaaatgttcaaaatcctcttttatagctatttgaaaatatacaatagattattgttaactatagtcaccctacagtgctaaatagacgactagagattattcctcctatttagtcttaattttgtatccattagctaaactctacctgttcatctcccacccttcccagagtctactattctctattctgctctctacatctatgaaataaaagcttttagcttccacatatcaatgagaatattcagtatttatctttctgtgtctggcttatttcacttaatgtcctccaggctcacacatctgaagcccatacatgttgcctcaaatgatgggatttcattcttttatatgactgaatagtattccattgtgtatacatacaccaatgtaaattagattgtattttgtttacttatttcttttttattgatacattgttgtacatatttatggggtacatgtgacactttgatatatgtatacaaaggacaatgactaaatcagggtatttaggatatccatcacctcaaacatttatcatttatttgtgctgggaacatttcaaatcttcccttctagccattttgaaatatatgataatttattgttaccattagtcaccctactgtgctatcaaatagaagttattccttttacttaattgtatgtacccattaaccaacttcgcttcatcccacccaccccctgttcccagcctctggtcaccaaaattctactccattagatcaaaatttttagctcccacatatgacagacaacatgtctcgaactcctgagttaaagcgatcctcctgcctctgctttccaaagtgttgagattatacatgtgaaccaccgatcacagcttctgttttcttttaagatgtacattaaactcacatttgtgagttttctccttcagtcagaagaggaacactgactctttcatctgccccttggaggtaaatttttctttttaaataaactatgactccattgaaattcttatttcaaccaagtttatgaagcactgtctcatttaaattatcagggctatattatgcgaagatttagaagatttgaagctcctccaaccccaaatcaactgaaccttacttggtgacctgaaccctcacctctcttctgattaggctatttctgctttggttgaagatgttcatggatcctgcaaggaaaattcaatttccctaatgtcttgacatttcctataatcaccaaacctgtaactatagtggatcctactcaggataaatgtggttttaagtttatatcctgtcgtaggttattatataaaaaataactacagggatttgctaattatatctccattgtctaggtaatatacttgggagaggaaaaaaagcattgcttctcttgttttttgagtgctggccttcctccctctggctccccttgagcaagggatgaagccatttctggggtttggcaagttagccttatgggcagggcatgtggctatttgctcatgggatgtgacactccagtagggttgattttagctggagtctgggaagaccattttataagggaatctctgttgcagattcagttttaaggagagcttcttccactgtggagggcataacagggtaattggctctactccagtaagggcttcagttttaattaaatggtcatataagttttaaggtatcacgatcatgattgatattaaaatgtgaaagagttatacatcatatccagtatggcaaaaaaaaatgaagagggaaagaaaactgagagtaaggcatctggaaaagctaaatatttgcttctaaaagtaactgttttgagggacgaacagcaaatttcacaagctcatgcacagtctttgtgatgttcagatattcaggtattaaaggtatatgttaaataatgtaggtgttcctagtatgtgaaccatttcatccatactctgaaaatattagtgttcaagaatgtattccctttcaatcatgccttatattcaatatctgtgtcttgttcatattccgtgttgtgctttttccattttcctcaagaatgtttaagctactggatgctctcttcctagatatttcacaaaagaacgatctattaaatttattacatttggattacttttcctttggttaatgattcgtacctttcatttactgcctgtttccttttcccttaagtttctcttgtgactcttttttttatttctaagtattattttcttgtatcatgtaatttgctgtctattttaataggatacgcatataatgctatgactgtcctaagaatacaattcaggcttgttcaataggctcctggaaatcgtctgtaaactatcctttaatgtaaatagtcgaatggaatggttcagcagtgtggagtaaaaacatttagataatttcttccctatacgtgcagtgcttcctttaaattcagaagttcttctaattaagtcagcaatttggaaaacatgtatgaaaaatacttatgtggactactcaggacttagtacattatagactttgaactctaaatcatatcatctgatgactcaaggcagaagcctgtaatataacctctgatatggttagaggttaccatatgtgtcttcaatctaattacacacagtagctcatgaagactgacaggaggacagggagcatgcttagcacaggcatcttacaaccaccttgagcatgactgacctacatgcattctccctacttcatgggtcacaaaaacctgactgtctctatcgattttattactcagtcattcaaggcttcactgcgggaagactttaaaatgtaatcattgggtctggcgcaggaggaggttcacccctgtaatcactcccaacattttgggaggccgagacgagtgggtcacttgaggtcaggagttcgagcccagcctggccaacatggtgaaacctcgtctctactaaaaataaaaaaactggttggcatggtggcaggcacctgtaatcccaaatacacgggaggctaaggcatgagaattgcttgaatccgggaggcagaagtcgcagtgaaccgagatcggaacactgcactccatcctgggtgacagagtgagaccccatctgaaaaaaaaaatgcaatcattgtttaagagcctgagagaattcaggatttgacaaaatccaaaaacactcatgaaggtctccatacaggaaaacaagcatcaagcagagtgccttctcattttcttaggagcaatgaaatctcaactcagatattttaattggactaaagctgattgttatgatgaaaaaatcatgaaaatcagaatatctgtgtattctctccaacagaaccatagcatgcagaaatcagcactgaaatggattttaatctatttgatatgcattcactactttcaataaaagcaaaaatgggtgtaggattgatgtgatttgtccagaatctcacaaatcgtgttggagctggtactagaatctccttcagagatcagtatatttcatacaaagtggtattacaaatgcattatatatttgtgagaaacagaaattacaaagtaatctgaaaattgttagctgttggttatacttagaagtaacaaaatgctttcctatttgatggttcaatatggctttcacccaatttgtgtctgtatctgatagtgtttcggctttgcagtcaggcttctggggtctgaaccaccttacaaataaagtctgcatttgaattctgtttttaaaggggcagtaatattctctctttttattatgaaaagtgtaatattgtggaatacagaaagcacataattttgaatcttaatggataacatacctccttctggcattttaaattgctctgactttgtcagaatcttcccctggacatcaggaccatctccgcattcatccccagtctttgactgagacagctcctggagatcagcttccaggtcaggcactaaaaaataccaaggaaatcgattggagcagccagacaagaatgataaataaggaaatgatcctattcttttcctcagtgttgtgcaataaaagcctgtaggctactgtggtaataaatgtgatgcaaagatgtccccgtttgttttcctgtattatgatatcttatttttaatgacaatctgaggataagtctcagcacacctgcatttcccatactttaccattgtgtattataaacacacagctacctaggaaacctgaagatggcctcgtggatagcattttaatcataacttaaatgtaattttctgaaggattagatcaatgtattggtgagcctatgacaaatcctatagtcttgacactcatctcctgttgaggtatcttgaaaatgttgttgttaaccttaattaaagtaattattaggttgaaaggccctatatgtgactttccatacatgaatgtcattaagaaaaaatacaaaatataacagcaaaatcactgtcttccagtgagagtatgggaactgaagtgcaaagaaattaatgggcattgttgacagtcatattctggaaaccccttaacagggaattgctaaaataatccatggcccaaattctgtctctgattagtctgaaaatgctatctgttgaggaaacagtttctgtttcatgataatcttatcgtacttgaagttttctaattataaaaatattagaacaacttttaaaagccccttcaaaatcctacaaacacagttacctgtatgccattgtcctgaattatccagcttttactaaacatatggtcaaaaatataaatcaaaggaaacagtggctgtcatccattggcctcttttctggagttgctatcttgcttcactgaactgcgttttgccctgagccaataccaaattaccttatagtacagacacatttaagtattaagcatttttaagcaaaatcattcacattttctaaaacagaaggcgggaagaatgcaaaccttgaaacaaaatatgaattccttctccatgagtcgtgttcttggtaagtctcaacctctgattctcagttttcttatttatttttttatttttatttttatttttcaagacggagtctcgctgtgtcaccgaggttggagtgcggtggtgcaatcttggctcactgcaaccaatgccacccgggctcaagcaactcttctgctgcagcctgcttagcagctgggattatgagtgtgtgccaccatgcccagctaatttttgtatttttcgtagagacagggtttcactatgttggccaggctggtctcgaactcctgacctcaagtgatccacccgcctcggcctcccaaagcacagggattacaggcatgagccaccacaccgggcctcagttttatttataaaatgaggttaacatccctttgcaaatgggctttattcagggtattataaggtagggcgacttggcactccacatgctattaaagggtgcttaaaacactgtgaacaccatggctgagaagatctcactgcaacatcctaagaatatcaagttaaactagtgaaataatgtacatttttatacaaccaattaaatggtttcatctgatttaggaaggactgtattttcaagcccacaaaatgcatctcgaagaaaaagagaagattaatcatatccagggactgcaggaagctgcaaactatacccgtcacgtttccagccaaccctcagcaaatgtttgagatcctttcctagtgttttctttcctcctcttactggtcatggcataaggcatgatgcacacataggtctcctcccccccatagacattctttctttcccttcccaccaccttgaatctcagctgcaccctgatcttcttctgtcttctgaccaggtgtacgatcccaactttaagctggtggttcttcttgttgaggctctggcacactgggctcctgggaaaagagggttttgtgtgtgcgcgtgcagataaaaaatttttcttatcaatgcatgtcaataatacgaatatacagattacatagatacttctgatcatatgcatgtttaaagacatgctgcaacactagctatgtgctagtgtaatgagctatgaataagcatgaggaggaaatcactagtcaaatctggggaacacaaattcccacatccaggaaaaaccagtatgtagtcctcttgggttactgtttccttcatgagatgccgcaatggttttttgtcaacatgggagacctttatcattgcatctatactaattcaacaacactatcacacaaaaaaaattctgctaatagaaaacatcaaatgttaagtcactcacaagcataggcccaatcagctgagcaagtcgtaaacatcgtcttggtctatatcatcttcctcgccaactcatatttcagtctgcaaacagaatagtgtgcactttgggaggccgaggtgggtggatcacctgaggtcaggagttcaaggccagcttggccaaaatggtgaaacatcgtctctactaacaatacaaaaacttagctgggcatggtgcgggtacttgcaatcccagctaatcaggaggctgaggcaggagaatcgatagaacccaggggcaaatgttgcagccagccgagatcacgccattgcactccagcctgggcaacaagagcaagactccctctcaaaaaaaccaaaccaaaccatagcaaatcaaaacaaaacaaaaatcagaatactgtgattggaaaaatggggtacatgtgcaggatgtgcagccatcagatggctagattttactgtttcacactgtattagttagggatctgtaaaggacagaactgatggatagatgtgtatgtgcagcagggtttgttaaggagtattaacttacacaatcacaaggcgaagtcccaaaataggctgtctgcaagctgaggagcaaaaaaggcagtctgagttccaaaacctcaaacgtattgaagccagcattgcagcctttagtctgtggctgaaggcccgagatcccctagcagatcactggtgtaaattcaagagtccaaaagcagaagaacctggagtctgatgttcgaagacaggaagcatgcagcacgggagaagttggaggctggaagactcagcaagtctagttttccatgttcttctgcttagtttattctagtgctgctggcaactgattagatggtgcccacccagattgagggtgggtctacctctcccagtccactgactcaaatgttaatctcctttggcaacaacctctcagacacacccagaaacaatactttgcaccctttgatccaatcaagttgacacttaatattaaacatcacctgcagacctggactttaatgattcctgagtggcctcactccagcttcaaagggcaggcttgaatttcttgccaaatttgaacttcccactgccattcctgtgggccataactccggacctgctggatgacttcaaaggatcataattgcgttggtattgggaaagttgtgaaggagcccttgtgacaaacaggaagcagcagacagtatgaaagacactgcagagacaagaagcgttgcctgatacatgaccctagcaactctctagctgctaagggaggaaacagagctgggaccaacacagccagtctacctgtgagagggctcaatttcccacatgaccagagcttcccatcctccatgcatgggaatctatgaccaaacatagatttccacaggatggtgggtgggtgggacaaagtctacagattctgagcagctggcaagtttcagggtaccagagtaaacactgtcacgtgacctcagattgcttggtggttgaggccaaattatttactacctaccattttcagtgtagctctcccacttgcctcataaaatggagcaccataagggaatggaggtcacacagggacctccctgtgaatgcatgcaatgcatgacattcagctatgctgcagcccaagcaaagcctccacatgatatcaagaggacaagaggtcacatgtattttctgttccttttgcctgtgagttcccatctgtccaagtaagacttcacctgtgcaaaacagacgctgatatctgcagatgaagcacatatttcatcagtaattgtatattttgtagtagcctttgtggcccataacaaagatgatatttttgtctaaaaacactgaattgcaaaggaggtggacaaaattgggttctcatgcatatttgcatatattctatagcaacatttatcaaccatgggggatgttctctgaaaagctgtaatcatttctaaactggtttttaatccatagtgggttgtaagattaatgttgtcagccacaaacagcattttaaagaatggagataaaatatattactaaatagcgttcactgcatatagaatatacaaatacactacacatccccatgtacaaacgtatatttatttgcctagttgactatatataaactgtgtatttctcacacattgtcataaaagagtttgaacgtcactactttagtggttattagaaaaaatgtttacaggccatttctttagccatctgtgaagatgatggattaagatttgctaagaataagttcactgttgtctgtggctttctacataatgcttgaaatggcactcagtgatgcttaaactggtcagttttactgtgggcatttgaccctcagcaaactcatttgtgaactcatgagctggtgagaaggaaggctgatgagttgtggggctttacttcctaccatgtctttctgcagctgcaggtgtgaccatgtgtgtgcttctgcactcgtctgacagtgctttgatatgttcccttttatttgcccctttattattgactgtgtcttatagttcctattatgtacttcattagcatccagtgacagcgacatctgtggtattcagtgttgatccaatttacacaaattttaaaaatattttcaagcatgaatattttttcttaccaactttccttaagtacttccaggagtcaaatgcaattcaatattagtagttgatgttagaccatactggggtataatcctggaaaattactgataatactaattgttgttacgcctcagcttttatgtcaccataatgcttagataaatggcacaatgaccaacacatggaaagaaggattctgaaatattgacattttttatttccaaaatttactttaagctcaggggtacatgtgcaggatgtgcaggtttcttacataggtaaatatgtgccactgtgatttactgcacacatcatcacatcaccctggcattaagcccagcatccacgagctactctacctgaccctctccctcctcccacccccgcagtccagtaggctcagtgtgtgatgcttctcccatgtgtccatgtgttttcatcatttacctcccacttataagtgagaacatccggtatttggttttctgttcctgcattagtttgctaaggataatggctgccaccaccatccatgtccctgccaaggacatgatctcatttttttatggctgcatggtattccatggtgtatatgtaccacattttcttgattcagtttatcattgatgggaaggacatctcaaataccacaaagacacttggtccttgttgtgggaaatatcggactgtggtggggcagacagacaaacagaacagcagtagaagagcaaaggagaaacacagggaagggaaccagaggaataaaaaacaatatattggccatgagacaggggaaaacaacacaatattttaaaaaggtaatctttctcctttgcctttgccacttttctgaaaatcaacttattaggttttgtgagtctattgctggctctattttgatttgttgacttttctccaataccacactgtcttgaatactggagaagtaacacaattgccatatggggctggatgattaagaatcataatcaacaacttcatgcaatgcttcctaactcaaggcagcaccctcacctcagctgaggatcccatgcctcccaccttctcaggggctccgctcctgcactgatctctcttctctcctgaaccatcaacggctccttctatactggatcaatccccaagccaagggggaagtcaccttcttccaatgcactgataacataatcaatcaataaatataatagaattaatgtgaatcttgacctcctgtagggtgaattccccaaagttaaacttcagaattgttttggatattctgattcattttcctttgtagataattttgaaaatggactccagtgaagtgtgttgcataagttcatgcagttttcctttgcagggcaggaattaaatgtgttcgtagctagagaaggacatgggggaagagggtgagttttcccttagcttggggaatgatccaatgtagagggagcagttgatggttctggagagaggagtgatcactgtaggagcaaagcccatgacaaggtgggaggcatggtatactgacctgaggtgagggggctggcttcagttaggagtattgtatgcagaagggcagcagagaatgtccatgaatcactgaaggtgagggtggccttgggggtccctgacacagtgtcagcaaccgtgtgattcaccagcaggaccctgactcactacaacatggtgaaactttctttgagtaagggaagagcgaaggggtagagatgaggaagctgtcactcctgggagactatggatttccccatagtatgaagcagcagctgagctgttgtctattatgaaaaatacttgtactcacaacattcacaataatccctccaactgcaagggaactggctcactggatccctcaactgctgttctgtgcatgataatatatggggggaaagcgcagtctttaatttttgttttctcctgcaggcaggtagagactggatacaattgttgccaatgaactttcagtaggccaaaaatcctgaaggtttgaattgttctttcctctaagtgggagggaaaaaatcagtttcctgggctaaagcaaagccttagataaaacttaagtcttagataaaggaaaaaaagtgagaaaaaaagaccactggcagtggctcacacctgtaatcccagtattttgagaagctgagggaggagaatcacttgaagccaggagttcaagaccagcctgggcaacatagtgagacccctgctctacacaatttttaaaattagctgggtatcatggcacatgtctgtagtcccatctactcaggaaggtaacacaggaggattgcttgagcctaggactcctaggttgtggtgagctctaagtcctccagtgtattccagcctggatgacagagagaaaccctgtctcaaaaagggagtggggtgtgtgaagacacatttcagccttgtcttcagctggactgccactgctgcagcctcctcccaacatttgaggcaggatttctcttggccatggaatcataactctgtgaatgctgagttcagtgctagggttttgatggaaattacaatgagataaaaaaaaaggtacagttgtaaaatgtctttgtgttttgtggctattacatctggatgtgtgatactgacggagagggtccagcagtttgactacttaatgcagttgccacaagtgaggaattcatcttttctacacttctcactggataagggatagagacaaaagggatggatgttatgtaaactgatttttaaaatttttatgaattcaggatttcatcctgtccatttcttaaatatgatgaatcttttcactaagtttatatcataatgtgtttttctgaagatgtttcgtcccttctgcttacaacccttccagaaaaaaaaaggtctggaggacgaaatgggatgattaaagagataaaaacttttcatcacaggatacaacatggtgattctgtaatagtggagaaaacagaaaacctggcacatgaggagaggcaagggagggaaggaggacatcggttgtctctgtttttcaaaactattcctgcacactctccacttttcctcagaaatacttcccatgagggctttccaagccactgtgagccattgttaaaaccacattcattggtgagccggtgattaccttacaggtattcaaggaaatcagctaccagtcaagaggtataaaagtgcaataacacaaccttaaaaaaaagtacaggtgtgaattgattgtctacagcatgtataaaaattggcaggcatgggaggatcacttgaggccatgtgtttgaaagcagcctgagcaactcagtgacaccccgcatctaaaatataataattattaaatacgttaggagggcgtggtggcggccaactgcagtcccagctacaggggaggttgctgtgtgaggaggattgcttgagcccaagagatggaggctgcagtgagccatggtcatgccactgccctccaccctggacaacagaaaaacaccctgagaaaacagtatgtgtaaatatagacataaaattctttatttctgtcacaaaaggtctttctgagacacaccctccactaagggtgacatgggactctctgttctcaatgtttctggatgcctgagaatggctgggcaagagacaaaaaaaatttaaaaaatctctcatgtccctttcttcctactacaaactacctgggataagggtgtggggatagcaggaaaaccctggccggccctgcatgtgcctgactcagtgtgcatgccccttgctgcacaaggcgtagtggctcacatctgtaatcccagcactttgggaggccaaggtgggtggatcacctgagttcaggagttcgagacgagcctgggcaacatggcgaaaccccgtctctactaaaaatacaaaaattagccgggcgtggtggcacatgcctgcaatcccagctactcgggaggctgaggcagagaaactgcttgaatccaggaggtggaggttgcggtgagccgggactgcaccattgcactccagcctgggcaaaaagaatgaaactctgtgtcaataaataaataaataaataaataaataaataaataacagaaaaatgaggctcagagattgagacttaccaagaacacttgactcatggaggaggaattcatattttgttccaaggtttgcattcttcccaccatccatgtcagaaaatgtgaatgattttgcttaaaaatgcttaatactcaaatatgtctgcactgtaaggtactcagcattgactcaggacaaaacgcagttcagtgaagtaggatagcgtctccagaaaagaggccaataaatgacagccactgtttcctctgatgcctatttttgacagtatgtttggtaaaaggtggataattcaggacactggaatacagataactatatcagtaggactttgaaggggcttttaaaagttgtttcaatatttttataattagaaaactccaagtacaataagattatcgtgaaacagaaattgtttcctcaacgaatagatagcactttcgaactaaagatagacagaatttgggccatggattattttagcaattcactgttaaggggtttccagaatatgactgtcaacaatgcccattaatttctctgcacttcagttcccgtactctcattggaagacagtggttttgctgttgtatcaggtactttttcttaatgacatatagggcctttggacctaaacattaattaagtttaaccccaacactttcagggtacctgaacagggaattagtgtcaggactataagatttgtcataagcagaccagtacattgatctaatcattcagaacattatatttaaggtatgattaaaatgctatccacggggcagtcttcagatttcctaggtagctgagatacttcagatttcctaggtagctgagtgtttataacacacaatgttaaaaagtatgggaaatgtaggtgtggtgtgatttatcctcagattgttagttaagatatcataatacaggaaaacaaacggggacatctttgcatcacatttattaccacagtagcctacaggcttttattgcatcacactgaggaaaagaataggatcatttccttatttatcattctggtttggctgctccagtcgatatccttggtattttttagtacctgacctggaagctgatctccagaagctgtctcagtcaaagactggggatgaatgtggagttggccctggtgtccagggggaagattctgacaaaatgagagcaatttaaaatgccagaaggaggtatgttatccattaagattcaaaattacgtgctttctgtattccataatattacacttttgataatgaaaagagagaacattactgcccctttaaaaacagagtccaaatgcagactttctcgggaaggtagtcgagaccccagaagcctgactgcaaaactgaaagactatcagatacagacacaaactgggtcaaagccatattgaatcatcaaatagaagcgggggctcacgcctgtcatcctagcactttgggaggccgaggcgggtggataatttgaggtcaggagttcgagaccagccagggcaaatggtgaaacccagtctctactaaaaatacaaaaaattagccgggcttcatggcaggcacctgtaatcccatctactcgggatggtgaggcagaggaactgcttgaacccaggaggtggaggttgcagtgagccgagatcatgccactgtactccagcctgggcaacagagtgaaactccgatctcggggggaaaaaaaagaaaggaaaagaaaaaagaaaagaaaagaaaagaaaagaaaagcattttcttacttctgagtataaccaacagctaaaaatttgtagattattttctactttctgcttttcacaaatacataatacatttgtaataccacttcgtatgaaatatgctgaccctgaagaagattctaataccagctctaagataatttgtgagattctggacaaaacacataaatcctgcaccggtttttgcttttattgaaagtagtgaatgcacatcagatagattaaaatcatttcattgctgatttctgcatgtttcggttctgttggagaaaatacaaagataatttcattttcgtgatttgtttatcataaccatcagcttcagtccaattataatatccgagttgagatttcattgctcctaagtaaatgagctggcactctacttgatgtttgttttcctgtatggagaccttcatgagtgttcttggattttgtcaaatcctgaattctctcaggctcttaaacaatgattgctttttttttttcagtaggggtctcactctgtcgcccaggctggagtgcagtggtctgatctcggttcactgtgatctccacctcccggtttcaagggattctcatgcctcagactcctgtgtagctgggaatacaggtgtgtgccaccacgccggactaatttttgtatttctagtagagacagagtttcaccatgttggccaggctgggctcgaactcctgatctcaagtgatccacctgcctcagcctcccaaagtgctgggattataggcatgagccacctcccttgctggacccagtgattgcattttaaagtcttcccgcagtgagaccttgaatgactgaataataaaatggaaagagacagtcaagtttttgtgacccaagaagtagggagcatgcatgtaggtcagtgatgctcaaggtgtttgtaagatgcctgggctaagcatgctccctgccctcctgtcagtcttcatgagctactgtgtataattagattgaagacacatatggtaacctctaaccatatcagaggttatatattacaggtttctgccttgagtcatcagaagatacgatttaaagttcaaagactataacatactaagtcctgagtagtccacgtaagtatcttttacacatgttttccaaattgctgacttaattagaagaacttctgaatttaaaggaagcactgcatgtttaggggagaaattacctaaatgtttttactccacacttctgaaccactccattaggctattaacattaaaagattgttttcagatgatttccaggaggctactgaacaagcctcagttgtattcttaggacagtcatagcattaaatgtatatcttattaaaatagatagcaaattccatgatacaagaaaataatattaagaaagagcaaaataataagagtcacagaataaacttaagggaaaaaggcagtaaatgaaaggtatgcatcattaacaaaaggaaaactaatttgatattaataaatttaatagaatgttcttttgagaaatagctaggaagagcatccagtagattaaacaatcttgaagaaaatggaaaaggcacaacacagaatatgaacaagacacagatattgaatgtagggcataattgaaagggaatacattcttgaacactaatgttttcagagtgtggatgatatggttgatatgctcagaatgcctacactatttaatatatccctgaaatacctgaatatctgaacatcacaaagactgtggaaggacgtgaaatttgccagttgtacctcaaaacacagtcaccttttttttttttttttgagatggagtctctctctgttgcccaggctgcagtgcagtggcacaatcttggctcactgcaagccccgcctcccgggttcatgccattctcctgcctcagcctcccgagcaactgggactacaggcaccagccaccacgcctggctaattttttgtatttttagtagagacggggtttcaccgtgttagccaggatggtcttgatctcttgacctggtgatctgcctgcctcggcctcccaaagtgctgggattacaggcgtgagccactgcgcccagccaaaaacagtcacttttagaagcaaatatttagctttccagatgtgttactctccgattttgtttccctctccatttctttttctttgccacattgcttatgatgtataactgtttcacgttttaatgtcaataatgacagtgatatcttaaaacttatattaccatttaattaattatacaaatgggaatactttccggtgaaaaatgtatcattattcatattgacataatgactataggtgaaaactggatgcaaatggttagtgtatgtcaaaaaaggactaagaagggtaaactagcccaaagcaatattattgcacttctgcacaatagacaaaaaacaaatgcaatactggaccttctattcacttcacttacgtatttcctaatgtatcataactgttttcagttacattatggcaaaacatacttctcagactatttgcaggagcctattggacatccaggtgatagtttcaagccaaaacattaaattatatatttttcacaaattccttcggttgcttaggttttttgtgttttagttgcattttgagtaaaactctacacaatgtttgctatctactttaagccccttttaataggttcacttgatttaatgtgttctggtctcagactgtcttttggtttccttctagcaccaaaagcggggtgtgtttaaaaaatgttgtttaatgtgtatgcttggaggtgttatgttcaaagtctctacagaggtctagtggaatgttagccatagggtgactcttacttaggcttctggtttttgtccaatgtataaaactaaaattttggtgtcctttgtatacctttaatttcatctgaatacagttctgctagtaatgttccttcctgttgtgtttctattgcaggggaagggcaaccacagctttaaacaaaggcaagctgaaagaatgcaaactggatttatccgagatatttgacttttaaaaatctcaataaagatttccagttttctccaaataagtatcacacatcttttgttcatttattctcgcatattagaccctattgtaaattttggccgggtggagtggctcatgcctgtaatccaagcacattgggatgctgaggcaaggggattgcttgagcttgggagagtgagacatgcctgggcaacatggcaaaaccccctctctacaaaaataaatgaatgaatgcatgaatgtatgcatgtatgtttgtaggtgtagttccagctactctggaggctgagatgggaggatcccttgagtctaggaggtcgaggatgcaggtagtcatgttcacaccactgcaactccagcctgggcgaatgcgactctgtctgaataaaatatagtatcatttttgcaactttgcattctgattgagctggtatacacatgtgtgatattgtgaaatatatatatttggtcctggaccctgcttactgtcatacagctcctacaggttttagaatcgcctcatagcgacgtctttttgtatgctagtgagttgactgatggctggcagctcctaggtagctctaggatgggagcttagagggttcgcactttcagctgcatccccaaccttcaggacagggagaggggctgaaggttaagttgattgccaatggcgggccaacagtttaatcaatcatgcctttataatgaaaacctccatcaaaacccaaaaggacagggttcatagagcttctgcctagcggaacacatggagggtagcatgcccgtagagggcatggaagccccctgcctcttccttcattccttcccctgtgtatctctgtatctgcatccttcgttaggatatcccatttgccacaagatatgtgagaattccctagactatagagctggatgaaagaactagcgcctaggcagaagaaaaaggaaagcgactaggtcaatttgctgaagcaaaattacttggatcctacctacactgtctccttacaggcaatggcatggcatagccttgggtgtccatcctgcctctcaaacactggccttgtgatgttgggcaagatacttacatcctgtgggactgtttccccatttccaaagtagaaattagaatatttagactaaatacttgctttgaagaataaatgaaataacataagatgcaggcattacattgcagataaatttactagttatctttccttaatccctttaaaatttcacattttttttacaactacatctctagtatgtgataagtgctttggaatttcaagtaggaatattagtctaccttttaaaatgcatttgacttcagaaactgatttgatgtaaatatgtaaattaaatagcagttgtagctggtatcagacatggcattgcttttgaagttgatttgtaaataaccgaggtgtgacaaggccaacactaagtcagtagtacgtgctgaaaacttgtttggtgtgtgtgaagccatgaagaataagtctactccagtcagtcaacaccacacaactcaatatcatcgtgtgtcaagagctcaggcagtccctaagcagccctgtggtggctaacagggacacaaggatcgccagtgcggttgttattttgtcttgtcatatattcatagatttggtgggtaagaagacaatgaggccaaatggatcgaaatggttgattacttgcagacggaacaaaagcaagatcggcattgtgtcaacactgtgtcgctactcccacagtactacactgaattggagatactcagtaacagcacagatggtgggtctctctgcctgtgaggagcccacagtcaaaacctaaggccaattttgaaaccacactgaatcctgaacccaaacttacatctgaccgagctgtgaccattgggcagcaggggtgacccagctgctgaacatcccacatagaacacctagggatgtcattcacacttgtgaataggaagaactagtgtcaatgactactctgaactgactgcctgctgatagttccactaaatgaaagatgcaaatcaattgtttggactggacaaagaaccctagagggaaaggtccctcagtgggaggccacattgggggccttggccagctcctgcctgatgactgtatgtcctgctgggggtgccttaacaagggtaaactcttggtgtccaggggtatcacctgtgccctctgggattgttcttacctgtatgccctgactatcccaccactgcctcatccctggaaggcattcacatcagcttcggcttcctggccagagttgttatgaccctgaaatgctggcttgggttggacaaaaatggataatacagaatcttagttaggaagtcacctgcctttgtcagataggccttcatcattattaggatttgtataagatggctatgatgggaaagctgatgtgtcaactttgctacgccacaatgcatgagaaatgttcactttgaccagggtagatgctctgtgaagggttttctttaggagaactaacatttaaatgagcagactttcagtaaacccaattgccctctccagtgtgggtgggcctcatccagttccttgaaggccttcagagaagaagactgcggttctccacaagatgaagaaattctgcctccacactgcccctggatttgagctctcatatcatctcttccccgggtctccagcctgacatcctgctctgcgagatttggacttcccggtcacaacagctgcatgagctaggtcttcaaactcaatctttctctctctctctctactcactcacataaatacttgggtgcacagcccaccccacgacacacacacacacacacacacacacacacacacacacagaagaaccctaaccaataggctgcttatatttggggcccttaaagtgcataactgagatcgatactgcaggttgatctcactctgctgcatggctccaaacgcagaggcctgtggtgttcccctcccatgcactgacatccatgctgctcgtcactgcgactcagggtttggtcatctaaccatgtagaggtcactacaattctacaagtgttctctgccctccttctgcatgtgaggtcctctgttccatcctgagggcacagagatctactgggtatgtttccatccttccaagaaggactttggagcctggtgagggagatacacctgcaacagcggtaacagcaacgggcatagccagtgtgttcaccaactcatgagagatcacactaccaacatctcccacataaatttccccatcaacaaagagcttatcatggaaatgatcgtgttcgtaggtatgttggattccccttattctattttccccaggaatgcacagatacaaagaaaactgatgctggaatgttgtgttggagtgcaatctaagaatggaatgccctgcagtgatgtgatttctgaagcagtcaataagtctttataagttcttagatgaagcaacatacaagtctccctcagtttacagggaagtgacatgtatggaaaatccagtttatggaagactttggaaaaagatgtttgcctccctgtaacactcattccccaaatgccagcagcccctaccaatcattccaacaaccacagctgcactcagaaaagtccaaaatggcccagtaggtaacgatattctggctataagccacaagtttatgattgaaaagaagtatcctcaaacttcttgtttacataaaaagagtagggatattgtggtcggtacaaaggaaataacagggcaccaaggaggaggacacaatgtccctgggaggggttacaggcaccttcctcctctgtcttgctttgctttctgtgataagaaagtggttcagggataggcgtggtggctcccgccagcttgggggacatagggagaccccttttctactaaaaattttgaaaaacagccaggcatggtggagcatgcctgtagtctcagctacttgggaggctgagatggaagcatcgcttgagcgtgggagtgagccatgatttctccactgtaatccaggctgagcaacagagtgggaccccatctcaaataaaacagaaataaaagaaagtgtctcagggccagctgcgatgggtggtgaagcttcatttcaaaggtcaatcactgccatgaacattaatactcagatggttctgtggtagtcatagctctgagatcctgggactgatgtccttcttgatgaggatagccctctccaggctgggacacaagagcaaggtgccaggctaggtcatcaggctaccagggacagctgtctgctgtgggatcacagatgagatcaggagaaggacagctgaagggaggagaagggagacaacctcctcagaggaggtgcaggtgtctgttactgaagggaaggcatttgccctaagtcctgacattgctctaggctcccatggatggacacgatggtaccagaaagatccaaggctggtgggaggagcacgatagcttccatcacctcccatcttatgtgttcactggtcccttagggaagtccatgcaattttggaatctaaagggttattttctggcattccctccattcaccacccacaaagagaagggatttgagataaactgaggtcttcagggagaaaggccagatggagttgtgaggccttctcaaaagtccctctgccctacccttatggtgagtctcacactgcattcatcatgtcttgtgttcctgtgtgctctgaggtctctcttctcaacctcatgtctgtcttgggaagagtgggtatattgcagacagttttgcaacctaagggatttaatcagttttctgaaacttccctagcctgggcagtaaattcccagatcctagggcaccattccgaccacactacatgagactcactgggtgtgaatcatggaatcttcacttttaaaggatcctggattccaactttcatggaaacttgtctgagaactagtagagcaggggagtagtctcctttcccagctgcacagcttctttctcctttgtgaaggtatagaagggacaggtttttttgtgttctctgatgtacaaacccaagatcttcaggtgaagacatgctgccgttatggtaatgacacactcagggcactgtctccaaatcatacccaggccaatcctttcaagtctccatctcttaactatttctgaagaaatcaaatgtctcttgcctgtgcagtcccatgctataaaattctaaatattttgctatagcctttggctcttacccttcagatcttacccttgcacaaatatgcagcacaatagagttttccatgatgcctctgacctgtgcctccaccactcagtgctggtgacactgagaaagttacttaacatctctgtgactcctttctccaatagtaccatagaaatactactagtaaatttatgtagttcttggggcagtttagagcactgagtgtgtgaagaaaacatgtacggttgtcaggaaagtccctggcatatggtcaatttccaatcaattctagctgttactgttttgctgtttatattgttgctgttcccacatttccctgggagcatgttccagagatacaatgtcacaactacctttgaccccttccatgatcttttgattatcacttcatttcttcagggactcaaggactgagtctgtgggggcagggtgaggccatatttttatgagcataataaatattcagctctccttacagggtattgtggagcctaaatgtaatgctgggatttcatcatcatgagcttgtatgaaaaatttaaatggaaatttctctaggaaatcagaagtctaatgacctcttcatgtgatttgtataatgcttggaaaagtaattagtgactggataaggatagcatgtaaatatataaatattaaaaattttatgaattttctatttcatagtttgtgtgttttgtatcccatctatcgttgttttacatgttgccacagattctcctacattttcttctagaagtgtgataagttctatgatgcattttgaattaacttttgtatatggtgtgagacaaaggttcaggttcacttgtttgcatgtcaatgtccaattgttccaccatcattctctgaatacagcatcctttcccactaaattatcttgggaccttatggaaaaaaattaacgagaatatataggtctagctttggcccttatttctttccttatgccaatatcacagtgtcctgattaccacagttatgaaatacatcttgaaaacaggtaacgattcctccaatattctttgttctttataaaattgttagactattccagtccctttgcttttccatataaactttgaattcagcttatcaatttgtagaaacaaaaagttgcatggattttgattgtggttacattgaatgtgtagttcatttgggagaaactgacatgttcacaatcttgagtattgcaatccattaacgtggtatacctctccactgatttcagcctgctttaatatttcacagcaatgttttttaggcttctgagtacaggttttgcacatattttgttaaatgttaccactaaacatttcatgagattttgccgctatattaagtggcattgattttaaattttcaatagtttgttgctgcgaaagtcaaacttctcttgtacatattaccatgctaaactcacatatacatgtataaatatattcaagtcatggggtgaatctcatttggctatgatgttgtaaatttttaatatattcctagttttgacctgctattattatagcataaacataaatctatgcttttatagacatgagttatattagtctgtcatgttgttttttcatgatgtttgtctggttttgataccaggttgatgtggactctgtaaaatgttttgaaaagtgtgatctcttttcaattataaagagtttgtgtagaaacaacattatttctttcacaaatgttttgcaggattatccagtgaagtcaccagaaacgtgaaatttatttgagaaaaaatctttatttcatttctttgtttctgatgtatttcttcctttttgatgtataatgtaaaatgtataatcttttgcaaacactctttttaatgttctggcttgaatctatggtctgtatgccaaatgggctcctggaaatagtctctcttggaagaaaatggttaatgtcaccttaggaactgcatcagggaagtgaatagaaaggccagcattgcatttatttttactctattgtgcagaagggcaaaaatatttatttgggctcgtttaccctactgtggtttttaaggtacagtaaccgtttgtacccagttttcttctaccgtgatgtcaacatgaatgatgcctctttttacacttgaaagtattcccatttgtataattaaatataaggtcacattactcttaagctatcactatcagttttgtcatcaatgtgtgacagcattatgaactgtgccacacacgaaaaaatggagggatatggaaatggaaaacaatagtaagacatctgaaaaagtcaaaatcagtttctgaaagtaaatgggatgccttccgagcttatcaaccatttcattcatgctctgaaaatattagagttcaagattttattcactttcaataatgccctatattaaatcaccctgtcttgttcatattccatgtcgtgctttttccattttctgcaagatggtgtaaactactgaatactctattcatacctatttttcaaaagaccattcttttaaatgcattacatttgaattattttttcttttactgatgatttgtaactgtcttttattcattacctctttctttttcctttaagtttattctgtggctcttttattattatttcatagtattattttcttttatcatgtaatcagctatttattttaagaagatttgcatttaaagctatgatctcccaaaaaataaaacagagtcttgttcaataggctgctggaaatcgtccgagaactatcttttaacgtaaacagtctaatggaatggttcagcagaggagagtaaaaacatttaggtaatttctcccttaaacatggagtgtttcttttaacttcaagaggtattctaattaacagtcaccaatttggaaaatatgtgtaaaatatatttatgtcaaccactcaggaattagcacattactgttattgtactttaaaccctgtcatctaatgtctcaaggcagaaacctgtaatgtgtaatgtatggtatggttagaggtgactctactatatgagtctttaatctaattacacgaagtagctcatgaagactgactgacaagagggcagggagcatgcttagcagaagcatcttacacccaccttaagcatcactgacctacatgcattctccctgctatactggccacagaaatctgatgatctcttgccattttatcattcagtcattcaaggcttcactgcgggaaggctttaaaatgcagttattctttaagagccagagaattcctttggcaacaacctctcagacacacccaggaacaatactttgcaccctttgatccaatcaagttgacacttaatattaaacatcacctgcagacctggactttaatgattcctgagtggcctcactccagcttcaaagggcaggcttgaatttcttgccaaatttgaacttcctgctgccattcctgtggactgtaactccggacctgctgaatgagttcaaaggatcattatagtattgggattgggaaagttgtgaaggagcccttgtgacaaacaggaagcagcagaaagtatgaaagacactgtagagacaagaggagttgcttgatacatgaccctagcaactctctagctgctaagggaggaaacagagctgggaccaacacagccagtctacctgtgagagggctcaatttcccacatgaccagagcttcccatcctccatgcatgggaatctacgaccaaacttagatttccacaggatggtgggggggtgggacaaagtctacagattctgagcagctggcaagtttcagggtaccagagtaaacactgtcacgtgacctcagattgcttggtggttgaggccaaattatttactacctaacattttcagtgtagctctcccacttgcctcataaaatggagcaccataagggaatggaggtccctgtgcattcacagggaggtctccgtgaatgcatgcaatgcatgacattcagctatgctgcagcccaagcaaagcctcctcatgataccaacagaagaggtcacatgtactttctgtcccctttgcctgtgagttcccatctgtccaactaagacttcacctgtgcaaaacagacactgatatctgcagatgaaacacatatttcatcagtaattgtatattttgtagtggcttttgtggcccatatcaaagatgacatttttgtctaaaagcactgaattgctaaggagggcgacaaaattgggttctaatgtgtttttgcatttattctatagcaacatttaccaaccatccaagatgttctctgaaaaggctttaattatttcttttttttattattatactttaagttctggggtacatgtgcacattgtgcaggttagttacatatgtatacatgtgccatctaaactagtttttagtccatgttcgatcataagattaatgttgtcagccaaaaacagcattttaaagaacagcattttaaaaaatggaggtaaaataaattactaaatagcgttcactgcatagagaatatacaaatacactgcacattcctatacacatacatatatttatttgcctagtcaactatatataaactgtgtatttatcacacattgtcataaaagagtttgaacgtcactacttcaggggttatcagacaaaacgtttacaggccacttccatagccatctgtgaagatgatggattaagacatgctcagaataagttcactgttgtctgtagctttctacataatgcttgaaatagcactcagtgatgtttaaattgtcagtttgactgcagggtgtgttcatgtgtgtgttcctgcactcatctgatgatgctttgatatgtctccttttatttactcctttattatttactgggtcttatggttactattgagagaagagagagatcctctcatattgttttatattgttttatattcagtatcttttttaagaaaaaacaacaaggaagtaaaaccaaagacaggcagccccgcgccaggcccaaaacctgacccgggcctgcctggcctaaacctagtagttaaaaatcaactcatgacttagaaaccgatgttattcatagattccagacattgtatagaagaacattgtgaaactccctgccctgttctgtttctctctgaccaccggtgcaggcagcccctgtcacatacccattgcttgctcaaatcaatcacgaccctttcatgtgaaatctttagtgttgtgagcccttaaaagggacagaaattgtgcattcggagagctcggattttaagacagtagcttgccgatgctcccagctgaataaagcccttccttctacaactcggtgtctgagaggttttgtctgcggctcgtctggctacactattatgtaattcattagcatagtgccagtgacatctgtggtactcagtgtcaatccaatttacatgaattttaaaaatgttttcaagtgtgaatactttttcttaccaactttccttaagcacttcaaggagttgaatgcaattcaatactagtagttgatgttatatcatactgagctataatcctgctaaattgctaatctactaactgttgttatgcctcagctttcatgtcaccataatgcttagataaatgacacaaagaccaaaacatagaaataaggattctgagatattgacttttttttaatttccaaattttactttaagttcaggggtacatgtgaaggatgtgcaggtttcttacacaagtaaatgtgtgccacggtgatttaccgcacacatcatcacatcacccagatattaagcccagtatccgtgagctgttcttcctgatcctctccctcctcccacccccgcactccagtacgccccagtgagtgatggttctcccatgtgtccatgtgttttcatcatttacctcccacttataagtgagaacatccggtatttggttttctgttcctgcattagtttgctaaggataatggccgccaccaccatccacctccctgccaaggacatgagctcattcatttcatggctgcatagtatttcatggctgcatagtattccatggtgcatgtgtaccacattttcttgattcggtttatcattgatgagatggacatagcaaatatcacaaagacacttggtccttgctgtgggaaatatcgcactgtggtggggcagacagacaaacagaacagcagttgaagtgcaaaggagaaacacaggaaaggaaaccagaggaataaaaaacaattaatgtagtggccacgaggcaggagaaaataacacaatttttaaaagataatctttgtccattgcctttgcctcttttctgaaagtcaacttattaggtttgtgagtctattgctagactctattttgatctgtagattttcccccaatatcacactgtcctgaatactggagaagtaacataattgccatatggggctggatgattaaaaatcataatcaatagcttcattcaatgctcctaactcaaggcagcaccctcacctcagctgaggatcccatgcctcccaccttttcaggagttctgctcctgcactgatcattcctctcccctgaaccatcaacggctccctctatattggatcaacccccaagccaagggggatgtcaacttcttccaactcactgataacataatcaatcaataaataaaatagaattaatgtgaatcttgacattgtgtggggtgaattcccccaagttacacttcagaattgttctagatattctggttcattttcctttgtagaaaattttgaaaatggactccaatgaagtgtgttgcataagttcatgcagttttcctttgcagggcagcagacacatgtgttcgtagctacagaaggacatgggggaagaaggtgagttttcccgtagctggagaatgatccaatgtagagggagcagtcgatggttcaggagagaggagtgatcactacaggagcaaagcccatgacaaggtgggacgcatggtatactgacctgaggtgagggggctggcttcaattaggagtattgtatgcagaagggcagcagagaatgtccatgaatcactgaaggtgagggtggccttgggggtccctgacacagtgtcaacaaccgtgtgattcaccagcaggaccctgactcactacaatatggtgaaagctttctttgagtaaaggaagagtgaaggggtagagatgatgaagctgtcactcctgggagactatgcatttccccatagtatgaagcaacagccgagctgttgtctgttatgaaaaatacatgtactcccagcatttaacaataatccctccaactgcaagagaactggctcactggatccctcaaacgctgttctgcacaggataatgtatggaggaaaagtgcagcctggtgctgactttaatttttgttttctcctgcaggcaggtagagacaggacacaattgttgccaatgaactttcagtaggtcaaaaatcctgaacgtttgaattgctgtttcctccaagtgggagggaaaaaattcagtttcctgggctggagcaaagccttacataaaccttaaaacttagataaaggaaaaataagtgagaaaaaggccacgggcagtggctcacgcctgtaatcccagtattttgagaggctgagggaggagaatcacttgaagccaggagttcaagaccagcttgggcaacatagtgagacccctgctctacacaatttttaaaattacctgggcattgtggcacatgtctgtagtcccatctactcagaaacgtaaggcaggaggatcgcttgagcacagaagtcctacgctgtggtgcactataagtcgtccagtgtactccagcctgggcaaaagagagaaaccctgcctcaaaaaaggggttgcaggtttgtgaagacacattccagcctcgtcttcagccgggttgccactgctgcagccccctctcaacatttcaggcaggatctctcttggccatggtacttgcaagtgtgtgaatattgaatttagtgctaggggtttaatggaaattacaatgatataaagaaaaccgccacagttgtaaaatgcctttgcattttgtggctattaaatctggatgtgtgatatcgatggacagggtgcagcagtttgactaactaatgccactgtcacaagcaaggaactcatcttttctacacttctcaccggataagtgatagagacaaaaggattggaggttatgcaaactgagttttacaattattacaaattcaggatttcatcctgaccatttcttaaatatgatgaattttttcacgaaatttatattacaatgtgtttttctgaatatgtttagtcccttctgcctaccacccttccagaaaaaaaaaaaaaaagttttgaggaagaaacgggatgatgaaagagataaaagcgtttcatcacataatactccatgctgatttgttaacaattggagaaagcagaaaacctggcacatgaggagaagcaagggagggaaggaagacataagtagtctctgtttttcaaaactgttcctggaaactctccagttttcctcaagacatacttcccatgcaggctttcctagctgctgtgagtcaacgctgaaatcacactgactgatgagccatgatcaccttacaggttttcatggaaatcagttaccagttgacaggttcaaaggtggagtaacacaatattaaaaaagcacacaagtgtgaactgattgagtctacagcatgtataaaaagcctttataaaaattggccaagatgggaggatcacttgaggctgtgtgtttgaaggcagcctgagcaacacactgacacacctcatctaaaaaaaaaattaaatacattaggtgggcatggtggcggccatctgcactcccagctacttgggaggtttcagtgtgaggaggcttgcttgagcccagaagatggatgctgcagtgaggcgtgatcatgccactgccctccacccttcacaacagaaaaacaccctgagaaaaaggcatgtgtaaatatagacataaaattctttatttctgtcacaaaaagtctttctgagacacactccgcactaagggtgacgtgggactctctgttcccaacgtttccggatgcaggagaatggttggacaagacacacacacagacagacacacacacacaaacacagacacacacagacacacatacacacacacacacacaagcacacacacaaaagctctcgcgtccctttgtttccactacaaacaccctggaattcgggtgtggggataccaggaaaaccctggtcggccctgcctgtgcctgactcagtgtgtctgctataaagacacatgcacacgtatgtttattgcagcactattcacaatagcaaagacttggaaccaacccaaatgcccatcaatgatagactggataaagaaaatgtggctcatatacaccatggaatactatgcagccatgaaaaaggatgagttcatgtcctttgcagggacatggatgaaattggaaaccatcattctcagcaaactgacacaggaacagaaaaccaaacactccatgttctcactcataagtggtagttgaacaatgagaacacgtggacacagggaggggaacatcacacactggggcctgttgggcgatgggggtctatgggagggatagcattaggagaaatacctaatgtagatgacggcttgatgggtgcagcaaaccatcatggcacgtgtatacctgtgtaacaaacctacacgttcagcacacatatcccagaacttaaagtataatagtaattttaaaagaaagaaaatggttcacggcaaggtaaggtggctcagacgtcaaatctcagcatgttgagtcatcgaggcatgaggattccttcagccccagagttcacgaccatcctgggcaacatagggagaccccgttttacaaaaaattttaaaagcatatacccaggcatggtggagcatgcatgtaattccagctacttgtgaggctgagatggaaggattgcttgagtctgggaggtcaaggctactgtgagccatgatttctccacggcactacaggctgagcaacgcagtgagggcctgtctcaaatgagacaaaaagaaaagaaagtgtttcagggccagctgcgatgggtggtgaagcttcatttcaaaggtcagccactgccatgggacactgatgctaaggatggttctgtagtagtcatggctctgggaccctgggactgatgtccttccactcggggagggcagccctctccaggctgggacataggaggaaggggccaggctagatcatcaggctacgagggacagctgtctgctgtggaatggcagatgagatcaggagaaggacagctgaaaggaggagaggggagacgcactgctcaggcgaggggccggtctcctaaaaagggaagacattggccctaagtcgtgtcattgctctaggctcccgtggaagcacatgatggtgcaagaaggaaaccaaggctggtgggaggggaacaatagcttgcatcatgccccatcctatgtgttcagtggcccctgaaaggagcccatgccttttggggatcgaaaaggtcatttcctgacacaactccattcaccacccatgaggagcagggatttgagataaactgaggcctctggggagaaaggccagtaagagttgtgaggtcttctcataagacgcactgccttacccttatggtgattttcacactgtgttcatcatgtcctgtgtttctgtgtgctctgaggtcgctcttctcaacttcatgtctgtcctgggaagagtggatatatttcagacagtcttgctacctaagggatttaataaagtttctggaagttccctaggctgggcagtgaattcccagatcctaggacaccattgtggccacactacataagcttcactgggtgtgattcctggaatctgcacttttaacagatcttgggctctaactttcacagaagcttgtctgagaactactagagcaggggaatagtctgctttcccagctccaaagcttctttctcctttgtgaaggtatagaagggacaggtttgtagtatataaaattttaaaaatgtatgtttgttctatttcatagtttgtgctttttgcatcctgtctatctttatcttacacgatgctgcagattcccttacattttcttctacaagtgttgtaacattagctttcacatttagttctatgaagcattttgagttaacttttgtgtatggtgtgaggcaaagtttgaggttcatttgtttgcatgtcaatgtccgactgttccagcaccactcctggaataaaacatccttccccactgaattctcttggcactttatggaaaaatccatttaacttgaatatatagatctagcttcggactcttatgccttttcttctgccaatatcacagtgtcctgattagcatagttgtcaaatgcatctcgatatcaggtaatgtgagtcctccaatattcttggtcctttataaaattgttaggctattctagtccctttgctttcccatataaattttgaagtcagcttgtcattttatagcaacaagaggctgcagggatttttattggtttacactagacatatagattatttgggagtaactgacatattgacaatcttgagtcttgcaatccattaatgtggtatgtctctctatttatttcaacgtggtttcatatttttctgaaatgttttttaggcttctgagcacaggtcttgcacatattttgttaaattttaccactacagatttcacgggggggtttgctgctatattaagggatatcgactttcaattttcaattgtttgttgctggcatataaaaatagcattgacttttccatgttcatcttgtaccatgttactttgctaaactcacatggaggaaattccatttggctaggatgtaaattttttatgttgctagtttctaactccggttaattgttttttacagagtttgtgtctatgttcatgagttacattggtctgtcatgttattttctcataatgttgtctggttttgatatcaggcttgtgcttgctctgtaaaatgctttggaaagtgtggcctctcctcaattatcttgagtggagaactggtgttatttctcccagaaacgtttggcagaattatccagtgaagtcaccagaaacatgaggtttaattgagaaatatctttgttgagtttctttgttgcttttactgaatccaattcctttaattgatatacggctatatatgtcgtttatttgttttttaacgtttcatttatgtccatttttatgggtatttagtaggcacacatacttgacatgttttgatgcagcttgcaatttgaaatgaggacatgatggagattgaggtattcctcctctcaagcatttatccactgagttgcaaataatccaattatactgttcatgttattttaaaatgcacagttacactctttttttgtttgtcttttttagcacttgtccactgtttattcattggaaggaaggcccggtcctaggtagactcgacctcccccgaggaaccttggagccaaaggcaggaggcttccagaatgcttagactctgatcctccttactatcaccctgagacctgtctcaccaaagccttcttctgtccatggttttctcactggatctacaagggaatccccccacaagtctggggtccagtgtggtcactcctgatggttttcaagaaggggaaggccaggaacctagggaaatacctcatttggcccgaccacaactggccagagcaggacaaacatgccatgccatgtcaggcgcccagttacccagctggagggaaagtcagtcctgagagggtggaaggggccagtcacaaatcccggatagatagtgacctgggctccacaggtgagctgggctctgatggctttccctgcctttggaaacaaggaggagaagttttttgcagaaaaagcctcttttccttccagaactgctgttttatgacagctgtttcggcagtgagtcttgtgtctgttatgagggtgggtccccctcttggccctgctctacagaaaatgatggagcagggcaagctgtcctcagtgaatgtacaccagaatggcctggacgtgagccacgccttcagaaaccatgcgtgctccaagagcgctacagcatcaaataaggcctatggagggtccccatctgaagggcatcggggaggtctctgagtcgaggtaggtgtctcagagaagagggtgacagcccagcctactgcctggagttctggcattgggtagggactgcagagggcccgggaacggggaggctttcagggaagtcctaggggctctgaacacctctgctccttccatgaggacaaggaaatgttgtgcacccagactgccaccttaatgtgcttcccacagcactcaattgatggggcaaggatgcacaggagaccgccccccctccccagtccagtgaccctgctgcccacagtgcctggcttccccactgtagggttctgacccctccagaatgatcctgctcgtctcctctgcacaggaggcagaggcacgtccctgcagggcacagaaaccatgccgacatcccacagcaggggctggggctcagagccggcatcgtgtgcagactgggctaggactcaccttgggagagaacttggggagccccttcttccaggggccacatcccactgagatgagtcgacccccatgaggatctgcaggatcttgtctgacatagcctcattgggaaggggggtctgatactgtgcagagtgggtccccggcactacagactgggatcccaataggctctgctcactccaccagccatcagccttgacaggccaggtcctcccaggcctgctgtccccacagaccccttttgggctcatcctgaggctctgggaggtctgccttctgcagggcgagcacaagctcacagccaggacataagcggcattcaaagttcatagaaacttgtccccatgtgcctgaaggtagcaggaggaccacacaagacagacctcaactgtcctgagggcagcacttgcactgtccacacgaccctctgctctggcctagagggaaggccaagccaagccaggcctggtcagctgtgcagggcaccgtgagtccttctggaaactgagcccacccctgacacgacacagatgaaaggcaggagcgtggtgagcattcccctgcctgggccttccctgcatccatggcctcctgtgcacagctggaccccagggttgtccaaaaggggcccagcactgcccactgggaagtgcccagagcagaaacgaggtgaaggcacagacctctcccaggagaccccacctggcctgatgtgcagccccattcctagaacatctcctgaagctgtctctctttggcccatgggagctccttcaggacatgctgtctcaggcctggactcttgaggaccacgtggtgctcaggcctccatggtcgagttgagaaggacacactgcgacctgcatcccacgtgggctccagcctcccgagtcaccctctgaggcattaaatcatggggagtgcccagaaccctccatccctactccctgggccttcctccttttcctcttccttctcaaagaagtttctgaaaacaggccagctgggccccagggcaggtgctagactcgcctcagtgacagggcatgggatgagggcaagacccctccaagcccctcccccacacccttcccctcctggcctagaagaaccctagggggcactggaggggttggtcccatctgtgcgagccaacacccacagctgccagcaccaacgccagagaacagcaggggcgcctcactcacaagcacccctccaagtgtgtcacgacggcaagccttgagccagggaatggagagaatcagtgtctcagacccagagagaggattcagggaaacggtgcagtaggccccttggtgtgggaagtcatggcatggcgtggattgtccgggatggcagaggggcccagtgcccaggagcgtctcacgcgctatggagacagatcctcatcttaggtggcaagggggccaggtgacaggtaaggcctctcccagctgggttctgcaccagggctgaagcccagaccgagccgccctggggtgagggtatgaggcctggagccccgagccagcctgaaccctggggtccgtctcaggagcagcctgagatgctctgacagcaaccatgccccaagctgcacgcacccctcactctgggttcagcagcctgtgggtgtttcctcagtgtcacaccaggtgggccactagagacccccaaaactccaggggcccaggttcatgaggcccagccctgcaaggaacaaatgggcttggtggagaagtggaccaaatctgcttttctttcagccaaacccgcaaagatccctaggaaggtcctgggcctggagcgagtgtccctggcacccaggcctctgtgggcatccctcagcatgcagaccctccccaagggggatgggctggccctccgtggcccaccagcccagctccagaagtccagaagctgaccctgaggccaaggcccagcagcatgaggggacttctgcagagccccgggcagcaggacactctctgggggctcagccgcccagagtgcagcaagtctgttcctatctcaggacagaccccaggattttgggcgatttctgtgtgggtgtcctctcccaaaactccccatgtacctggacatccagggctcatggtttctacagtgcagctttgagcaggcatgctgaactcctattccttccacatctgctctggacatcgccaggaccaatggacaggcccatccctgcaaccccagcagggctccaacaaccagacccggcccaccccactgaaaacccagaggtaggaccacagaaactccccttgcatggtggcatctggatctgacgtttctctgaggatagtgacctgcacagccccaaagcagtcagtactactgctaggccatatgggatcaatatcaatggggaagctgggccctcagaggctgctggaggggagagtgactgtggcatctgcacagccccagccagccagcagcatatcacatgtcctcatgtctgcccattcgtgtgacagagcctctctcacatggcaagcgtcctagagccatggggctgcgatccagcccaagccctccccaaccaaagccctaagagaaaaaggacccaggggagccatgggtgccccagaaacagctaagatggatacacaggggactgagttcctgggacactggccagaactagactgtggcccaaggcagggcaagccccttaaagcagtgtgtgggtacgcagggcctgtgcatgcctggcagagccaagccagtgacgttaccaggctcaaagagcaaccatccacgacggccatggtggggcaggagcaggtgggccagccccctgcctcatcaactcaaggaatcagggatggctgggttcccaggccctgagtgcccaccacctgaccattagtgaggcagagacatgaggccaatcacatgatcctggggccctgcttccatcttacaagaactccttcagctcacagcaccaagaaaaatcctgggcaagtgagggtccaggaggccaggttcctacgtctattctccttgtcaggtgcattttgccactgggaaaagtcagaaaaggtggcctcagtccatgtaagcaggctccaaagtaggcaccatagctgcagggggagaaggagctcctggcggcactggaataggctctggcaggatcccagattctgtgattctgtcccccgcaacctgttttttgttttgtttttttttttgttttttttttttttttttccccttgagtgcttggaatcgtccccattttacacggagtctgcagccattgacaatcagtttattagaggacttgtcggcacccacttctgtagccaccctgtggaaagctggatgaaaggcacactgctatctctgcacaacggtgaccatccggatctcaccaacaggcagagacaatttcttaaatctgtctgagtaatggtatccgccagatcaccaacatacactctggtggaatccttctctgctggtgattcaagatgaagcgtggttgaagcctgctttagaagcttatctgctacagggtcattgtttccacaatatcgatctttaatattttgaccagcaagagggggtcatcgggatctgcaggcttctcatgtctttacggacagtcctctcctttcacctggacagaacaaatgtaaggcttattcctcagccagtacagtgtggtccgggccagtttgagcagcatctcactactggacgtggctttccccagcagagcaactggccatgttctatcagggttagaaattcctctgtccatatctgcagtcacctttaaaggcaagtctgtgtcatgaacctgtatgggcagtcatactctaggtctaagaggcaagtctgacagacatttcctgcaggcttggcccccttcagtcttcttgggatgcatgtgctcccccgggcaccagccaaacactgaatggcctgacagagtttgcattttttctcatagttctccttggtcatgtttctctgagacatatctggcacagaatggagaaatcgacgtcctcccagttttgcctgttttaggcgctggaacccagagaggtcgccatcttgagagggtcggcaggcagcagtagatttccaggtgggagagaggacccccagaatcccaccagacccagctctccttcctggtgctgttcttgaggccctggataattgcctttcaccatacgtgagtcatctttcttgagtcaaggtgaacctcacttccaaggaatccccattcttgtaggacactctgtgcttcctggtctctccaggagctggctaaaattctatgctttttcattggaatactgagatagacagaagtgcagtttttttacaagtgtctttatccagccatggcattaatttcccgtttggtaggaggacaatagtcttattttcatcagtatgtgtagtgcatgttagtgcacagcatgaaccttagaggaagacttctaccttgagatgtgaaatgcatcaatacttgtgtggagttaataaacctgctctacctccacaagtgtcagcttcctcacccatacaatggggatcacacaacgacttcttcaagttgttgccagagttacattcaccaagatatttaaaagtacctaactacaagggtccacagcattaataaaactgcatcagacttcaatgcacacaaaaggaataaagtacatgcgtccaaagacgagatgagcagctttctaagcagcctgatgagcatcagaatgagatctacatttaagtagaattcttcacagctccactgaagaggacacacatgggggctccaagaagataagcacatggccattgcacagtaactggtgtagtgtggatggaatccctgaagaccctctgaaatatcattacacaactggctctcagggaacactggaacaaatcaggaaactcagcagatgctaccaggaactgggtgagcagaggggggtcacatccacaaatttaagcagaagacaccaaaccgcaaggagctcctggctctgcaacagcagctgtggtggcatcggggccaatcttctgagacagctgctgtgggattgctgagaccatgtgtttttgcagccacacacccaaaagcagtgcatttgaaaacggatcacaacactctcctctccattcatctttgttttaagatgactgatgatggataccctcacattgcaacatccccaccaacacttgtggacaatcgtatttagaaaatcccacctaaagagggaacagtcaggagtaggatgagaatattgagggatgggggagagatgcgggtacttcaccccagactctgtttgaaacaagagccattgtgctgtggtctccctatacttcctcattttgccgcattcgtagatgccacctggtttttgtccctttacttacaaaggtgctgatgagcccatgggtggttaatcctgaaggaggaaattcttcacaaaatacaataacagagtctaatttcaatgaccaggttttttagtttttttttttttttcatagtatcccacattaaaaatcacaaatgaaacctgttggaatgtgtgatatgaacaaagtcttattttcatgcagattaacaacttggcttttacggattacacataaaagcataaaagctggtaccatcccagaatcaaaggaacagtcccagaggacatacggaatttagtgacatcaattattaagaggctacacgaaactggaagtgctcccagaagttttcattgtctagacagaaaaattcaagacatcagccccagcgagtaaaggtacgtcccctggctgccgtgggtgatgagcttttcattcaaagcagagatatgaagcctgaggtgtctcaaagtcaccccaagtgctccacaccttgaaagtcactcccacaaagctggaacaccatctgttcctgaaggatcaggtcatgacctgtatctttgagacactgggcagtcaggcctcagttgagatgaagccaatgatttcaagtgtaaaatacctaaaaccaaatctttaggtatctattagcagccccgtccacttaaatgggttggtgaacatggcccatcagacagacacacacctgagcactggggttttctcctctgttcttagcatcccctgggtaaaccagtaattaccctccctcatgcctcaacgttcacatctgtgaaaaaggtgatggggagagtggcctttccaggaaagcggagcacatgtcaacacctgctaagctctgaatttgtgcgtgggcccaggcgacggatttctccagaaagcggctgaactgggactctggctgaagagagcggaggtcagcagcacaatgcacagcccctgggacctcaggccagttccatagcagcttaggaaagcagttgggtccctaggctggaggaggcccggtgctctggaaagatccagggtgcgggtggagaggaaacggagctgagcagtgagaggtggggtgagcaccacgtccatccggtttgggcaaaggcaaggtgtcctttgcagtgtcacaccctcctcactactgagcccagaactgcctctcatggccttctccagactcacttcccatggccaggaggtggcacatgatcagtagccggcacatgatcagtagccagcatcattcttctatacagttaacttcttattgactaccgtctctcggctgtgctatcaaataggacgtcttattcagtctttctaactatgtttttggtacccattaccatccccacatcccccaagctccccactacccttcccagcctctggtaaccatccttctactctctgtgtccatgagttgaattgtttggatttttagatcccacaaataagtgagaacaattgatgtttgtctttctgtgaatggattatttcacttaacatattgatctccagttccattcatggttttgcaaatgagtggctctcaattttttttatggctgaagagtactcccttgtgtgtatgtgccacattttcttcattcctctgttgctggacgcttaggttgcttccaaatcttagctattgtgaacagtgctgcaacacacatgggagtgcagatatctcttcgatatactgctttcatttctttggggcataaacccagcaataggattgcttgatcatatggaagctctatttttagtttgtagagaaacctccaaactgttctccgtagtggttgtatattacattcccactgacagtgtatgagggttcccttttctccacatcttcgccagcatttggtatttcgtgactgttggttaaaagccatttgaactggagtgagatgatatctcattgtagttttgattggcatttctccaaagatcagcgatgctgagcaccttctcacatgcctgttttccatttgtatgtcttcctttgagaaatgtccactcaaatcttttggtgatttcttgatcagatattagattttttccgatagaattgtttgagcttcccgtatactctggttattaatccctcgtgagacgggtagtttgcaaatattttgtcccattctgtgtgctgtctcttcaatgtgttgattgtatcctctgctgtgcagaagcttttgaacttgatgtgatctcatttgcccgtgtttgctttggatgcctgtgcttgtggggcattactcaagaaattttcgcccagggaaatctacaatctaaatgtcttgtagagtttcctcaatattttattgtagtagtttcatagtttgaaagcttagatttctttaacccattctgatttgatttttgtatatggtgagagataggggtctagattcattcttctgcatatggatatccaggtttcccagtaccatttattaatgagactgtctttccccagtgtatgttcttggcacctttgtggaaagtgagttcactgtaagtgtgtgggtttgtttctgctttctgtattctgttcaatgggtctatacgtctgttttaatgtcagtaccgtgctgtttgggttactatctctctgtagtatgatttgaagtcaggtaatgtgagtcctccagatttgttcttttttgtttagaatagcttggctattctgggtcacttgtggttccatatgaattttgtgattgctttatccatttctgtgagaaatgtcactgtctgttgttgtttgttttttttttttagggattgcactgaatctgcagattgcttgcttgtatatgttttagaatgagttttgctagctagtgtccttcaaataattttttctttcaatataaatataagtttttggataacatttcttgaaaggttccctgttgtacatttaatatctaaaggatctgtattgacgtaacgaccctctgggtttgctgatattaatatttgtagtctctgtgtctccctctctcatcagtctggataaaggtttattaattcgagttgtcttctcaaagaaacaatgtctgggtttcactgataatttctatagatttttatcaattctatttaattcatttttcctcatgtcttttaaattttttccttctttttttctcctttttttttttttttttttaacagaatctcgcactgtcacccaggctggagtgcagtggcatgatctcggctcactgcagcctgcacctcccaggttgaagagattctcctgccttagcctcccgagtagctgaaactataggcgtgcaccaccagcccagctaacttttgtatttttagtagagaccgggtttcaccatgttggccaggctggtctcgaactccagacctcaggggatcggccacctcagcctccaagagtgctgggattacaggcatgagccactgtgcacggtctaacagttttccttctgactttgggtataatttgatttcatttttctagtttcttaatgtggaaacctagataattgatttgagacttttcttcctttctggcataagtattgaagggtataaatttccctctatgctttagtttcatcttgcaaagtttgataagttgagttttcattttaaaattttttcctgcaatttcttctttgatctctgagttacttaaatgtgacatttaatttccaagatttcatgagttgcagacatctttctacaactaatttccatttcaattctttttttggtcatagaacatgttttataacatttcattccttttgaatttgttgagatttgttttttggcccacaatatggtctatcttggtgaacattctatgagcacttgagaagaatgtgcattctgctgttgatctatgaatatcaattaggccatgctgtctgatagtgttgttcaagccttctgcatttatatatcctgattttttgtacactttttctaccaaatgctgggagtaatggggaagtcttctactaaaggcacatgtgtttatttcttctttgtgatgatgtatcagttgtccctcaagtattttgaagttgcctacatatccgtggtgtttctgtcttctgaatcaatgcacctctctatgattattatgtaatgtcccactttgtcccttgtagtaatctccactataaagtgtgctttgtgagatactaatttcacactttgagtttatgtgattcatatttgcaggaaatatctttttccatcttttacttgtatcttatttatttgtagagtggggctctttttttcaagatacagattactgataaatatactgtgaaaatcaagatcctcttgcaactgtgcaacaacaataaaagtaccgaaaaattagatgcagaagttaatatacaactaaaatgttacgcagaaatccacagaataatctgctcggctcttcaaaagaacctcaatcaaactctttgacagccttcatagaaagatatcttcacattaaagtggtatatttatatgaaaaatataattttatccccctattttctacagtagggttttgggtaaaatttcatttcacgaaggtgttcttttgctaaaaatcctttgagaaacaactatataaaatgatctctcagagctctcttagctttgaaatgtggagattcaaatatccctctgtagattgaggaggagatgtaaaaaaaaaaaacaaaacaaaacaaaacaaaaaacaaaaaaaaccacgggggaggaaatgttggtctcctgcacttttcttttctttttcttcctagactaaccagtttgtgttggtcctccgctgagctgttaatccagggaagagttgcccttctgaagaatatgtggatttaatggagaccaaggcaggtttgaatcgctcagaaacaacagccagaataacttttgaagggctgtaaatgaagatgattcaaatcctctgatttatgttacttttcactcaagtttctaaaagtgccttcccatcaagagctgtttggctagggacagaaacgtttgttcagccctatttttctcttccttccttccttccttccttccttccttccttccttcctgcctcccttcctgcctccctccctccctcctttacttctttccaccctccctccctcgctccatttgtccttattttctcccttcctccctggctcccttcatgcctcactcccttccttctttcctaccttttataaaaagaagtgaactgatatttgtaaagtagaaagatcagaagagttcacaattattttcgagttttcttttaacttttattttgggttcagggtgcatgtgcaggtttgtaatataggtaaactcatgtcatggggtttgttgtacagattatttcatcacccaggtagtaaggccagtgcccattagttattttgttgatcctctccctcctcccagcctctaccctctgataagccccagcgtgttggccctctctgggtgtccatgtgttctcagcaattagctcccatttataagtgacttcatgtggtattgggttttctgctcctgcattagtttgctaaggataatggcctccagctccatccgtgttcctggaaaggacatgatctcactgttttttacggctgcatagtactccatggtgtatatgtaccacattttaaaaagtgcagtctgttattgatgggcatttaggttgatcccatgtctttgctattgtgagtagtgctacaatgatcatacatgtgcatgcgtctttataatagaaaggtttatgtacctttgggtatagtcccagcaatgggattgcagggccaaatggtatttctgttcttaagtccgtgaggaattgccacactcctttccacaatggttgaactaatttatactccaaccaacagggtataagcgttgccttttctgcacaaactcaccagcgtctgttatttttgttcttgctttttatccagccttatagactctgactctgttttttgagacaggatgtctttctgtctgtgaacgtgaattccgctggtgtctgagacttgccaggattccagctctctcaaatgcctgtgttcgaactttatgaatttgctacattttcactggttttcttcttaccccctgttatggctgtcacttcttccacacatgctctgccacaggtgatgcagtttgtttgtctcatccctcctcagagggactaagtcaccattttggatcagttcccatggctgccttgttacctcaggtctctcatgatctaaaaacaaagcaaaacaaaagataacgttatagattattaggctgtttttcattttcaaggctaaagtgactttctcttgaggctttctaaatcttacctggtggtagaactctcctttgttaatcttttgactactggtacaaaaatacagcattcaaatatgtgaagtaaaagataatccaggggctagctgactatggcttgagatctaaatacagcccatggcttgttttgcatagccattgagataaggatttttttccatttaaaagtattattgctaaaaaacacaacactacgccacagaaactacatgacccacaaagactgaaataattacgatcagatctgttaaagcaaaatttggtgatgccgtattaatcaaatacctgttattctgctttgcattattgcatacatcttttcatccattaattaatttatttacacacggattgaaaatatggatgttactctatcccctcaagaaagcgtccagctttatgataccatgatttcagtctgggaaacttgtcccagggatcaggtcaatacacaaacatacatttgaggtaggagactggcaggacttgttttctggtcataactgagcctagagcctacagtcagaatctatggctatttctgaaacatatactgtctgaatgacctacaggtatattcagggaaatcagttaccagtccagagatttaaatgtgaagtaacacaacctaaaaagaaaagagtaaacaggtgtgaatgtatttattctacagaagaatttattcaattacgtttattggaagcatggcagaaaacccagaaccagagaacaaagtgattaataaaagcatttataaaactggccaaggtgggaggatcacttgagcccaggaaattgagaccagcatgggcaacacagtgagaccactatctaaaaaataaataaataataaataaaccaattacccaggtgtggtgtctgcacctgtagtagcagggactggggaggctacatcgggaggattgtttgagcccaggagatggaggcttcagtgaggtatggtcatgccactgccctccagcctgagcaacagagtgacactctgtctggaaaaaaaaataaataaaaacggctttataaataaagatatgaaaataatttatttcttccacaaaaggtcttcctgagacacatcctccagtaagggactgtctgttcccaacgtttctgaatgcatgagattggacaaagagagacgaaagctctcaagtccctttttctactacaaacgccatggggatgcgggtctgggaacagcggaaaaccctaccctgccctgaaaagtccctggctcaatgtgcatgtccctttctatgaaagttccttgctgcctatgcgccttgctctctaacttctgtccctccacaactgtgaaaggagacgtcgtgacttccttctttcgtgctgactatgacttagccagtaggtctgcagatcagtcctcccagaaagtgaagtgtgagtgagtgtgagggggagcgtggggggcttcctgtgggttgtgccacttggtccatggcctctgaggtcgtcatctttctactaaaactcagcgatactgccatggccttgctgttgtggggtcccgggcatgggacgaaggagggccatagcggggaggagggtcaggtgagcatggagtgagtttttttttttttttcacggagtcttgctctgtcaccaggctggagtgcagtggcgcaatctcggctcactgtaacctccgcctcccgggttcaagtgattctcctgcctcagcctcccgagtagctgggagtacaggcgcgcacaaccacacccagctaatttttgtatttttcagtagagacgggttttaaccatgttggcgaggatggtctcgatctcttggccacatgatccacccgcctccgccccccaaagtgctgggattacaggcgtgagccaccgcgcccggtcatggagtgagttttgaaggctgactttatttgaggtatttgagtcctggtgggggggaacccacacacagagaggagggattccaaagtcgttaatggggacctgggaaggagcataggacagggcaaggcgggataaggaggggcaccacagcccttaaggcacgagggaacctcactgcgcatgctcctttggtgcccacctcagtgcgcatgttcactgggcgtcttcccatcggccccttcgccagtgtggggaacgcggcggagctgtgagccggcgactcgggtccctgaggtctggattctttctccgctactgagacacggcgggtaggtccacaggcagatccaactgggagttgaagtgtgagtgagagtgaagaggaaccagcaggcttccggagggttgtgtggtcagtgactcagagtgagaaggccctcgaagtcgtcgtccctctcatgcggtgccacgcccatggaccttcttgtctcgtcacggccataactagggaggaaggagggccgaggagtggaggggctcaggcgaagctggggtgctgttgggggtatccgagtcccagaagcacctggaaccccgacagaagattctggactccccagacgggaccaggagagggacggcatgagcggtatggaagggtcctggagacggggcatgctgcgggctagtgaccgcagccccgaggtctgtagagtgcctggcataggggtcctgtgaggagtgcccactgctgtgtagcaaattctcaactccactgtggagattccaatgggcggggccctgagttcctaaaaatgtgactttggggtgggggggaagtgggcctagcaaatcattatgtgacaaaattggtggtcactgcagtttcagttctgtagctgtaatttcctacttgtctccctgatggagtgtccagttgtgaaaccaacctcatgggaaatgccctgtgttttttgccaggagccttaagacatcgctcagctagctagacctacttaagtggctttgcaagcattcgattcaaaaggtgcatacacttatacttgcccggggactttcagagtatttctaaattaaaaaaaaaaaaaatgtccaagttaacatttgaccatgaaagcggtcaaatctagttgtcctgtcaagtgcattttcccaatcgcagtattctgcttgcagagtgaagtatgtgttgatgaggacgatcaacatataggcctatgccaagaagttcacaacctcctgagctcattgtgcctctgcttgtgaatgtcttaacattcgatgttttctcttagcagaaagttatttttctgatagtgttgatggactagtatggatacactgataatggtctcccatgctgataaaaaatgatcatggcatcccatgaaggaaagattagtccagagggttatatttgggttttgtgtgggtggatgatcgtgtgtgcccagattttgtccataacttcctcctcatgcttattcagaacagattacacacattcatcccaacattgattaaaacggcttccaaagtccctgaggatatctgtctttgagtaacctctctgagggaagaatagtgttatgaagattaggtatacggggtagtgttggagaaatgtctctagacatacttataataagacatacctgtgtattctgtatatttatattattgacatgtattaataacaaaactttttatctagacacacacaaacacagaaccacacagccagtcccaggagcccagtaatggagagccccaaaaagaagaaccagcagctgaaagtcgggatcctacacctgggcagcagacagaagaagatcaggatacagctgagatcccaggtgctgggaagggaaagtatgtctatggggcgggagaaggtctatgtgtgcattgtggcctatgccatgagcagtaacaggagcaaagagaacattaggaaaagataccaaacatttgctcaaagttggctggaaaagggagagtatagtttgcagcttcatgctgtccctggatataatgaatcttctcttgttcttcgagatggattttgtatgcttgaaaatacagtccttactaaatcacttgaaaccatttaatttggtgtatagaaatgtacatttttttattatgtggcagaggctcatctgtcacgcagtgtggattgttgtggcatgatcttggctcactgccacctccagctcttgggttcaagcgacctcggcctcccaaagtgctgagattacaggcatgaaccactacgcctggctcaggctttatttcgtaacgcgaaggaagagaatattatcatttccttatttatatttcatgttggaatgcttaaatcgataacctttgtattttgaagtgcgcgacatggaaggtgatctgcaagagctgcatcagtcaaacaccggggataaatctggatttgggttccggcgtcaaggtgaagataatacctaaagaggaacactgtaaaatgccagaagcaggtatgttatccagcaagatgcaaagttatgtgctttctcatttacacagtattatacttttgataatagagggataacattagtgctactttaaaaacacagtgcaaatgcaaatgttctttgaaacgtcgttcagacccaaatgccagattgcaagacttaaacactatcagatacagaaacaaattgggtcaaagccatattgaatcatcaaacgtgacagcattttcttagtttggtgtataaccaacagctaacaattttcagattcttttctaatttctgcttttaacaaacacataatgcatttgtaataccagtttgtgtgaagtatgctgagccctgaagcagattctagtaccagctctaccataatttgtgagagtctggatgaatcgtataaattccacaggcatccttgctcttagtgaaaagagtggatgcacatcagatagattaaaatccatttcgttgctaatttccacatgctctggttctgttggatagaagaccaagatattctgatcttcatgatttgtttatcataacaatcagcttcagtccaattatagtgtctgagttgagatttcatggttcctaggaaaatgagcgggcactctgcttggtgtttgttttcctgtgtggagccctgtatgagtgttcttgtattttgccaaattctgagttctctgtctcttaaagaataattgcattttaaagccttcccgcagtgaagccttgaatgactgaatgataaaatggcaggagatcatcaggtttctgtggccagtgaagtagagagaatgcatgtaggtcagtgatgcccaaggtgggtgtaagatgcttctgctaagcatgctccctgccctcccgtcagtcttcatgaactacttcgtgtaattagattgaagactcatatagtagagtcacctctaaccataccataggttacatattacaggtttctgccttgaggcattagatgatagggtttgaagttcaacaacagcactgtgctagttcctgagtagttgacacaagtatgttttacacatattttccaaattggtgactgttaattacaatacctcttgaagttaaaggaagcaccccatgtttaagggagaaattacctaagtgtttttactgtaccctgctgaaccattccattatactatttacattaaaagatagttctcagacgatttccaggagcccactgaacaagcctcagttgtattcttagggagatcatagctttaaatgcacgtcttattaaaataaatagcacgttacatgttaaaggaaaagaatactatgaaataacaataaaagagccagagaataaacttaaaggaaaaagaaagtggtagtgaataaaagacaggtacgaatcattagtataaggaaaagtagttcaaatgtcataaattgaaaagattggtgttttgaaaattagctacgaatattcagtaatttacacaatcttgaagaaacggaaaaagcacaacatggaatatgaacaagacagagtgatttaatacagggctttattgaaagtgaatacagtcttgaacgctaagattttcagagcatggatgaaatggttggtaagctaggaaggcatgcattatttatttctgtaatacctgattaagcatcacaaagcctgtggaagaaactgtgaaattttccagttgtccctcagaaacatttacttttagaaacaaattttggctttttcagctgtcctactcttgttttccattcccgtatccctccatgtgttcatgtgtgacacagttcataatgctatcacatattgatgacaaaactgatagtgatagcttaagagtaatgcgaccatatacttaattatacaaatgggaatactttcaagtgtaaaaagaggcatgattcatgttgacatcacggtaggagaaaactgggtacaaacggttgctgtaccttaaaaaccacagaagggtaaacgagcccaaataaatatttttgcccttctgcgcaatagagtaaaaacaaatgcaatgctggcctttctattcactttacttattcagttcctaaggtgacagtaaccgttttcttccaagatagtattcagaccatttccaggagcccgtttggcatgcagaccacagattcaagccagaatattaaaagagtgtttgccaaaaattatacatttttcgtaaattccttttttgtttcttaggatttttgtgtggtgctggtattttgagtaaaactatgcacaatgtttgctttctactttaaacccctttttagtaggttcacttcatttaatgtgttcggaccttggactgtcttgctttccttgtagcactagaaagcagggtgtgtttgaaaaacatctttaatgcatacacttggacgactgttgtcaaagtctcttcagaggtctacatgaatgtaagcaaaagggtgactcttaggcttctggttttgtccattgtagaaaactaaaactttggtgtcttttccatatccttaatgtcatttaaacacagttctgctagtaatgttcccacctgttatgcttctgttataggtgaagagcaaccacaagtttaaatgaagacaagctgaaacaacgcaagctggttttatattagatatttgacttaaactatctcaataaagttttgcagctttcaccaaagaagtcttgctcatctttggttcacttccttcccaggtatttgataatattggaaatcgtttctggctgcggttgtccacgcctgtaatcccagcactttgggatgctgaggcaggaggattgcttgagctcagtagtttgagaccagatggggcaacaaagcaagactctctctctacaaaaataaaagagtgaatgcatgaatgtatgcaagtttgtatgtagctatagccccagctactctagagccgaagggtggaggatgcctccagcccaggaggtccaggatgaggttaatttttttttgagatagagactctatttttttttttttttttaaaaattcagtatcatttttgaaattttgtgttctgattgagctggtatgcacaggtgtgatattgtgtaatacatatttggtcctagaccctgcttcctggcatacaactactacaatttttaaaatctccacaaagtggtgtctttttatatgctagtgagttgactcatggctggcagcacctaggtagctctagtttggggaataggagggttggggctttcagctgcccctccccccccccagcattcgggaagaggcagaaggttaatttgatccccagtggcaggacaacagtttaatcagtcacgcctacagaatgaaaacctccatcaaaaccaaaaggacaggattcagacggcttctggctagctgaacatatggagggcagcatgcccctagtgggcacagaagctccctacccctttccccataccttgcgctatgtctctcctcatctgcttcctttcttagggtatcccatttgccacaaaacatgtgagaagtccctaggctatagagctggatgaaagaattagggcctaggtaggagtaagcggcaaggaaccagggcaacttgctgaagcaagatgacgggtcctacctacaccgtctctttagaggctatgtcatgaagtagccatgggtttccatcttgcctctcacacagtgctcttgatatggtggtcaagatacttacaccctttgggactgtttttccatttctaaagttgaatttacaatatgtacactaaaaatacttagtatgaaaaataaaggaaataacatcaaggaggctttacattgcagataaatttggcctgctacttagatttccttttttcctttagatttcaaactttttcatttcatttttccttacaactacatttctggtgtgtgataacctgcttttgaatttcaagtaggaatatcaagttcacttttaaaatacatttgaattcagaaaattatttgatttaaatatgttaatttaatagcagtgtagccggtgtcacccacggcatagattctgaagttgatttgtaaataaccgaggtgttataaagccaactgaatgtcagcaatgtgtgctgaaaacttgtttgctatgtgttatgcgggtggatcacctgaggtcaggagtatgagagcagcctggccaacatggtgaaaccccatctctactaaaaatacaaaaattagccagatgtggtggtatatgcatgtaatctcagctactggggagtccgaggcaggagaatcgcttgaacccaggaggcggggcttgcagtgatcggagatcgtgccattgcactccagtctggaaaataaagagtgaaactctgtcaaaaaaaaaaaggaaggaagaaaggaaggaaggcagacaggaaaagagaaaaagagaaagagaagggaagaaaatgaagaaagaaaaaggggagagagagagagaaggatggagagggggaggaaggaaggaaggaaggaagggaagtccctctgtccgtatttgcagtcactttaaaggcacgtctgtgccatgaacccggatcggcagtcatactctaggtctaagaggcaagtctgaaagacattgcctgcaggcttgacatccttcattattcttgggatgcacgttctccccagggcaccagccaaacaccgaatggcctgacacagagtttgcattttttctcatagttctccttggtcattcagataatatgggttctctctaagacatatctggtgcagaatagagaaggttgcatcctcccagttttgcctgttttaggtgctggaacccagacaggtcgcaatcttgagagggtcggcaggcagcagtagattttcaggtgggaaggaggacccccgcaatcccaccagacacagctcttctttctcatgctgttcttgaggccctgggcaattgcctttgaccgtatatgattcatctttcttgtgtcaaggtgaacctcacttccaaggaatccccattcttgtaggacactctggacttcctggtctctccaagaactggctaaattccatgtttttccatcggaatactgagatagacaaccttgaagtgcagtttctttacaagtgtctttatctggccatgacattaatttcgcatttggtaggagggtaacagtcttattttcatcagtatgttcagtgcatgttagtgtacagcatgaaccttagaggaagacttctacgttgagatgtgaaatgcatcaaaagcttgtgtggagttaataaagctactctacctctacgagtgccagtttcctcacccataaaatgaggatcacaagatgacttcttcaagttgttgccagagttaaattcagaaagatatttaaaagtacctaactgcaagggtccacatcatgaatgaaatagcatcagatttcaaagtacacaaaaggaataaagtacacatgacctaagatgagatgatcagctttctaagcagactgacgagcatcagaatgagatctatatttaagcgatttcttcgcagccccactgaagaggacacacatgggggctccaagaaggtacgtacacggccattgtagaggaactgatgttgtgagggcggaatttgaaatgtcattacacaactggttctcagggagcactggaagaaaccgtgcaacccagcagatactaccaggaattgggtgagcagaggagggtcatggccacaaatctaagcagaagacaccaaaccacaaggagcttctggctctgaaacagcagctgtgatggcataaggagcaatcttctgagatagctgctgtgggattgctgagagcacatgattttgcatcaatacacccaaaagcagtgcatgtgaaaacagatcacaaaactctcccctccattcatctttgttttaccatgaccaatgatggataccctcacgttacaacatccccaccaacacttgtggacaagtatatttagaaactcccacctaaattgggaacgctcaggagtagggtgagaatattgatggatgggtgagggatgtgggttcttcacctcatagactctgtttgaaacaagagaagagctgctgtgctgtggtctccctatacttcctcatcttgccacattcatagatgccacatagtttttgtccctttatttacaaaggggctgatgaacccatgggtaattaatcctgaaggagaaaattcttcacaaagtacaataacagggtctaatttccatggccaagttttttaggtttttttttttttaatagtggctcacattcaggaatcacaaaagaaacctgttggaatgtgtgatatgaacaaggtcttattttgatgtagattagcaactaggcttttacagattagacataaaagcataaaagctggtaccatcccagaatcaaaggaatggtccctgaggacatacggaattagggacatcaattactaagaggctacaggaaactagaagtgctcccagaacttttcattgtccagatagaaaaattcaacaaatctgctctaataagtaaaggtacctccctgactgccatgggtgatgggctttccattccaagcagagaagtgaagcttgaggcccttcaaaagcaccccaagtgctccacaccttgaaagtcattcccacaaagctggaacaccatctgttcctgagggatcaggtcatgatctgtgtctttgagacactggccaaacagactctgagtcctgaatggatcttcactgggtaactgcatctctattcctgcattctgctgagatggttgatggagccatgagtcacatacctcacctcttaagcaatcaattgtccagctacatccttggccatgttttcatggcatgctatctgaataggctgagaatcttccaaatcatcacaggctgatttctttttcttagcagttctgttgttgatttatttctcctctcttggattttgctatcagcagcagggagaaacatggcaacatcttcaatacttggcttagaaatcttagctaaatacccacgttcatcacttgcaaattctactttgcatctaagagtatgcagtttagctaaattctctgcgattttctcataaggaatgtgaatccatgtttccaataacatgttccccattcctgtctgagacctcaccggaagcacctttaacattcatttttctagcaacattctgttcttgatgttggatgtattctctaagatgacagaaattttctgtatagctctcctgtttttttctgagcacttgccagaatttatcttaatgtccatatgtctaccaattgccccttcaaggaagtgtaggctttttctgtcacttactttgaaactcttccagcatctcttcacgacccaattccaaagctactttcatgctgttaggtatttgttagagccgcacttcatttcctggtaccacaatctttgagagttctctagggctgcagtaacaaatcaccacaaactcactggcttcaacaacagacatttattgtatcacagttccggaggctaagagtctgaaatcaaggtgtgggcagggttgactccttctgaggcctgaatggaagaatctgttccatgcctttctcatagtttctgttggcttgctggcaatccttgacattcattgaccagtagatgcatcacccctatctcttccttcatgctcacgtggttttttccctgtgtgcacgtcgtagtccattttgtgttgctataaaggaatacctagaaccaggtaattcataaggaaaagatatttatttagctcacagttctacaaactgagaaattcaagggaatgcatagccctctggctttcggtgagggatttcgatccacatcacaacatggtggagaaggccaaagtggaagtggacacttgtgaagaggggaaaacctgaggggtgtcgtggctttacaacaacccactttaaagggaatgaatccattccttcaagagctactccagcattctgaaactgagaactcacttaccatttcaccaagagatcagcaccaagttattcataagggatccacatccataacccaaactcatcctaacaggccccacctcccaacactgccacgggaagtggggggtcaaatttcttttttttcctttttctttttttgagacagagtcttgctctgttttccagtctacagtacagtggtgcgatctcagctcactgcaaactgtgcttcccaggttcaagtgattctcctgccgcagcctcctgagtagctgggacaacaggtgcatgccaccacttccggctaatttttgtatttttttttttattagatacagagtttcaccatgttggccaaactggttttgaactcctgacctcaggtgatctgcccacctgccttggcctcccaaagtgctgggattacaggcatgagccaccgcaccagggcaagggggtcaaatttcaacatgagttttcctggagacaaaccaaccatacccaagccataccaacgtctgtgtacaaatttccccctcttctaataacaacagtcatattagattaggggcccacccaacctcattatgacctcatctgaaattaattatattttcaataaccctatttccaaataaggtcacattctgcggtacctggggttaggacatcaacatatgaatttttcaggaaacccaaaataaactatgtgtattttgccacaataaaaaatgtttaacctcctcctgtgcagtaaactgcttcaagggcacctttggaaacatctccatgtgaacctcactgtccagaaagcttctttcacaataaacaccatagaaagctcttgacaggtatagtctccacaagaatttgaacaacagccactcccatctcctctgctctcccctgtattgctacttgttgctgctgctgctgctgctggaatgttgataactactcctccctggatcccttgcagagggttgtgcgccacagtttaccaggtattgctaataatatgccctattataaggtttgggaattagaagtaattttttagttctaccaaaaatggttgcagtgtgaatcgtgaatgtggcaaagtttaggcaggtgggaatggcgaatgtgagaattttcagcaggtgcgcatggtgaatatggaatgtttaggcagatgtgcatggtgattgtggaatatttgggcaggtgtgaatcgtgaatgtgaaatgtttgggcaggtgtgaatagtgaatgtgggaatgtttggacaggtatgaatgatgaatgcagaatgttctggcaggtgtgaatggtgaatgtgcgagtgttcaggcaggtgtgaataatgagtgtgcgagtgtttgttatggccccgggattcccctactgatcacctgcctcaggattccaggaggcagagacatttggcagaggtttcctccagttgcctgaccatcaggtatatttcagtggactccaaatctagtatgatttccattatgtctgtaggttttatgagacttgaagattcttcattactattttctgtactgataatttaattaataattttctgtacatataatttaataacacatgaattcatgataagaaatgtaacaaatttgactttctcagttacattccactcaaaaacacatgagttttgtctgtttgactagtacttccattcctggtaaggttcagcaagagctgagatttctgagcttcagtgactacatcctaccttgcaggttacttgcaataatgaaataaatgatagtgataatagtagtaaaaatagtagtaaaagaaggctgggctcagtggctcatgcttataatcccagcactttgggaggctgaggcaggaggatcgcatgagcacaggagttccagaccagcctggagaacatggcgcaaccccccgcccctgtctacaaaaaggttaacaaaatttagtccagtgtggtgtcacacgcctgtactgccagctactaggaagatgacatggcaggatccctggagcaaggagttccagacagtagtgagccatggcaaagtcagtgcactccagtcagggtcacccagtgagacttggtgtcaaaaataatcagttttaatataaaaccaacagtcatactgttacggactgacttctgtctgcacgagattcatatggtgaagtcctaacccctagagcctcagactgtaactgtatgtgagatagatggggtctttaaaaaggtaattaagtgaaatggggtcattagagtagagtctaaggcaatgtgcctggtgcccttacaagaagaggaaatgaggacacagacttgtacagagggagggctaaggcagacacggagaaaacagctgcctgcaaggcaaggagggaggccttagaagaaaccaactctgctgacaccttgatctcagatgtgtagcctccagaattgtgagaaaatacatttttgttgtttaagtcacccagttcatggtagtttttgatggcagccctaacaaaccaatagaaacacttttagtgccgctcagaaggcaagcattatcatatctattttatgagctagaactcctgctcctccaactaatataatgagcatgtaatgatacctgtatctgagcaactgagcagtgatgagaaaacttcaaaactttggaattattttaccttaagtctatgaccacgagagaatcgcttctccctttcgcactcatcctacttccactactacaatactctcacaaattcctaggaaccctcctccatttgaatgacctaccctaatgattccttcagaagacagaagctatctgctgggaattctcagagcatcccaaacccaggctacccctgttgggcctggcattctctgccacccttgtgcatacaatgctcctaacggaagcaagcccctcacctcagctcaggatcccataactcccactttcccaggggctttcctgctgcaatgatcgttcttctctcctgaaccatcaatggctccccctatattggatcactccccaagctaagggggaaactcactttcttcccccatgtccttctatagctacgaatacatttagctgctgcccttcaaagcaaaactgcctcaacatatacaactcacttcactggagtcattttccaaaattacctggcaacaaaaatgaaccagaacagctgaaacaatgctgaactataactttggggaactcacactacctaatagtaagagtgatgttaattctatagtaatcaagagaacgtggtaatttggaaaaatcaacaaatcagaatggagtccagcaatagactcacagacatgatatattgattttcagaaaaggtgcaaaggcaatggagaaagattgtcttttcgtgaaagtgttattttcctcctgcctcttggccactacattgattggtttttattcccctgggtcccttccctgtgtttccccctttgcacttcagctgctcttctgtttagtggcctctctgccccaccacagtgtgacagcccccacagcaagtaccatgtgttgttggttgttcttccaatttccagcatcccaggtatttcttgtaacatggcaggccactcatgcatgtctactgaattgatgaattaaccttttgtaatgatcctaacagaaaagcatctcctgtgtttaggagacattattggagatgatatgtttctaggcaccttacatatggtctttggttttgtgccggacactctagggtaatggctctgtatgttgctctggagctcctgcaggtcaccactaataggggaagtaggcaaagctagactacaagctaacctgagtctgggcacaatatcttgactgcccttggaacaaggaaagataggcagggcggtgggagctgccacaggtatttttgcaccagctccctatctgcctggaggctgacacaaggccattcttcatccgtctccctagtttgaggtaagcacaggcctttcttcatcatagggtacagttgtggagtataaaattgctcactgcctttgggcacaggtgtgggctcctcaccagcagaaagacccactatctgtgctgtccatcactgagtacctccgattcactgtcacactatggaaatagggatacggtgcttacacaatgctgatcttgcttttgctttctctacaagcaatcaaccacttggatctgtttgggctcattgtctccgtattggccaaatttaagaatatgtgaaaaggcaaactaacgactttagtggtgatcctcatggcccttttaggacaacacagggctgcttacggaccgcttgagtaattgacacactactgtattgagttgcgtggtgtagcatagacagaatattgatttagtcttcatggcatcacacacagcaaataagttttcagcacatactattgacttatggttggccttgtaacacctcggttatttacaaatcaacttcagaatctatgccgtgggtgacaccggctacactgctattaaattaacatatttaaatcaaataattttctgaattcaaatgtattttaaaagtgaacttgacattcctacttgaaattcaaaagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttttaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacgatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccgtaaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaaggaaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagcaggttatcacacaccagaaatgtagttgtaaggaaaaatgaaatgaaaaagtttgaaatctaaaggaaaaaaggaaatctaagtagcaggccaaatttatctgcaatgtaaagcctccttgatgttatttcctttatttttcatactaagtatttttagtgtacatattgtaaattcaactttagaaatggaaaaacagtcccaaagggtgtaagtatcttgaccaccatatcaagagcactgtgtgagaggcaagatggaaacccatggctacttcatgacatagcctctaaagagacggtgtaggtaggacccgtcatcttgcttcagcaagttgccctggttccttgccgcttactcctacctaggccctaattctttcatccagctctatagcctagggacttctcacatgttttgtggcaaatgggataccctaagaaaggaagcagatgaggagagacatagcgcaaggtatggggaaaggggtagggagcttctgtgcccactaggggcatgctgccctccatatgttcagctagccagaagccgtctgaatcctgtccttttggttttgatggaggttttcattctgtaggcgtgactgattaaactgttgtcctgccactggggatcaaattaaccttctgcctcttcccgaatgctgggggggggggaggggcagctgaaagccccaaccctcctattccccaaactagagctacctaggtgctgccagccatgagtcaactcactagcatataaaaagacaccactttgtggagattttaaaaattgtagtagttgtatgccaggaagcagggtctaggaccaaatatgtattacacaatatcacacctgtgcataccagctcaatcagaacacaaaatttcaaaaatgatactgaatttttaaaaaaaaaaaaaaatagagtctctatctcaaaaaaaaattaacctcatcctggacctcctgggctggaggcatcctccacccttcggctctagagtagctggggctatagctacatacaaacttgcatacattcatgcattcactcttttatttttgtagagagagagtcttgctttgttgccccatctggtctcaaactactgagctcaagcaatcctcctgcctcagcatcccaaagtgctgggattacaggcgtggacaaccgcagccagaaacgatttccaatattatcaaatacctgggaaggaagtgaaccaaagatgagcaagacttctttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaacgactttggaatccctcctctctgtgtgtgggttcccccccaccaggactcaaatacctcaaataaagtcagccttcaaaactcactccatgaccgggcgcggtggctcacgcctgtaatcccagcactttggggggcggaggcgggtggatcatgtggccaagagatcgagaccatcctcgccaacatggttaaaacccgtctctactgaaaaatacaaaaattagctgggtgtggttgtgcgcgcctgtactcccagctactcgggaggctgaggcaggagaatcacttgaacccgggaggcggaggttacagtgagccgagattgcgccactgcactccagcctggtgacagagcaagactccgtgaaaaaaaaaaaaaaaactcactccatgctcacctgaccctcctccccgctatggccctccttcgtcccatgcccgggaccccacaacagcaaggccatggcagtatcgctgagttttagtagaaagatgacgacctcagaggccatggaccaagtggcacaacccacaggaagccccccacgctccccctcacactcactcacacttcactttctgggaggactgatctgcagacctactggctaagtcatagtcagcacgaaagaaggaagtcacgacgtctcctttcacagttgtggagggacagaagttagagagcaaggcgcataggcagcaaggaactttcatagaaagggacatgcacattgagccagggacttttcagggcagggtagggttttccgctgttcccagacccgcatccccatggcgtttgtagtagaaaaagggacttgagagctttcgtctctctttgtccaatctcatgcattcagaaacgttgggaacagacagtcccttactggaggatgtgtctcaggaagaccttttgtggaagaaataaattattttcatatctttatttataaagccgtttttatttatttttttttccagacagagtgtcactctgttgctcaggctggagggcagtggcatgaccatacctcactgaagcctccatctcctgggctcaaacaatcctcccgatgtagcctccccagtccctgctactacaggtgcagacaccacacctgggtaattggtttatttattatttatttattttttagatagtggtctcactgtgttgcccatgctggtctcaatttcctgggctcaagtgatcctcccaccttggccagttttataaatgcttttattaatcactttgttctctggttctgggttttctgccatgcttccaataaacgtaattgaataaattcttctgtagaataaatacattcacacctgtttactcttttctttttaggttgtgttacttcacatttaaatctctggactggtaactgatttccctgaatatacctgtaggtcattcagacagtatatgtttcagaaatagccatagattctgactgtaggctctaggctcagttatgaccagaaaacaagtcctgccagtctcctacctcaaatgtatgtttgtgtattgacctgatccctgggacaagtttcccagactgaaatcatggtatcataaagctggacgctttcttgaggggatagagtaacatccatattttcaatccgtgtgtaaataaattaattaatggatgaaaagatgtatgcaataatgcaaagcagaataacaggtatttgattaatacggcatcaccaaattttgctttaacagatctgatcgtaattatttcagtctttgtgggtcatgtagtttctgtggcgtagtgttgtgttttttagcaataatacttttaaatggaaaaaaatccttatctcaatggctatgcaaaacaagccatgggctgtatttagatctcaagccatagtcagctagcccctggattatcttttacttcacatatttgaatgctgtatttttgtaccagtagtcaaaagattaacaaaggagagttctaccaccaggtaagatttagaaagcctcaagagaaagtcactttagccttgaaaatgaaaaacagcctaataatctataacgttatcttttgttttgctttgtttttagatcatgagagacctgaggtaacaaggcagccatgggaactgatccaaaatggtgacttagtccctctgaggagggatgagacaaacaaactgcatcacctgtggcagagcatgtgtggaagaagtgacagccataacagggggtaagaagaaaaccagtgaaaatgtagcaaattcataaagttcgaacacaggcatttgagagagctggaatcctggcaagtctcagacaccagcggaattcacgttcacagacagaaagacatcctgtctcaaaaaacagagtcagagtctataaggctggataaaaagcaagaacaaaaataacagacgctggtgagtttgtgcagaaaaggcaacgcttataccctgttggttggagtataaattagttcaaccattgtggaaaggagtgtggcaattcctcacggacttaagaacagaaataccatttggccctgcaatcccattgctgggactatacccaaaggtacataaacctttctattataaagacgcatgcacatgtatgatcattgtagcactactcacaatagcaaagacatgggatcaacctaaatgcccatcaataacagactgcactttttaaaatgtggtacatatacaccatggagtactatgcagccgtaaaaaacagtgagatcatgtcctttccaggaacacggatggagctggaggccattatccttagcaaactaatgcaggagcagaaaacccaataccacatgaagtcacttataaatgggagctaattgctgagaacacatggacacccagagagggccaacacgctggggcttatcagagggtagaggctgggaggagggagaggatcaacaaaataactaatgggcactggccttactacctgggtgatgaaataatctgtacaacaaaccccatgacatgagtttacctatattacaaacctgcacatgcaccctgaacccaaaataaaagttaaaagaaaactcgaaaataattgtgaactcttctgatctttctactttacaaatatcagttcacttctttttataaaaggtaggaaagaaggaagggagtgaggcatgaagggagccagggaggaagggagaaaataaggacaaatggagcgagggagggagggtggaaagaagtaaaggagggagggagggaggcaggaagggaggcaggaaggaaggaaggaaggaaggaaggaaggaaggaaggaaggaaggaaggaaggaaggaagagaaaaatagggctgaacaaacgtttctgtccctagccaaacagctcttgatgggaaggcacttttagaaacttgagtgaaaagtaacataaatcagaggatttgaatcatcttcatttacagcccttcaaaagttattctggctgttgtttctgagcgattcaaacctgccttggtctccattaaatccacatattcttcagaagggcaactcttccctggattaacagctcagcggaggaccaacacaaactggttagtctaggaagaaaaagaaaagaaaagtgcaggagaccaacatttcctcccccgtggttttttttgtttttttttttgttttgttttgttttttttttttacatctcctcctcaatctacagagggatatttgaatctccacatttcaaagctaagagagctctgagagatcattttatatagttgtttctcaaaggatttttagcaaaagaacaccttcgtgaaatgaaattttacccaaaaccctactgtagaaaatagggggataaaattatatttttcatataaatataccactttaatgtgaagatatctttctatgaaggctgtcaaagagtttgattgaggttcttttgaagagccgagcagattattctgtggatttctgcgtaacattttagttgtatattaacttctgcatctaatttttcggtacttttattgttgttgcacagttgcaagaggatcttgattttcacagtatatttatcagtaatctgtatcttgaaaaaaagagccccactctacaaataaataagatacaagtaaaagatggaaaaagatatttcctgcaaatatgaatcacataaactcaaagtgtgaaattagtatctcacaaagcacactttatagtggagattactacaagggacaaagtgggacattacataataatcatagagaggtgcattgattcagaagacagaaacaccacggatatgtaggcaacttcaaaatacttgagggacaactgatacatcatcacaaagaagaaataaacacatgtgcctttagtagaagacttccccattactcccagcatttggtagaaaaagtgtacaaaaaatcaggatatataaatgcagaaggcttgaacaacactatcagacagcatggcctaattgatattcatagatcaacagcagaatgcacattcttctcaagtgctcatagaatgttcaccaagatagaccatattgtgggccaaaaaacaaatctcaacaaattcaaaaggaatgaaatgttataaaacatgttctatgaccaaaaaaagaattgaaatggaaattagttgtagaaagatgtctgcaactcatgaaatcttggaaattaaatgtcacatttaagtaactcagagatcaaagaagaaattgcaggaaaaaattttaaaatgaaaactcaacttatcaaactttgcaagatgaaactaaagcatagagggaaatttatacccttcaatacttatgccagaaaggaagaaaagtctcaaatcaattatctaggtttccacattaagaaactagaaaaatgaaatcaaattatacccaaagtcagaaggaaaactgttagaccgtgcacagtggctcatgcctgtaatcccagcactcttggaggctgaggtggccgatcccctgaggtctggagttcgagaccagcctggccaacatggtgaaacccggtctctactaaaaatacaaaagttagctgggctggtggtgcacgcctatagtttcagctactcgggaggctaaggcaggagaatctcttcaacctgggaggtgcaggctgcagtgagccgagatcatgccactgcactccagcctgggtgacagtgcgagattctgttaaaaaaaaaaaaaaaaaaaaggagaaaaaaagaaggaaaaaatttaaaagacatgaggaaaaatgaattaaatagaattgataaaaatctatagaaattatcagtgaaacccagacattgtttctttgagaagacaactcgaattaataaacctttatccagactgatgagagagggagacacagagactacaaatattaatatcagcaaacccagagggtcgttacgtcaatacagatcctttagatattaaatgtacaacagggaacctttcaagaaatgttatccaaaaacttatatttatattgaaagaaaaaattatttgaaggacactagctagcaaaactcattctaaaacatatacaagcaagcaatctgcagattcagtgcaatccctaaaaaaaaaaaacaaacaacaacagacagtgacatttctcacagaaatggataaagcaatcacaaaattcatatggaaccacaagtgacccagaatagccaagctattctaaacaaaaaagaacaaatctggaggactcacattacctgacttcaaatcatactacagagagatagtaacccaaacagcacggtactgacattaaaacagacgtatagacccattgaacagaatacagaaagcagaaacaaacccacacacttacagtgaactcactttccacaaaggtgccaagaacatacactggggaaagacagtctcattaataaatggtactgggaaacctggatatccatatgcagaagaatgaatctagacccctatctctcaccatatacaaaaatcaaatcagaatgggttaaagaaatctaagctttcaaactatgaaactactacaataaaatattgaggaaactctacaagacatttagattgtagatttccctgggcgaaaatttcttgagtaatgccccacaagcacaggcatccaaagcaaacacgggcaaatgagatcacatcaagttcaaaagcttctgcacagcagaggatacaatcaacacattgaagagacagcacacagaatgggacaaaatatttgcaaactacccgtctcacgagggattaataaccagagtatacgggaagctcaaacaattctatcggaaaaaatctaatatctgatcaagaaatcaccaaaagatttgagtggacatttctcaaaggaagacatacaaatggaaaacaggcatgtgagaaggtgctcagcatcgctgatctttggagaaatgccaatcaaaactacaatgagatatcatctcactccagttcaaatggcttttaaccaacagtcacgaaataccaaatgctggcgaagatgtggagaaaagggaaccctcatacactgtcagtgggaatgtaatatacaaccactacggagaacagtttggaggtttctctacaaactaaaaatagagcttccatatgatcaagcaatcctattgctgggtttatgccccaaagaaatgaaagcagtatatcgaagagatatctgcactcccatgtgtgttgcagcactgttcacaatagctaagatttggaagcaacctaagcgtccagcaacagaggaatgaagaaaatgtggcacatacacacaagggagtactcttcagccataaaaaaaattgagagccactcatttgcaaaaccatgaatggaactggagatcaatatgttaagtgaaataatccattcacagaaagacaaacatcaattgttctcacttatttgtgggatctaaaaatccaaacaattcaactcatggacacagagagtagaaggatggttaccagaggctgggaagggtagtggggagcttgggggatgtggggatggtaatgggtaccaaaaacatagttagaaagactgaataagacgtcctatttgatagcacagccgagagacggtagtcaataagaagttaactgtatagaagaatgatgctggctactgatcatgtgccggctactgatcatgtgccacctcctggccatgggaagtgagtctggagaaggccatgagaggcagttctgggctcagtagtgaggagggtgtgacactgcaaaggacaccttgcctttgcccaaaccggatggacgtggtgctcaccccacctctcactgctcagctccgtttcctctccacccgcaccctggatctttccagagcaccgggcctcctccagcctagggacccaactgctttcctaagctgctatggaactggcctgaggtcccaggggctgtgcattgtgctgctgacctccgctctcttcagccagagtcccagttcagccgctttctggagaaatccgtcgcctgggcccacgcacaaattcagagcttagcaggtgttgacatgtgctccgctttcctggaaaggccactctccccatcacctttttcacagatgtgaacgttgaggcatgagggagggtaattactggtttacccaggggatgctaagaacagaggagaaaaccccagtgctcaggtgtgtgtctgtctgatgggccatgttcaccaacccatttaagtggacggggctgctaatagatacctaaagatttggttttaggtattttacacttgaaatcattggcttcatctcaactgaggcctgactgcccagtgtctcaaagatacaggtcatgacctgatccttcaggaacagatggtgttccagctttgtgggagtgactttcaaggtgtggagcacttggggtgactttgagacacctcaggcttcatatctctgctttgaatgaaaagctcatcacccacggcagccaggggacgtacctttactcgctggggctgatgtcttgaatttttctgtctagacaatgaaaacttctgggagcacttccagtttcgtgtagcctcttaataattgatgtcactaaattccgtatgtcctctgggactgttcctttgattctgggatggtaccagcttttatgcttttatgtgtaatccgtaaaagccaagttgttaatctgcatgaaaataagactttgttcatatcacacattccaacaggtttcatttgtgatttttaatgtgggatactatgaaaaaaaaaaaaaaactaaaaaacctggtcattgaaattagactctgttattgtattttgtgaagaatttcctccttcaggattaaccacccatgggctcatcagcacctttgtaagtaaagggacaaaaaccaggtggcatctacgaatgcggcaaaatgaggaagtatagggagaccacagcacaatggctcttgtttcaaacagagtctggggtgaagtacccgcatctctcccccatccctcaatattctcatcctactcctgactgttccctctttaggtgggattttctaaatacgattgtccacaagtgttggtggggatgttgcaatgtgagggtatccatcatcagtcatcttaaaacaaagatgaatggagaggagagtgttgtgatccgttttcaaatgcactgcttttgggtgtgtggctgcaaaaacacatggtctcagcaatcccacagcagctgtctcagaagattggccccgatgccaccacagctgctgttgcagagccaggagctccttgcggtttggtgtcttctgcttaaatttgtggatgtgacccccctctgctcacccagttcctggtagcatctgctgagtttcctgatttgttccagtgttccctgagagccagttgtgtaatgatatttcagagggtcttcagggattccatccacactacaccagttactgtgcaatggccatgtgcttatcttcttggagcccccatgtgtgtcctcttcagtggagctgtgaagaattctacttaaatgtagatctcattctgatgctcatcaggctgcttagaaagctgctcatctcgtctttggacgcatgtactttattccttttgtgtgcattgaagtctgatgcagttttattaatgctgtggacccttgtagttaggtacttttaaatatcttggtgaatgtaactctggcaacaacttgaagaagtcgttgtgtgatccccattgtatgggtgaggaagctgacacttgtggaggtagagcaggtttattaactccacacaagtattgatgcatttcacatctcaaggtagaagtcttcctctaaggttcatgctgtgcactaacatgcactacacatactgatgaaaataagactattgtcctcctaccaaacgggaaattaatgccatggctggataaagacacttgtaaaaaaactgcacttctgtctatctcagtattccaatgaaaaagcatagaattttagccagctcctggagagaccaggaagcacagagtgtcctacaagaatggggattccttggaagtgaggttcaccttgactcaagaaagatgactcacgtatggtgaaaggcaattatccagggcctcaagaacagcaccaggaaggagagctgggtctggtgggattctgggggtcctctctcccacctggaaatctactgctgcctgccgaccctctcaagatggcgacctctctgggttccagcgcctaaaacaggcaaaactgggaggacgtcgatttctccattctgtgccagatatgtctcagagaaacatgaccaaggagaactatgagaaaaaatgcaaactctgtcaggccattcagtgtttggctggtgcccgggggagcacatgcatcccaagaagactgaagggggccaagcctgcaggaaatgtctgtcagacttgcctcttagacctagagtatgactgcccatacaggttcatgacacagacttgcctttaaaggtgactgcagatatggacagaggaatttctaaccctgatagaacatggccagttgctctgctggggaaagccacgtccagtagtgagatgctgctcaaactggcccggaccacactgtactggctgaggaataagccttacatttgttctgtccaggtgaaaggagaggactgtccgtaaagacatgagaagcctgcagatcccgatgaccccctcttgctggtcaaaatattaaagatcgatattgtggaaacaatgaccctgtagcagataagcttctaaagcaggcttcaaccacgcttcatcttgaatcaccagcagagaaggattccaccagagtgtatgttggtgatctggcggataccattactcagacagatttaagaaattgtctctgcctgttggtgagatccggatggtcaccgttgtgcagagatagcagtgtgcctttcatccagctttccacagggtggctacagaagtgggtgccgacaagtcctctaataaactgattgtcaatggctgcagactccgtgtaaaatggggacgattccaagcactcaaggggaaaaaaaaaaaaaaaaaacaaaaaaaaaaacaaaacaaaaaacaggttgcgggggacagaatcacagaatctgggatcctgccagagcctattccagtgccgccaggagctccttctccccctgcagctatggtgcctactttggagcctgcttacatggactgaggccaccttttctgacttttcccagtggcaaaatgcacctgacaaggagaatagacgtaggaacctggcctcctggaccctcacttgcccaggatttttcttggtgctgtgagctgaaggagttcttgtaagatggaagcagggccccaggatcatgtgattggcctcatgtctctgcctcactaatggtcaggtggtgggcactcagggcctgggaacccagccatccctgattccttgagttgatgaggcagggggctggcccacctgctcctgccccaccatggccgtcgtggatggttgctctttgagcctggtaacgtcactggcttggctctgccaggcatgcacaggccctgcgtacccacacactgctttaaggggcttgccctgccttgggccacagtctagttctggccagtgtcccaggaactcagtcccctgtgtatccatcttagctgtttctggggcacccatggctcccctgggtcctttttctcttagggctttggttggggagggcttgggctggatcgcagccccatggctctaggacgcttgccatgtgagagaggctctgtcacacgaatgggcagacatgaggacatgtgatatgctgctggctggctggggctgtgcagatgccacagtcactctcccctccagcagcctctgagggcccagcttccccattgatattgatcccatatggcctagcagtagtactgactgctttggggctgtgcaggtcactatcctcagagaaacgtcagatccagatgccaccatgcaaggggagtttctgtggtcctacctctgggttttcagtggggtgggccgggtctggttgttggagccctgctggggttgcagggatgggcctgtccattggtcctggcgatgtccagagcagatgtggaaggaataggagttcagcatgcctgctcaaagctgcactgtagaaaccatgagccctggatgtccaggtacatggggagttttgggagaggacacccacacagaaatcgcccaaaatcctggggtctgtcctgagataggaacagacttgctgcactctgggcggctgagcccccagagagtgtcctgctgcccggggctctgcagaagtcccctcatgctgctgggccttggcctcagggtcagcttctggacttctggagctgggctggtgggccacggagggccagcccatcccccttggggagggtctgcatgctgagggatgcccacagaggcctgggtgccagggacactcgctccaggcccaggaccttcctagggatctttgcgggtttggctgaaagaaaagcagatttggtccacttctccaccaagcccatttgttccttgcagggctgggcctcatgaacctgggcccctggagttttgggggtctctagtggcccacctggtgtgacactgaggaaacacccacaggctgctgaacccagagtgaggggtgcgtgcagcttggggcatggttgctgtcagagcatctcaggctgctcctgagacggaccccagggttcaggctggctcggggctccaggcctcataccctcaccccagggcggctcggtctgggcttcagccctggtgcagaacccagctgggagaggccttacctgtcacctggcccccttgccacctaagatgaggatctgtctccatagcgcgtgagacgctcctgggcactgggcccctctgccatcccggacaatccacgccatgccatgacttcccacaccaaggggcctactgcaccgtttccctgaatcctctctctgggtctgagacactgattctctccattccctggctcaaggcttgccgtcgtgacacacttggaggggtgcttgtgagtgaggcgcccctgctgttctctggcgttggtgctggcagctgtgggtgttggctcgcacagatgggaccaacccctccagtgccccctagggttcttctaggccaggaggggaagggtgtgggggaggggcttggaggggtcttgccctcatcccatgccctgtcactgaggcgagtctagcacctgccctggggcccagctggcctgttttcagaaacttctttgagaaggaagaggaaaaggaggaaggcccagggagtagggatggagggttctgggcactccccatgatttaatgcctcagagggtgactcgggaggctggagcccacgtgggatgcaggtcgcagtgtgtccttctcaactcgaccatggaggcctgagcaccacgtggtcctcaagagtccaggcctgagacagcatgtcctgaaggagctcccatgggccaaagagagacagcttcaggagatgttctaggaatggggctgcacatcaggccaggtggggtctcctgggagaggtctgtgccttcacctcgtttctgctctgggcacttcccagtgggcagtgctgggccccttttggacaaccctggggtccagctgtgcacaggaggccatggatgcagggaaggcccaggcaggggaatgctcaccacgctcctgcctttcatctgtgtcgtgtcaggggtgggctcagtttccagaaggactcacggtgccctgcacagctgaccaggcctggcttggcttggccttccctctaggccagagcagagggtcgtgtggacagtgcaagtgctgccctcaggacagttgaggtctgtcttgtgtggtcctcctgctaccttcaggcacatggggacaagtttctatgaactttgaatgccgcttatgtcctggctgtgagcttgtgctcgccctgcagaaggcagacctcccagagcctcaggatgagcccaaaaggggtctgtggggacagcaggcctgggaggacctggcctgtcaaggctgatggctggtggagtgagcagagcctattgggatcccagtctgtagtgccggggacccactctgcacagtatcagaccccccttcccaatgaggctatgtcagacaagatcctgcagatcctcatgggggtcgactcatctcagtgggatgtggcccctggaagaaggggctccccaagttctctcccaaggtgagtcctagcccagtctgcacacgatgccggctctgagccccagcccctgctgtgggatgtcggcatggtttctgtgccctgcagggacgtgcctctgcctcctgtgcagaggagacgagcaggatcattctggaggggtcagaaccctacagcggggaagccaggcactgtgggcagcagggtcactggactggggagggggggcggtctcctgtgcatccttgccccatcaattgagtgctgtgggaagcacattaaggtggcagtctgggtgcacaacatttccttgtcctcatggaaggagcagaggtgttcagagcccctaggacttccctgaaagcctccccgttcccgggccctctgcagtccctacccaatgccagaactccaggcagtaggctgggctgtcaccctcttctctgagacacctacctcgactcagagacctccccgatgcccttcagatggggaccctccataggccttatttgatgctgtagcgctcttggagcacgcatggtttctgaaggcgtggctcacgtccaggccattctggtgtacattcactgaggacagcttgccctgctccatcattttctgtagagcagggccaagagggggacccaccctcataacagacacaagactcactgccgaaacagctgtcataaaacagcagttctggaaggaaaagaggctttttctgcaaaaaacttctcctccttgtttccaaaggcagggaaagccatcagagcccagctcacctgtggagcccaggtcactatctatccgggatttgtgactggccccttccaccctctcaggactgactttccctccagctgggtaactgggcgcctgacatggcatggcatgtttgtcctgctctggccagttgtggtcgggccaaatgaggtatttccctaggttcctggccttccccttcttgaaaaccatcaggagtgaccacactggaccccagacttgtggggggattcccttgtagatccagtgagaaaaccatggacagaagaaggctttggtgagacaggtctcagggtgatagtaaggaggatcagagtctaagcattctggaagcctcctgcctttggctccaaggttcctcgggggaggtcgagtctacctaggaccgggccttccttccaatgaataaacagtggacaagtgctaaaaaagacaaacaaaaaaagagtgtaactgtgcattttaaaataacatgaacagtataattggattatttgcaactcagtggataaatgcttgagaggaggaatacctcaatctccatcatgtcctcatttcaaattgcaagctgcatcaaaacatgtcaagtatgtgtgcctactaaatacccataaaaatggacataaatgaaacgttaaaaaacaaataaacgacatatatagccgtatatcaattaaaggaattggattcagtaaaagcaacaaagaaactcaacaaagatatttctcaattaaacctcatgtttctggtgacttcactggataattctgccaaacgtttctgggagaaataacaccagttctccactcaagataattgaggagaggccacactttccaaagcattttacagagcaagcacaagcctgatatcaaaaccagacaacattatgagaaaataacatgacagaccaatgtaactcatgaacatagacacaaactctgtaaaaaacaattaaccggagttagaaactagcaacataaaaaatttacatcctagccaaatggaatttcctccatgtgagtttagcaaagtaacatggtacaagatgaacatggaaaagtcaatgctatttttatatgccagcaacaaacaattgaaaattgaaagtcgatatcccttaatatagcagcaaacccccccgtgaaatctgtagtggtaaaatttaacaaaatatgtgcaagacctgtgctcagaagcctaaaaaacatttcagaaaaatatgaaaccacgttgaaataaatagagagacataccacattaatggattgcaagactcaagattgtcaatatgtcagttactcccaaataatctatatgtctagtgtaaaccaataaaaatccctgcagcctcttgttgctataaaatgacaagctgacttcaaaatttatatgggaaagcaaagggactagaatagcctaacaattttataaaggaccaagaatattggaggactcacattacctgatatcgagatgcatttgacaactatgctaatcaggacactgtgatattggcagaagaaaaggcataagagtccgaagctagatctatatattcaagttaaatggatttttccataaagtgccaagagaattcagtggggaaggatgttttattccaggagtggtgctggaacagtcggacattgacatgcaaacaaatgaacctcaaactttgcctcacaccatacacaaaagttaactcaaaatgcttcatagaactaaatgtgaaagctaatgttacaacacttgtagaagaaaatgtaagggaatctgcagcatcgtgtaagataaagatagacaggatgcaaaaagcacaaactatgaaatagaacaaacatacatttttaaaattttatatactacaaacctgtcccttctataccttcacaaaggagaaagaagctttggagctgggaaagcagactattcccctgctctagtagttctcagacaagcttctgtgaaagttagagcccaagatctgttaaaagtgcagattccaggaatcacacccagtgaagcttatgtagtgtggccacaatggtgtcctaggatctgggaattcactgcccagcctagggaacttccagaaactttattaaatcccttaggtagcaagactgtctgaaatatatccactcttcccaggacagacatgaagttgagaagagcgacctcagagcacacagaaacacaggacatgatgaacacagtgtgaaaatcaccataagggtaaggcagtgcgtcttatgagaagacctcacaactcttactggcctttctccccagaggcctcagtttatctcaaatccctgctcctcatgggtggtgaatggagttgtgtcaggaaatgaccttttcgatccccaaaaggcatgggctcctttcaggggccactgaacacataggatggggcatgatgcaagctattgttcccctcccaccagccttggtttccttcttgcaccatcatgtgcttccacgggagcctagagcaatgacacgacttagggccaatgtcttccctttttaggagaccggcccctcgcctgagcagtgcgtctcccctctcctcctttcagctgtccttctcctgatctcatctgccattccacagcagacagctgtccctcgtagcctgatgatctagcctggccccttcctcctatgtcccagcctggagagggctgccctccccgagtggaaggacatcagtcccagggtcccagagccatgactactacagaaccatccttagcatcagtgtcccatggcagtggctgacctttgaaatgaagcttcaccacccatcgcagctggccctgaaacactttcttttctttttgtctcatttgagacaggccctcactgcgttgctcagcctgtagtgccgtggagaaatcatggctcacagtagccttgacctcccagactcaagcaatccttccatctcagcctcacaagtagctggaattacatgcatgctccaccatgcctgggtatatgcttttaaaattttttgtaaaacggggtctccctatgttgcccaggatggtcgtgaactctggggctgaaggaatcctcatgcctcgatgactcaacatgctgagatttgacgtctgagccaccttaccttgccgtgaaccattttctttcttttaaaattactattatactttaagttctgggatatgtgtgctgaacgtgtaggtttgttacacaggtatacacgtgccatgatggtttgctgcacccatcaagccgtcatctacattaggtatttctcctaatgctatccctcccatagacccccatcgcccaacaggccccagtgtgtgatgttcccctccctgtgtccacgtgttctcattgttcaactaccacttatgagtgagaacatggagtgtttggttttctgttcctgtgtcagtttgctgagaatgatggtttccaatttcatccatgtccctgcaaaggacatgaactcatcctttttcatggctgcatagtattccatggtgtatatgagccacattttctttatccagtctatcattgatgggcatttgggttggttccaagtctttgctattgtgaatagtgctgcaataaacatacgtgtgcatgtgtctttatagcagacacactgagtcaggcacaggcagggccgaccagggttttcctggtatccccacacccgaattccagggtgtttgtagtggaaacaaagggacgcgagagcttttgtgtgtgtgcttgtgtgtgtgtgtgtgtatgtgtgtctgtgtgtgtctgtgtttgtgtgtgtgtgtctgtctgtgtgtgtgtcttgtccaaccattctcctgcatccggaaacgttgggaacagagagtcccacgtcacccttagtgcggagtgtgtctcagaaagactttttgtgacagaaataaagaattttatgtctatatttacacatgcctttttctcagggtgtttttctgttgtgaagggtggagggcagtggcatgatcacgcctcactgcagcatccatcttctgggctcaagcaagcctcctcacactgaaacctcccaagtagctgggagtgcagatggccgccaccatgcccacctaatgtatttaattttttttttagatgaggtgtgtcagtgtgttgctcaggctgccttcaaacacacagcctcaagtgatcctcccatcttggccaatttttataaaggctttttatacatgctgtagactcaatcagttcacacttgtgtgcttttttaatattgtgttactccacctttgaacctgtcaactggtaactgatttccatgaaaacctgtaaggtgatcatggctcatcagtcagtgtgatttcagcgttgactcacagcagctaggaaagcctgcatgggaagtatgtcttgaggaaaactggagagtttccaggaacagttttgaaaaacagagactacttatgtcttccttccctcccttgcttctcctcatgtgccaggttttctgctttctccaattgttaacaaatcagcatggagtattatgtgatgaaacgcttttatctctttcatcatcccgtttcttcctcaaaactttttttttttttttctggaagggtggtaggcagaagggactaaacatattcagaaaaacacattgtaatataaatttcgtgaaaaaattcatcatatttaagaaatggtcaggatgaaatcctgaatttgtaataattgtaaaactcagtttgcataacctccaatccttttgtctctatcacttatccggtgagaagtgtagaaaagatgaattccttgcttgtgacagtggcattagttagtcaaactgctgcaccctgtccatcgatatcacacatccagatttaatagccacaaaatgcaaaggcattttacaactgtggcggttttctttatatcattgtaatttccattaaacccctagcactaaattcaatattcacacacttgcaagtaccatggccaagagagatcctgcctgaaatgttgagagggggctgcagcagtggcaacccggctgaagacgaggctggaatgtgtcttcacaaacctgcaaccccttttttgaggcagggtttctctcttttgcccaggctggagtacactggacgacttatagtgcaccacagcgtaggacttctgtgctcaagcgatcctcctgccttacgtttctgagtagatgggactacagacatgtgccacaatgcccaggtaattttaaaaattgtgtagagcaggggtctcactatgttgcccaagctggtcttgaactcctggcttcaagtgattctcctccctcagcctctcaaaatactgggattacaggcgtgagccactgcccgtggcctttttctcacttatttttcctttatctaagttttaaggtttatgtaaggctttgctccagcccaggaaactgaattttttccctcccacttggaggaaacagcaattcaaacgttcaggatttttgacctactgaaagttcattggcaacaattgtgtcctgtctctacctgcctgcaggagaaaacaaaaattaaagtcagcaccaggctgcacttttcctccatacattatcctgtgcagaacagcgtttgagggatccagtgagccagttctcttgcagttggagggattattgttaaatgctgggagtacatgtatttttcataacagacaacagctcggctgttgcttcatactatggggaaatgcatagtctcccaggagtgacagcttcatcatctctaccccttcactcttcctttactcaaagaaagctttcaccatattgtagtgagtcagggtcctgctggtgaatcacacggttgttgacactgtgtcagggacccccaaggccaccctcaccttcagtgattcatggacattctctgctgcccttctgcatacaatactcctaattgaagccagccccctcacctcaggtcagtataccatgcgtcccaccttgtcatgggctttgctcctgtagtgatcactcctctctcctgaaccatcgactgctccctctacattggatcattctccagctacgggaaaactcaccttcttcccccatgtccttctgtagctacgaacacatgtgtctgctgccctgcaaaggaaaactgcatgaacttatgcaacacacttcattggagtccattttcaaaattttctacaaaggaaaatgaaccagaatatctagaacaattctgaagtgtaacttgggggaattcaccccacacaatgtcaagattcacattaattctattttatttattgattgattatgttatcagtgagttggaagaagttgacttcccccttggcttgggggttgatccaatatagagggagccgttgatggttcaggggagaggaatgatcagtgcaggagcagaactcctgaaaaggtgggaggcatgggatcctcagctgaggtgagggtgctgccttgagttaggagcattgaatgaagctattgattatgatttttaatcatccagccccatatggcaattatgttacttctccagtattcaggacagtgtgatattgggggaaaatctacagatcaaaatagagtctagcaatagactcacaaacctaataagttgactttcagaaaagaggcaaaggcaatggacaaagattatcttttaaaaattgtgttattttctcctgcctcgtggccactacattaattgttttttattcctctggtttcctttcctgtgtttctcctttgcacttcaactgctgttctgtttgtctgtctgccccaccacagtgcgatatttcccacagcaaggaccaagtgtctttgtgatatttgctatgtccatctcatcaatgataaaccgaatcaagaaaatgtggtacacatgcaccatggaatactatgcagccatgaaatactatgcagccatgaaatgaatgagctcatgtccttggcagggaggtggatggtggtggcggccattatccttagcaaactaatgcaggaacagaaaaccaaataccggatgttctcacttataagtgggaggtaaatgatgaaaacacatggacacatgggagaaccatcactcactggggcgtactggagtgcgggggtgggaggagggagaggatcaggaagaacagctcacggatactgggcttaatatctgggtgatgtgatgatgtgtgcggtaaatcaccgtggcacacatttacttgtgtaagaaacctgcacatccttcacatgtacccctgaacttaaagtaaaatttggaaattaaaaaaaagtcaatatctcagaatccttatttctatgttttggtctttgtgtcatttatctaagcattatggtgacatgaaagctgaggcataacaacagttagtatgattagcaatttagcaggattatagctcagtatgatataacatcaactactagtattgaattgcattcaactccttgaagtgcttaaggaaagttggtaagaaaaagtattcacacttgaaaacatttttaaaattcatgtaaactggatcaacactgattaccacagatgtcactgtcactagatgctaatgaattacataatagtaaccataaaacccagtcaaaaataaagggggaaataaaaggagacatatcaaagcatcatcagatgaatgcaggaacacccacatgaacacaccctgcagttaaactgacaatttaaacatcactgagtgctatttcaagcattatgtagaaagctacagacaacagtgaacttattctgagcacgtcttaatccatcatcttcacagatggctatagaaatggcctgtaaacattttgtctgataaccgctaaagtagtgacgttcaaactcttttatgacaatgtgtgagaaacgcacagtttatatatagtcgactaggcaaataaatatatatatgtgcttggggatgtgcagtgaatattgtatatttgtatattctgtgtgcagtgaatgctacttagtaatttattttatctccgttctttaaaatgctgtttttggctgacaacattaatcttatgatcgaccatggattaaaaaccagtttagaaatgattaaagccttttcagagaacatcttgaatggttgataaatgttgctatagtatatatccaaaaacacattagaacccaattttgtccgcctccttagcaattcagtgtttttagacaaaaatgtcgtctttgatatgggccacaaaagccactacaaaatagacaattactgatgaaatgtgtgtttcatctgcagatatctgtttctcttttgcaaaggtgaagtcttacttggacagatgggaactcacaggcaaaaagggacagaaagtacatatgacctcttgtcctcttggtatcacgtggaggctttgcttgggctgcagcatacgtgaatgttatgcatttcctgcattcatggagacctccctgtgagtgcacagggacctccattcccctacggtggtcccattttatgaggcaagtgggagaatggcacggaacatggtaggtagtaaataatttggcctcaaccacaaagcaatctgagctcacatgacagtgtttactctggtaccctgaaacttgccagctgctcagaatctgtagactttgtcccacccacccaccatcctgtggaaatctatgtttggtcatagattcccatgcgtggaggatgggaagctctggtcatgtgggaaattgagccctctcacaggtagactggctgtgttggtcccagctctgtttcctcccttagcagctagagagttgctagggtcatgtatcaggcaactcttcttgtctctgcagtgtctttcatactgtctgctgcttcctgtttgtcacaagggctccttcacaactttcccaataccaatgcaattatgatcctttgaagttatccaggaggtccggagttatagtccacaggaagggcagcgggaagttcaaatttggcaagaaattcaagcctgccctttgaagctggagtgaggccactcaggaatcattaaagtccaggtctgcaggtgatgtttaatattaagtgtcaacttggttggatcaaagggtgcaaagtattgttcctgggtgtgtctgagacgttgttgccaaaggagattaacatttgagtcagtggactgggagaggtagacccaccctcaatctgggtgggcaccgtctaatcatttgccagtgccactagaataaaccaggcagaagaacatggaaaaccagacttgctgagtcttccagcctccaactttctcccgtgctgcatgcctcctgtcctcaaacatcagactccaggttcctctgcttttggactcttgaacttacactggtgatctgccaggggctctcaggctttcagccacagactaaaggctgcaatgctggcttcaatacgtttgaggttttggaactcagactgcctttcttgctcctcagcttgcagacagcctattttgggacttcgccttgtgattgtgtaaatcaatattccttgataagccctgcttcacatatacatctatgcatcagttctgtccttctgcagatccgtaactaatacagtgtgaaagagtaccatccagccatctgatggcatgaccatttgctaaatagttgcccacagaaagtctgagtccagaaatcactatttcctattctttgagcacgtctgagtgcactatattaaaaactggggttaataagaaacaaaataaagtaaaatttaataatgatagtgcccttgccaagaaagaataaaaagataaaagttaaattaattaagtcatcatgattacaactgctctcaccttttaaaaaaatctttgaaacgccgtaattcctactcacattgcttttgagagagagacagagagactgagcaaacttttatttccaactcaaggtatttccctaagagaagcccaggtgaatggaatatataggagtcatttcagcaatatatctcaatttatttataaaagcctgcattctcatcaggccccccttcctatccttctgtttcatatactatttcccacattaaactgctaagtaatacaaaagtaataaaaacaggaatcatgcacacagcttactgtctactttaaggaaagtttatacaccactggcttcattaagataactttactaatacaggaatctcttgcttaggaaaataaaagttgcaaagaactttactgttaatttcagcaactgtctgaaagatccatcaagtcttcagtcaaaagattcaaatgacatttttcaaccccaaaacacattgaatcattgcctaaaagtgtttgtcttcttggctccaccagtcctaaatcattatgattcctatctaactccaaacaaacagtcccccactttaaaagacccactttacaccagatttcaaaatgagaataaagatacttaaatcccctcgtctgacatactagtgctttgttgaagtagtgctctcttttacagcgttatgcaaataatatcagccctgtcttacgaacaggccatgtggctgatatttggagagtacggtatatgatctggttagtcaccactgcatgacatcatgtcacagtagactgtgcctagatcctgtcatcaatatctatgtatatttctgaatatacatatacggtctgaatgacctacaagtatattcaggcaaatcagtcaccagtccagagatgtaaatgttcaataacacacctccccataaatttagcacgtgtgaatatatttagtctgcagaagagtttattccattacattcattagaagcatggcagaaaactgagaaccagaggaaaaaagtgaattatcaaagcacgtataaaaattggtcaaggtaggaggatcgcttgagcccaggaattcgagaccaacatggaaacggagtgagaccatgctctaaaaaatgaatttactgcccacgtgtggtgtttgcacctgtagtaccacccacttgagaggctgcagcatgaggattatttgagcccaggagatccagacttcagtgagttatgatcatgccactgccatccagcctgggtgagaaagtgacaccctgtctaaaaaaaaaaaaaaaaaaaaaaaaaaaaaaaaaaaaaacatttataaataaggatataaaaatagtttatttcacaacaggcttttctgaaacacgtcctccattaagggtgacataggactgtgtgttcccaatgtttctcaatgcatgagattgtttgggcaaagaaaaagaaaagctcccttaagtccctttctttccactacaaacaacttgtgggtgcgggtatgagaacagcaggaaaaccacggtcggccctgcaagtagcagactcaatgggcatgccccttgctaagcaagttcctgctgcccatgtgccttgctgtctgctttctgtccctgcagagctgtggaaggaaacgttgtgacttctttcttgcctactatgacacaacacgtaggtcccagatcagtcctcccagaagttgaagtgtcagtgagtgtgagggagagcggaagggcttcctgtgggttggaccactcggtctatggcctcatagaggtcgtcatccttctactaaaagacagtggcatcaccatggccttgatgttgtggggtcctggagaggggaggagttaaggccgtagaggcgaggagggtcagatgatcaaggaatgaattgaagcgtgacattatttgcggtatttcagtctccgaagcataagaaaccacagaggatgggttccaacatccttagtggggaccttggaagaagcagaggacagtgagtgcaggaacaaggaggtgcagtgcagccctttaaggcaagaggggaactcactgcgcacgctccttgggtgcccgcctcagtgcacaggttcactgggcgtcttcccatctgcctttttgcccacgtggtgagtgccttagagctgtgagcctgcagctcggtccctgagatctgcattctttctcccctactgagacgcagccggtaagtccgcaggcccctcctactgggaattgaagtgtgagtgagagtgaggaggagacactggggttccagagggtcgggcagcttggtcggtgactctgagggagaagggctttgatgttgtcgtccttctcatgtggccctgccactatgggccttcttgtcttgctggagtgcgaacgaaagaagaaggagggcctcggagtggggcgatgctggggtgctgctggcggtattcgagtcccagaaacccctggaacccccaacagaggacagattctgaactcctcaaggaggatcagggctgggaggtgtgggcggtaaggaaagggcctgcaaagtgggaacactccagactggttcccgccaccccaaggtttgtgtagtgactcccagtggcgcccgacctgtgaggaccgcccagtgctgtgtggcaagttttcaacttcatcttggacgttcgaatgcgcggacggggctctgcattccaacaaaactcgattttgtgggggaaatgggcctagcaaatgggtgcgtgacaaaagctgtggacactttaatttgaattctcaagctgtattttcctaagtgtctcaccatggagagtccagttgtgaaaccaaacctcattggaaatactgtgtgtctcttgccctaagccctaaggcattgctcagctcagtaaagccctaaggcattacttgacgaacgtaagtggctgtgcaagtattcgattcagaaggcatacacacttatacatgctctctgacttacttttcaatgtcttaccaaacttttataaattgcaagttaacatttggccatggacgtagtatcctctcacgtgcatttttccaatcacagttttctaatttttgctttgttttgttttgatttggtttggtttttttgagagggagttttgctcttgttgcccaggctggagtgcaatgacatgatctcggctggctgcaacctttgcccctgggttctatcgattctcctgcctcagcctcccaactagctgggattacaggtacctgctaccacgcccagctaagtttttgtatttttggtagagatggggtttcactattttggccaagctggcctcgaactcctgacctcaggtggtccacccaccttggcctcccaaagtgcacactattctgtttgcagactgaaatatgagttggcgaggaagatgatatagaaccaagatgatgtttacgacttgctcagctgattgggcctatgcttgtgagtgacttaacattcaatgttttctattagcagaatttttttgtgtgtgatagtgttgttgaactagcatagatgcactgataaaggtctcccatgttgacaaaaaaccattgcggcatctcatgaaggaaacagtaacccaagaggactacatactggttttgcctggatgtgggaatttgtgttccccagatttgactagtgatttcctcctcatgcttattcatagctcattacactagcacatagctagtgttgcagcatgtctttaaacatgcatatgatcagaagtatctatgtaatctgtatattcgtgttattgacatgcattgataagaaaaattttttatctgcacatgcacacagaaaacccccttttcccaggagcctagtgtgccagagcctcaacaagaagaaccaccagctgaaagtcaggatagtacatctggtcagaagacagaagaagatcagggtgcagctgagattcaaagtggtgggaagagaaagaaagaatgtctacggggggaggaggcctatgtgtgcatcatgccttatgccatgaccagtaagaggaggaaagaaaacactaggaaaggatctcaaacatttgctgagggttggctggaaacgtgacgggtatagtttgcagcttcctgcagtccctggatatgattaatcttctctttttcttcgagatgcattttgtaggcttgaaagtacagtccttcctaaatcagatgaaatcatttaattggttgtataaaaatgtacattatttcactagtttaacttgatattcttaggatgttgcagtgagatcttctcagccatggtattcacagtgttttaagcaccctttaatagcatgtggagtgccaagtcgccctaccttataataccctgaataaagcccatttgcaaagggatgttaacctcattttataaataaaactgaggcccggtgtggtggctcatgcctgtaatccctgcactttgggaggccgaagcgggcagatcacttgaggtcaggagttcaagaccagcctggccaatatggtgaaaccccatctctactaaaaatacaaaaattagctgggcatggtggcacacactcgtaatcccagatgctaagcaggctgaggcaggagagtcacttgagcccgggtggcattggttgcagtgagccaagatcgcaccactgcactccaacctcggtgacacagcgagactctgtctccaaaaataaaaataaaaataaataaataaataagaaaactgagaatcagaggttgagacttaccaagaacacttggctcatggagaaggaattcatattttgttccaaggtttgcattctattttagaaaatgtgaatgattttgcttaaaaatgcttaatattcaaatgtgtctgtactataaggtaatttggtatcggctcagggcaaaacgcagttcagtgaagcaagatagcaactccagaaaggaggccaataaatgacagccactgtttcctttgatttatatttttgaacgtatgtttgataaaagctggataattcaggacaatggcatacaggtaactgtatttgtaggattttgaaggggcttttaaaagttgttgcaatatttttataattagaaaattctaagtatgataagattatcatgaaacagaaactgtttcctcaacagatagcattttcaaactaatcagagacagaatttgggccatgggttattttggcaattccctgttaaggggtttccagaatatgactgtcaacaatgcccattaatttatttgcacttcagttcccatactctcactggaagacagtgattttgcttttatattccgtacttttttcttaatgacattcatgtatggaaagtcacatatagcgccttttgacctaagaataactttgattaagtttaaccccaacattttcaagatacctcaacaggagatgagtatcaggactataggatttgtcataagctcaccaatacattgatctaatccttcagaaaattacatttaagttatgattaaaatgctatccacgaggccatcttcaggtttcctaggtagctgtgtgtttataatacacaatggtaaagtatgggaaatgcaggtgtgctgtgacttatcctcagattgtcatttaagataagatatcataatacaggaaaacaaacggggacatctttgcatcacatttattaccacagtagcctctaggcttttattgcatcacactgaggaaaagaacaggatcatttccttatttatcattctgctttggctgctccagttgatttccttggtattttttagtgcctgacctggaagctgatctccaggagctgtctcagtcaaagactggggatgaatgcggagatgatcctgatatccaggggaagattctgccaaaatcagagcaatttaaaatgccagaaggaggtatgttatccattaagattcaaaattacgtgctttctgtattccacaatattacacttttgacaataaaaagagagaatattactgcccctccaaaaactgagttcaaatgcagactttcttcgaaaggtagatcagaccctagaagcctgactgcaaaactgaaacactatcagatacagacacaaattgggtcaaagccatattgaaccattgaatagcaaagcattttgttacttctaagtataaccaacagctaacaattttcagattattttgcaatttctgtttctcacaaataaataatgcatttgtaataccactttgtatgatatatgctgatccctgaaggagattctagtaccagctccaacataatttgtgagattctggacaaatcacatcaatcctacacccatttttgcttttattgaaaatagtgaatgcacataagatacattaaaatccatttcagtgctggtttctccatgctttcgtcttgttgcagagaatatacagatattctgattttcatgatttgtttatcataacaatcagctttagtccaattaaaatatctgagttgagacttcattgctcctaagaaaatgagaaggcactctgcttgatgcttgttttcctgtatggagaccttcatgagtgttcttggattttgtcaaatcctgaattctctcaggctcttaaacaatgattgcatttttttttcagatggggtctcactctgtcacccaggatggagtgcagtgttctgatctcggttcactgcgacttctgcctcccgggttcaagcgattctcaagcctcagcctcccatgcatttgggattacagatgcctgccaccatgccaaccaatttttttatttttagtagagacgaggtttcaccatgttggccaggctgggctcgaactcctgacctcaagtgacccactcgtctcggcctcccaaaatgttgggagtgattataggggtgaacctcctcctgcgccagacccaatgattacattttaatgtcttcccgcagtgaagccttgaatgactgagtaataaaatcgatagagacagtcaggtttttgtgacccatgaagtagggagaatgcatgtaggtcagtcatgctcaaggtggttgtaagatgcctgtgctaagcatgctccctgtcctcctgtcagtcttcatgagctactgtgtgtaattagattgaagacacatatggtaaccgctaaccatatcagaggttatattacaggcttctgctttgagtcatcagatgatatgatttagagttcaaagtctataatgtactaagtcctgagtagtccacataagtatttttcatacatgttttccaaattgctgacttaattagaagaacttctgaatttaaaggaagcactgcacgtataggggagaatatctaaatgtttttacttcacactgctgaaccactccctttgactatttacattaaaggatagcttgtaggcgatttccaggagcctattgaacaagcctgaatagtattcttaggacagtcatagcattatatgcatatcctattaaaatagacagcaaattacatgatacaagaaaataatactaagaaataaaaaaagagtcacaaaagaaacttaagggaaagggaaacaggcagtaaatgaaaggtacgaatcattaacaaaaggaaaactaatccaaaagtaataaatttaacagatcgttcttttgtgaaatatctaggaagagagcatccagtagcttaaacaatcttgaggaaaatggaaaaagcacaacacggaatatgaacaagacacagatattgaatataaggcatgattgaaagggaatacattcttgaacactaatattttcagagtgtggatgaaatggttgacatgctaggaacacctacattatttaacgtatccctttaatacctgaatatctgaacatcacaaagactgtgcatgagcttgtggaatttgctggtcatccctcaaaacagttacttttagaagcaaatatttagcttttccagatgccttactctccgttttcttttccccctccattttttttttgccacactggttatgatgtataactctttcacgttttaatgtcaataaagatcctgataccttaaaacttatatgaccatttaattaattatataaacgggaatacattctggtgattaaagtgtcattattcatatcctcatgaggactataggtgaaaactggatgcaaatgtttactttatgttaaaaaaaaacacagaagggtaacctagcccaaaggaatattgctgcacttcagcacaatagagaaaaaacaaatgcaatactggccttcctattcatttcacttatgtatttcctaatgtgacattaactgttttctccaaagataattttcagactttttgcaggagcttattggacatcaagaccatagtttcaagccaacacattaaattatacatttttcacaaattccttctgttgcttaggttttttatgtcctggtcgtattttgagtaaaactctacaaaatgtttgctatctactctaagcaccttttaaataggtccacttgatttaatgtgttctgacctcagactgtcttttggtttccttctagcactaaaagaagggtgtgtttaaaaaatgttactaatatgtacccttggaagtgtatcttcaaagtctctacagaggtttagttgaatgttagccatagggatgctgaagcacgaggatgtcttgagcttgggagactgagacatgcttgggcaacctgctgaaaccccctgtctacaaaaataaatgaatgaatgcatgaatgtatgcatgtatgtatgcaggtgtagtcccagctactctaaatgaatgtatgcatgtaatgcaggtgtatactccagctactctggaggctgaggtgagaggttcccttgagcctaggaggttgaggatgcaggtagacattttcatgccactgcaactccagcccgggtgactgagactgttttaataaaaaatagtatcatttttggaagatggccaaataggaacagctccaatctgcagctcccagtgagatcgatgcagaagacgggtgattcctgcatttccaactgaggtacctggttcatctcattgggactggttggacagtgggtgcagtccacggagggtgagctgaagcagggcggggcgtggactcacccgggaagtgcaaggggtcaggggatttccctttgctagccaagggaagccatgacagtctgtacctgcgcttttcccacagtcttcacaaccggcagaccaggagattccctcctgtgcctggctcagagggtcccatgcccatggagccttgctcactgctcccacagcagtctgagatcgacctgtgatgctgcagcttggcgaagggaggggcgtccgccattgctgaggcttgagtaggtgattctgtgctcacagtgtaaataaggaggctcggaagcttgaactgggcggacccactgcagcttagcaaggcctactgcctctctagattccacctctgtgggcagggcatatcagaacaaaaggcagcagtcagcttccacaaacctaaacatccctgtctgacagctctgaagagagcagtggttctcccagcatggcattcgagctctgagaacagacagactgccacctcaagtgggtccctgaccatcatgtagcctgactgggaacccccagtaggggccgacagacagctcatacaagcaggtgcccctctgggacgaatcttccagaggaaggatcaggcagcaatatttgctgttctgcagcctccgctggtgatacctaggcaaacaggttctggagtggaactccagcaaactccaacagacctgcagctgaggggcccgactgttagaaggaaaactaacaaacagaaaggaatagcatcaacatcaacaaaaagcacatccacaccaaaaccccatctgtaggtcaccaacatcaaagaccaaagatagataaaaccacatagatggggacaaaccagagcagaaaatctgaaaactcaaaaaccagagcccctcttctcctccaaaggatcgcagctcctcgccagcaaaggaacaaaactggacggagaatgagtttgatgagttgacagaagaaggcttcaaaaggtcagtaataacaaacttcaccaaactaatggagcatattctaacccatcacaaggaagctaaaaaccttgaaaaaagattagacgactggctaactagaataaacactgttgagaagaccttaaatgaccggatggatctgaaaaccacagcacgagaacttcatgatgcatgcacaagcttcaatagcagatttgatcaagtggaagaaaggatatcagtgactgaagatcaaattaatgaaataaagagagaagacaagattagagaaaaaagagtgaaaagaacaaagcctgcaagaaatatgggactatgtgaaaagaccgaatctacgtttgattggtgtgactgaatgtgatggggagaatggaaccaagttagaaaacactcttcagaatattatccaggagaacttccccaacctagcaaggcaggccaacattcaaattcaggaaatacagagaacaccacaaagatactcctcgagaagagcaaccccaagacatataattgtcagattcaccaaggttgaaatcaaggaaaaaatgttaagggcagccagagagaaaggttgggttacccacagagagaagcccaacagactaacagcagatctcttggcagcaaccatacaagccagaagagagtgggggccaatattcaacattcttaaagcaaagaattttcaacccagaatttcatatccagtgaaactaagattcataagtgtagggaaaagaaaatcctttacagacaagcaaatgctgagagattttgtcaccaccaggcctgccttacaacagctcctgaaggaagcactaaacatgggaaggaacaaccggtaccagccactacaaaaatataccaaattgtaaagaccatcgacgctatgaagaaactgcatcaattaacaggcaaaacaaccagctaacatcacattgacagcatcaaattcacacataagaatattaaccttaaatgtgagtgggctaaatgccccaattaaaagacacagactggcaaattgaataacagtgaagacccatcggtgtgctgtattcaagggatggaggaagatctaccaagaaaacggaaaccaaaaaaaaaaaaaaagcaggggttgcaatcgtagtctctggtaaaacagactttaaaccaacaaagatcaacagagacaaagaaggccattacataatggtaaagagatcaattcaaccagaagagctaactatcctaaatatatatacacccaacacaggagcacccagattcataaaggaagtccttagaggcctacaaagagacttagactccctaaaaaaaattttggaggaatatgaaagcacgctgaaataagtggagagacataccacgttaaaggatcccaagacttaagattgtcaatatgtcagtttctcccaaataatctgtacattccatgtaaacccaattaaaatacttgcaaactcttgtttctataaattgacaagctgacttcaaaatttatatgggaaagcaaagggactagaatagcctaacaatgttataaagggcaaataatattggagtattcacattatctgatttcaagatgcatttgacaactatgctaatcaggacactgtgatattggcagaggaaaaggcataagagtctgaagctagatctatatatgcaagttaaatagatttttccataaagtgccaagataattcagtggggaaggatgttttattccaggaatggtgctggaacaattggacattgatatgcaaaaaaatgaaccttaatctttgcctcacgccatatacaaaaatgaactcaaaatacatcatagaactcaatgtaaaagctactgttacaacacttgtagaagaaaatgtaagggaatctgcagcatcttgtaagacaaagatagacaggatacaaaaagcactaactatgaaatagtacatgcatacatttttaaaattctatataattatgtgctaccctcatccagtgactacttacttgcccaagaattatacaaatgatatgaagaggtaattagagctctaatttcctagaaagttttcattcaaattctccataccagctcatgaagacaaaaccccagctttaaatttaggctttagaataaccccatgaggagcattgattattcattattctaaaaaaaatgtgccctccttccagccacacagactcatttcttgagtcccaaaagagctgaagtgataacagaaagatcatccaaggggtcaaaggtattcatgacatagtctctctggaacatgtcccagggaaatgtggacacagcaacaatcttggcaacaataacagctagaattgattggaaatttatgatatggctggcaatgtcctgacaactgtgcatgtcttaatacactcaatgctctaaactgccccaagaaatagatgacattactagtagtatttccatgatactaatggagaaaggaggcacagagatgataaggaactgtctcagtgtcacccagcagtgagtggtggagccaaaggccacaggcatggtgaaaactctactgagctgcatatttgtgtaatcaagagtaagatccaaaggctactgcaaaactttagaatgttagagcatgaaactgcacaggcaaaagacatttgatttcttcagaaatctttaagagatggagacttgaaaggactggtctgggtatcatttggagacggcatcctgagagtgtcattagaataacagccagcatgtgagtgtccgtctcctcacctgaaggtcttgagttcgtccatcagagaaggcaccaaacctgtcccttctatacttttacaaaggagacagaagccgtgtagctgggaaatgagactattcccctgctctaatagttctcagacaagtttccatgaaagttagaatccaagatctgttaaaagtgcagattccaggaatcacacccagtgaagctcatttagtgtggccacaactgtgtcctaggatctgggaatttactccccagcctagggaactttcagaaaccttattaaatccctcaggtaacaagactctctgcaatatacccagaaaaatattcccaggacagacatgaggttgagaagagcgacctcaacacacaggaacacaggacaggatgaacgcagtgtgagactcatcataagggtaaggcagtgtatcttatgagaagacctcacaactcttactggcctttctccccagaggcctgtttatctcaaatccctgctcctcgtgggtggtgaatggagttgtgtcaggaaatgaccttttagatcccagaaaggcatgggctcctctcaggggccactgaacacataggatggggcgtgatgcaagctgttgttcccctcccaccagccttggtttccttcttgcaccatcatgtgcttccacgggagcctagagcaatgacacgacttagggccaatgtcttccctttttaggagaccggcccctcacctgaggagtgcgtctccccctctcttcctttcagctgtccttctcctgatctcatctgccatcccacagcagacaggtgtccctggtagcctgacgacctagcctggccccttcctcctgtgtccccacctggagagggctgtcctcgccaaggggaaggacactgatccaaggatcccagagacatgcctaccacagaaccatcctgagcatcaatgtcccatggcagtgcttgacctatgaaatgaagcttcaccacacaccccagctggccgtgaaatattttctttctttttgtcttatttgagacagggtctcactgtgttgctcagcctggaatgtaatagagaaattgtggctcactgtagccttgaattcccagactccagcaatccttccatctcatcctcatataccatgcacaggccaccatgcctaggtatatatttttaacttttttgtaaagatggggtcaccctctgttgtcctggctggtcttgaaccccagagcttaaagaatactcacacttcgatgaaccaacatgctgagatttgaggtctgagccacctcaccttgccatgaaccattttcttatcacggaaagcaagacagaggaggaaggtgcctgcaactcctcctggggaacattgtgtccttccccttgttactgagctgtttcctctgtactgactgcaacattgctatgcttttgatgtaaataagaagtttgagggtactcctttgcattcctaaacttgcggtttatagccagaacatcattgcccattttggggcattttggaaatttctgagggtagctgtggttgttggaattattgtcagaggttactggcatttggggattaaggttatggggagaggcaaagttttttttcctgagtcttaaataaactggattttccatacatgtcacttccctgtaaactgagggagacttatatgttgctttatctgggaacttatgaagacttgttgactgctttggaaaatcacatcactgcagggcatttcattcttggattccactctgatacaacattccaatatcagtttgctttgcacctgtgcatgcctgggaaaaatagaatgagggaaatccagcttgtctaccaacagtatcttttccaagataagctgtcaattgttggggaaaatgaagtgggagatgttcacagtgtaatttcccttgagttggtgaaaacaccagctatgccccttgctgttactgcactgaaagttctctttgcagatgtatctctctcactaggttcccaggtcctttgtgaaaggttgaaattttacccagtagacccctatgtctttgggatggaacagaggacctcacaggcagatggagggcagggaacacttgtggaattgtagtgatctctacatggttggatgatcaaaccctaaggcacagtgatgagccacgtggatgtcagtctgcagagggtgggaggggaatgccacaggcctctgccttaggagccatgcatcagagtgataccagcctgcagtactgatctcagttatgccctttaagggtcccagatgtaagcagcctattggttggggtttctctgtttgtgtgggtgttgaggggagtgagtggagagatagagagaaagagaggagattttgagaaactgtctcaggcaactatgggagctggaaagtacaaactttgcagagcaggatgtcaccctggagtcccctggcagaggtgatgtgatagctcaaatttaagcgcagtgtggaggcagatgtttttcatcttatggagggccccagtctttttctttgaaggcctccaagtgactggatgaggctcaaacacattgtggaggacaattagcttttctcaaagtctgttgatttaagtgttagtctcatatcagaacaccccttcagagagacagctacattgattaaagtgaagaatttcctacgtagtgtggcccagcaaagttgacacatcaaatttcccatcatagctgtcttgcacaaaagctattaatgatgaatgtctatcttagataggcaggggacttcctaactaagattctgtattaaccacttttgtccggtccaagccaccatttcaggctcagctcaactctggccagtaagctgtagctgccatgaatgccttccagggcccaggcagggtccggatagtcgggggacacatgcaagcacattgccagagggcacacgtgatacccctggacaccaagagtttacccttgtgagagcacccctccgggacatacattagtcaggcagaagttggccaaggccccaacatggcatccttctgtaagacctttcctctagggttcctcatccagtccaaacaatgcatctgcatctttggcttaggggaactgtcagaaggcagtcagttcagcatagtcattgacaccagttcctcatcttcacaagcatgaatgacttccataggtcttctgtgttcaggagctggattgcccctcctgtcccggctgatgttgcagctctgtcaggtgtgatcctaagctgagtattcagtgcggtttcaccattggtcttagggtacagctgtaggttcctcacagaaaaagagactctccatctatgctgtctgtcattgagtacctctgattcactgtcatactgtgggactagggacatggtgctgacacaatggtgatcttgcttttgctgcgtctgcaagcaatcagtcaattggatccatttgagctcactgtcttcttaccggacaaatctatggatatgtgacaagccagactaacaaccgtattggtgatccctgtggccctgttagccaccacagggctgcttaggtactgcctgagcaattgacacacaattgtactgaattatgtggtgttgcccaatcagaatgttgacttattcctcatggcatcacacagagcaaggagcaaagttttcagcacatactactgacaggattttccttgtcacagttgggtatttacaaaaatatttcagaattcattccatgtgtgacaccattaatgaacatgtatatttaaatcaaataagctatggaagtcaaatgcatttaaaaaggtaacttcgtatttttacttgcatttcacaaaggtagctatcacttaatatagatgtagttgtaaaggcaaatcaagtgaaaagattaaattttaaagaaaaaaataaataacttgtaaaccaaatttatgtgcactgtaatgccttctcggtatgttacttcttttattcttcataacaatcatttagtgtaaataatctcatttctaatttagaaatggggaaacagtcccacaggatataagtactttgctcatcatctcaagccagtgtgtcagggccatgatggaaactcatgggtattccatgttatagtctgtgaggagacagtgtagctgggacccaagtcattttgctcagcaagttgccctggttactttcccctttcttctactaggccctaattctttcattcagctctacagcctaggaacttctcacatactttgtggcgaatgggatcccctacatttagactcactttttatttgaaccctagcttttcagtccttttgaacaaaaatatttataatctctgtaaaagagagaaatcattgctaattataatgcccttgccctctctaagcagtgtggattttgagaaggggcctttactgcagaattatcttttatggtgtgaggatacaaatggagctcagaggtgtcagtcgtgtattatgtattagtaagagggatatcaggctggatccaggcagctgcaggggctcctgaatgagatgtggtgactgtgaggctgatggattttatgtagatgaaaaatgaggtttggtgcttctccttccctgactcttaataattttaaagaaaggtcggacgtgtttgcatgagatgttgtggacttgctccacagggattgagacatcatttcttctctccgtgtttccactcactgtttcagatggctttagtattctagttacatgtttctgtaccacagtaaaataggtgtgttctcattaattttttaaaaatgtttttggaccggtcgggcgctatgtgactcctaaatgtaatcgcagcaatttgggaggctgaggtggtctgatcacctgaggtcaggggttcaacaccagcctggtaaacaaggtgaaactccatctctacaaaaatacaaaaattagccagatgtgggtgcatgcgactgtaatcccacccaatcgggaggctgaggtgtgagaattgcttgaaccagggaggcagaggttgcagtgagccaagatggcaccattgcactccagcccagtgacagagtgagactgcatctcaaaaaaagaaaaaaaaagtttttggaccaatggtttcatctagggatgcctgttaggcctatgtgccatgttttgggaaacccctccttcaagagaagaacaaagcctcttatcttgaataatgaaaaaatatattttatatattatcctagatttatatgaaatcatgtgattaccacgaaagtcaacatgtacaacaccagttctacgttcaacactgtcagaagcatttgcttcaagaaagcgcagactgtgaacttagaacttgagtccccatatctgcttcttactagagtcatttattgttaattttaggaaactctgactcaccttattaaagaattaaatgaggtcagaatcaatgaaacatagctcacagaattggctaatggataacacatactctataaatgtgaggtattattattcctgtttttcttagagaacccattttataagcctccagagtagctgggactacagtgacatacagacatgagtacattcatacaatcattcatttatttttgcaggggggggtctcgctgtgttgctcaatctggtgtcagtctctgagctcaagcagtccacctccctcagcatgccaaaatactggattacagacatgagccactgcacctggccacaagttacaaaagtgttaactacctgggaataaaatgaataaaaaatgtgcaagaattctttggagaaggcttaaaactttattgagacatttttcagtcaaatatctaatataaaaccagtttgtgttgtttcagcttgtcttcatttaaaactgtggttgcccatcacctataatagaaacataacaggaggggacattactagcagaactgtattcagataaaattaaaggtatgagaaggacaccgaagttttagttttacacaatggactaaaactaggagcctaagagtcactctatggcttatattgaattagacttctgtagagacgtaatatgtctgtattctctgtagagagtacatttattacttatgaataacttcaactaatgattcatacctgtcttttattcactacctgtctccccataagtttgttctgtggctcttctactattatgtttatttctttgtattatttttatttgtcatgtaattttctgtctattttagtaacatgtgcatttaaggctatgatcttcctaagaatacaattgaggcttgttcgatatgcttccagaaatcgtctgaaaactatcttttaatgtaaatagtctaatgaaatggttcagcagtgtagagtaaaaacatttaggtaatttctcccctaaacatgcagttcttcagttaaaatcagaaagtcttctaattcatagccatcaattggcattatatgcgtaaaaaatacttatgtcaactacccaggaattagtacccttagaatacttgaaatttaattcctatcatctgaggtctcaaggcagaaacctgtaaaatgtaacctatgatatggttggaagagattgtatcatacgtgtcttctatctaattgcacacagtaggtcatgaagactgacaggagggcagagagcatgcttagcacaggcatcttacacctaccttgagcatcactgacctacgtgcattctctctacttatcagccacagaaataagactgtcacttgccattttattataacggtttcttctgatttagcaaggacagtattttcaacatagaaaatgtatctcaaaggtaagagatgattcattatatccagggactccaggaaactacaaactatacttatcaattttccagccaactttcagcaaacatttgagaccctttcctaatgctttctttcctcctgttactgctcaaggcataaggcatgatgcacacataggcctcctccccccatagacattctttctttcccttcccaggaccttgaatctcagctgcaccttgatcattcttctctctcctgaccaggttttggatcttgactttcagctggtggttcctcctctcatggctctttatcactgggctcctgggaacaggggtgtgtgtttgtccagataaaaagttttgttatcaattacatgtcaataatataaatgtatataatacatacatattgttgatcataagtacgtctgaagacatttctccaacactataccatatactaattgttcatagagttactcttttcacagacaggttactctaatagagttaacctcaagggcttcagaagccattttaatttatgttgggatgaatgtgtggaatcatgggatactttaatcattgtacctatactagttcaacactatcatgaaaaggaatttctgctaatggaaagcattgaatggcaaggcactcacaagcataggcccaatcagctcaggaggttgtacatatcatcttggtctaggcctatatgttgatcttcctagccaattcatatttcacagtgcgaacaggaaactgtgatggggaaaatgcacttgacaggatagctatatttgaccacttccatagccaaatttcaacttgtaattttttaaaaatttggtaagactttgaatataagtcctagggcaagtataagtttgtttgccttctgaatgaaatgcttgcacattacattggtcaagctagctgagcaatgtcttaaggctcttggcaaatgacacagggtatttccgatgaggttggtttcaaaactggaccttccacataaagacatatagaaatatacagctagtgaattaaaaccgcagtggccacggcttttgtcacacaaccatttgctagtcccatttctcccctaaaatcgagttttgttggaatgcagagccccatccattcgaacctctacggtggagtagacaagttgagacgcatccctgagtgctcctacagacctgggagctgccatcaacaacttgcggtgctctgagtttccaggccccttccttatctcccacctggccctctctggggtccctcacggtgagcctggaatctgtcatctctcaggtgttccaggcccttgtgggcctcggataccttcaacagggcccccagcactctccccatcttcacctgatccccctgaagtccatggcccacctttctcctttgttctgaacccaccataacaatgcctgtgatggtgccgacacacgaggaaaaggacaatcacctcatgacccttcaccctgagaggccaaggaccatgctgccccatgctctggaaggccacgttcccctcctcacactcacccacacttccactcctgggagggctggtctgtggacctacggactgcatctcagtagtgggagaaagtgaccctcacaccctcacagctctgcgacattcaccacgtggcaaaggggccgactggaagatgcccagtgaacatgcgcactgaggcaggggccccaggagcatgggcagggaagtcggtacctgccttgtgggctgtggtgccctgccttgcctcacctcatcccccactctgcaggcctgccccctgccccaggtcaccactgtggacttcaaatgtgccctccgtgggcggtttcatatgcctccggaactgaaatactacgaatagttttccccttcaaaatgcactccatcttcatcaggccctccttctctctatggacctccttcctcctgtccaggccctgcacgacagcaaggccgtagctcctttgtcgcctgttagtagaaggacagggacctcaaggcccttccccctaggaggccatggaccgtgcccgcaggctccttctcacactctctcacacttcaactctgggagtactgatctgtggacctactggctgactcttagcaacacagaaggaagtcacgatgtctccttgcatagctctacagggacaggaggcaaatagacaaggcacctgggcaacaaaggacgtgcacacaatcaggcacgtgcagtgacagccagggttttcccactgtccccaggcccacatccccagggtggtgtttgtagtagaaagagacgcgagattttttttttttttttttgtctcttgcccaaacattctcatgcatccagaaacattgggaacagagagtcccatgtcacccttagtggaggatgtgtctcagaaagacctttgtgacagaaataaagacttgtatgtctacatttacacatacttttttctcagggtgttgctctgccctccaggcaggagggcagtggcatgaccatgcttcactgcagcctccatctcctgggctccagccatcctcctcaagctgctgcctcccaagtagctgggactgcaggtagacgccaccaggcccagctaatgtattaaattgttattgttttagatgcggggtgtcactgtttgctcaggtggctttcaaacacatgggctcaagtgatcctcccatcttggccaacttttatacatgctttgattagtcactttctcctctggttctgggttttctaccatgcatacaatgtaattaactacttctgtagactcaatcaattcacatctgtacccattctttaggttgtgttaacgcatatttatacttctccactggtaactgatttcccttaatacctgtaaggtaatcacctgtaaggtaactctgtgtgatttcaacattggctcacagtgacttggaaagcctgcgtgggaagtatttcttgaaggaaagtggagagtttccaggaaccattttgaaaaacagagacaagcgatgtcctccttccctcccttgcctctcctcctgagccaggttttctattttctccattgttacaaaatcagcatgtagtattctgtgatgaaaagttttcatctctttaatcatccagtttttttcctctagaccttttttttttcctggaagggttgtatgcagatggaacaaaacattttcagaaaaacacattatgatataaatttagtgaaaagactcatcatatttaagaaatggtcaggatgaaatcctgaatttataaaaattgtaaaaatcagtttacattacctccatcccttttgtctacatcacttatccagtgagaagtgtagaaaagatgaattccttgcttgtgacagctgcattaattagtcaaacttctggaacccttccatcaatatcatacattcagatgtagtggccacaaaatgcaaagccattttacaactgtacctgtttttctttttttttcttttaatctcattgtaatttccatcaaacccctatcactaaattcaccattcacagagttacaagtatcatggccaagagagatcctgcctcaaatttttttttgtgggtggtggggtgctgcagcagtggcagcccagctgatgacaaggctggaatgtgtcttcacacacccgcatcgcccttttgaaacagggcttctctctgttgcccaaggtggagtacactggaggacttacagctcaccacaacctaggactcctgggctcaagcgatcctgctgccttaccttcctgagtagatgggactacagacacgtgccatgatgcccagctaattttgaaaattgtgaagagcaggggtctcattatgttgcccaggctggccttgaactcctggcctcaagtgattctcctccctcagcttcccaaaatactgagatttcagatgtgagccacctcatgtcgccttttttttttcctcactcttctccctttatataaggcttaaggtttatctaaatccttgctccagtccaggagactggttttttccctcctgcttgcaggaaagagcaattcatacgtcagggtttttggcctactgaaagttctttggcaacaattgcgtcctttctctacatgcctacaggagaaaacaaaaattaaagtcagcaccaggctgcacttttccttcatacattatcctgtgcagaacagcgtttaagagatccagtgagccagttctcttgcagctggagggattattgttaaatgctgtgagtacatgtatttttcataatagacaacagctcagctggtgcttcatactatggggaaatccatagtctcaaaggagtgacaacttcatcttctgtatcccttcacacttcctttattcaaacaaggttttcaccatattgtagtgagccagggtattgctggtgaatcacactgttgctgccactgtgtcagggatcctcaaggccaccctcaccttcagtgattccctggcattctctgctgcccttctgcatacaatactcctgactggagccagccccctcacctcaggtgaggataccatgtctcccactttctcaggggctttgctcctgcaatgatcactcttttctcctgaaccatcgactgctccctctacgttggatcattccccaagctaagggaaaactcaccttcttcccccatgtccttttgtaagtaccaacacatgtatctgctgcccagcaaaggaaaactgcatgaacttaagcatcacacttcactggagtccgttctcatattatctacaaaggaaaatgaaccacaatatccaaaacaattctgaagtataactttggggtattcaccgtacatgatgtcaaaattcacattaattctattttattgattgattgactatgttctcaatgaatgggaagaagtggagttctctcttagcttggggattgatctaatatagagggagccgttgatggttcaggagagaggagtgatcactgcaggagtaaagcccctgagaagaggggaggcatggcatcccgagctgaggtgagggtgctcccttgagttaggagaattgtatgtagttgttgattatgatttttaatcatccagccccatatggcaattgtgttacttctccaatattcaagacagtgtggcatttggggaaaatcaacagatcagaatagagtccagcaatagactcacagacataataagttgattttcagagaaggggaaaaggcaaaggagaaagttttttttaaataaatgatgttggttttctcccacctcgtggtcactacattgttttttattcctctggttcccttctctatgtttctcctttgcacttcaactggtcttctgtttgtctttctgccccaacatagtgcgatatttcccacagcacgtatcaagtgtctttgtgatatttgatatgttcatcacatcaatgataaaccagatcaagaaaatgtggtacatatacaccatggaatactatgcagccataaaactaaagagatcatgtccttggcagggacgtggacagtggtggaggccattatccttagcaaactaatgcaggaccagaaaaccaaataccggatcttctcacttataagtgggagttaaatgatgaaaacacatggacacacgggagaagcatcacacactggggcgtactggagggcgggggtgggaggagggagaggatcaggaagaatagctcgtggatgctaggcttaatacctgagtgatgtgatgatctgcgcagtaaatcatggtggcactcatttacctatgtaacaaatctgcacatcctgcacacgtaaccctgaacttaatataaattttggaaataaaaaagtcagtatctcagaatccctctttccatgtgtttgtcattatgtcatttatcaaagcagtatggtgacataaaagctcaggtgtaataacagttagtatgattagtgatttagcaggattatagcccagtaattactaatattgaattgcattggactgcttacagtacttaaggaaagttggtaaggaaaaatattcatgcttcaaaataattttaaaattcatgtaaaattgatcaacactgaataccacagatgtcgctgtcactggatgctaatgaagtacataatggacccataagacacagtcaataataaagggggaaataaaagggaacatatcaaagcaccatcagactagtgcagaggcacacacatgaacacaccctgcagctgcggaaagacatggtaggaagtaaagccccacaactcatcagccatccttctcaccagctcatgagttcacaaatgagtttgctgagggtcaaatgtctacagtaaaactgaccgatttaaatatcactgaatgccatttcaagccttaggtagaaagctacagacaagagtgaacttattctgagcaagtcttaatccatcatcttcacagatggctaacagaaatggcctgtaaatatcttgtctgacaaccgctaaagtactgacatccaaactcttttattacaatgcatgagagtgttgcgggaaaatcagagatgggagagacggaacagagttcaggagagccctttattattaaggtgatcaccggctcagtcggactagggtccagaaagtctgagccccgaacaaagggatcaatcaccttttaagtagtttgtggcgggagttacgtgctgcaggaagcgtacttgtggaagcgagaacaaaggcagttaatctttctttcacatttgttgcaccacatgtcttacatccttgggaatacatgtttttgtagcatttgcttatcaaccttgtgacttcacagccgcgctagggagggaagaaagaactcgctgtgcctcaaggaatgtgaaatgatggaacacagataagcctctctgagcatagaggagaaataagcagttaatattctcttttaacccaggcctctgggttggggggctatatgacattctaccttcaaggaaaataatacatttcttgactattatatttaaaaaattcattaattcccccttcatttccccactttggtgcttgccatacatgcagattaataaagggcaccacagtcgtttatgtcttccggtgtaggctcatattcttcttgagggactgattggtatttttgcagtgccattagtttggtggtagtcgtccggtctactactgcttcagtggtggattggatgcttctgatgagaagaagtaaaagccaaggcagtattaggcatcctccagttatgactataaaaccaattattagagttttaaagcctccaagccatgagaaccatcctccaaaaagtgtatttgggctccatctggaccaggtctgcactgagacatgggctaactttcacatcttagcagtaatttccataacagctcttccattgttgtcaatttgtaagcaacagttggtcaaatttagtttgccacaaactcctcctttggaggctaggagatagtctaacgctagcctattttggtatatggcatccctcatttgggtggcatgtatagctagcaaatctaaggctcgagctgtctcattgactataatttctagtaccgcttgtaatcttataattcagttcagcatgtatataggagtatggtaaccccatgacccatcttgggcctacgtagttggtccataatattttatgatcctctctggaggctattcattgtctttccaatttcttatttcaatgtcttttcttatgtttgtgtttacctttttggcggtacttatctgggtagagacatttcttctggtccttttcctttctttgttatagactgggtaacttaaatcttctccttgggttaatgggagtaagaagaaagatggtcttattgttcctaatacacaggctctgatccaattttcaggcaatagttggtaggcctttgtcccagagatccagtatagtcctgctggtgccttccaaatatttgggacatccagccgataccatgactgatttaacactggaaattgggagaggggattgaaatccagcacagaggaattatctgtacaacttctctcctgggtcttattttctgattcctcgaaatattgttgatgtgaacaagttgtatcccctacctgagtttgaaagtttttttccccatcgtgctatgcaatatctcccaatgataggggcctttagtagccaaacacttgggttggcattgaattttgtaacaaattctggtatggtaaaattatcttgtggcattaattctctggcttcccaaggccattgatctcccatatttgtacctccacaaacataacgtgatgtgaccccaagattagtagcaatactttcagctagttgagcaaacagattttctgctgttattggtggaatttgaatctttgattctttggggtcgaaatgcttaataaggaatttataaaacctgaattgctgcattgggttaacttgaactttagctcgttgagtctttttaataattacattcggaatcccttggtttgctccttcctggttaaagcccattagtcctttatgtccgttagtccagaaaggcatatttggtttcagtatagtcagattgagggggttgcatgttcgggttgtgcacccaattttggctttcaggcaggcaaacaaagccactcttcctgggtaaaggtgctgactgaactcgtgggtagtccattgactgtgacagtcaagacaatccttttctgtttctcccattaagatcttagcagctttgctgctgattctttcctggcctagatccctacagaccactcctagattgttcaacttgctaagatgtgcagcttggcaggcatcaaaatatattgagacaggccctctgtgtgaaaaaggaaatacctttgttttggttacaagcttccctactccagtgtctattggattcgtatatgatggcaacaagggttcccctattcggatttcaagccagaaatcgtagggcagggattccagatcataacagatttgaggctgcccatttcccaggtcacaaacagagtagctggtttggttataaacacaagttcctacctgagtccctgtgcactcatagtaggtctggtatatcagagtcttagttatgcctttttcagaccaagcatccatcatgcagtgatggcaactatcttggtttccttggacagctgttagcatttttgctactagtacaatcaggtttagactatgcacgggcatcctcctgggcagcaagttcgacagcaattgcaaaggtaacatgacagtaagacaattagtacaagcaaaagaataactacactggcaaattctatccacatttacttatctggcactggcttcctcaggcttcggccatgtgtagactactcagcttccggttgtgtgactagagcaaggtttggtgtttcttcaagcttcagccatacatggaccgaccagcctccagtgtggtcggagcagggcagtcgtccttctctgacgcaccttggtctttctgcaagatcagtccagctggattatctggatcttgcttacttgtccaccagtctggagctggggctgcaggtttcagcaggctatgatgaacccaaggtgtgatacctgcaactttaacagtggtaggggtagacatgattgttgtgggaagtcaggaaccccgaatggagggactggctgaagccatggcagaagaacatggattgtgaagatttcatggacatttattagttccccaaattaatacttttataatttcttacgcctgtctttactgcaatctctgaacataaattgctaagatttcatggacacttatcacttccccaatcaatacccttgtgatttcctatgcctatctttactttagtctcttaatcccatcatcttcgtaaactgaggaggatgtatgtcacctcaggaccctgtgatgattgctttaactgcacaaattgtttgtagagcatgtgtgtttaaacaatataaaatctgggcaccttgaaaaaagaacaggataacagcaatgttcagggaacaagagagataaccttaaactctgactgccggtgagccgggcagaacagagccatatttctcttctttcaaaagcaaatgggagaaatatcactgaattctttttctcagcaaggaacatccctgagaaagagaacgcatccctgagggtaggcctctaaaatggccgcttcagggggcggccatcttttatggtcgaagctgtagggatgaaataagccccagtctcctgtagcgctcccaggcttattaggacgaggaaattcccacctaataaattttggtcagaccggttgtctgctctcaaaccctggctcctgataagatgttatcaatgacaacgcgtgcccaaaacttcattagcaattttaatttcgccctggtcctgtggtcctgtgacctcgccttgtacactccctccccttttgaaaatcactaataaaaacttgctggttttacggctcagggggcatcatggaaccggctgacatgtgatgtgtcccccggacacccagctttaaaatttctctcttttgtactctgtccctttatttctctcttttgtactctgtccctttatttctcagaccggctgacacttagggaaaatagaaaagaaactacgtgaaatattgggggtgaatttcgcctgatatctggctgaatttcccccgatacatgatcacaacatgggggccatcccataaaggcctgagggtgatggggttccaacgtttaacccatacagagtctctgggttgaaagggttgtactgcatctgtaagactaacaggtattctctgtcttacccacccttgtacttcttgcattacttcacctaatgcctgcatttgtctccttagagttagttctcctatttcttttaaatctcctcttatttgagctatgagttggggtggtcggccatacactatctcatagggtgaatacccagttaatttagtgggggtacacctgactcagagaaggaccattggcaacacctgatcccaccttaaatgagtttcctggcaaaacttcttccacagttgtttcagtgtttggttcatcctttcaacttttctggaactctgtggatgataggcagtacgcagcttccgtttaacatttgggttaactgctgcactacttctgccacaaaggctggtctgttatctgagcctaaagttagtggcagtctaaatctaggaataatgtcttttagtagtatcctggttacttctcgagccttctctgttctggtgggaaatgcttcaacccaccttcaaaaggtgcagactaacactaacatgtactgatagtctccagcccaaggcagctgggtaaattctacaagcaggttttcacatggcaactgctcctgtttcttgaattcctgggggccgagtgggcccttgtctggggttattttgagcacatatgacacattgctcgcagatggctcctgtgacggcagtcaggtgtggtacaaagaagtatcaccctacaagagtttctaaggctgtcttccttatctgtgttccttggtgaagttgctttataagtcgaggggcgacggcttctgggatggcaagcctcccgtctgaaaacttccaccagcctcctttctttgataatccccgttttcctgtgcgaaccatgccttttcactggaggtgtagttaggagtttctgcaaggggaggttctaataagggcatgacataagtctctcttttttctgtcatttttgttattgcagccctttttgcttccctgtctactttcctgtttcctgtagcctcattacttcctcctgtttgatgtccattacaatgaattaatgctactttctttggagtccatactgcctctaggagctgctctatttcttttttgttctttatttctttcccttcagtagttaacagtcctttctccttgtagatggctccatgagcatgcaaggtagcaaaggcatattttgagtcagtatagatattcactgactttccttttgctagaagtagcgctcttatgagagctattagttctgccttctgtgcagaggttcctactggtaaagggcaggcctcagcgactgagttcagtgtggctactgcatatccagcctttctgataccttcggatatgaagctacttccatcagtaaaatactctatgtctgggtcctttaggggctggtcttttaggtctttccggcttgaaaagacttcatctactgtttctacacagcaatgataccctggggcacataacgggggcttcccatgctctgcatattctattggcagaagtgtagccagatttagggtgtttacagtctctaaggtgatgtatggattttcacacaggagccattggtatctcagcattctagggttagagagccaacgatgtcctcctctctgttccatcagggtgacaactgtatggggcacctgaattatcaacttctgtccaaaagtgagcttgttagcatcctcagctaacagagcagtgacagccagcaccttgaaacggggcggccatcctgtggccacccagtccagttgcttggacagatatgctacaggtagataccatgaccctaacatttgcaccaagactcctgtggccatctcctttctttcatgaacatacagataaaagggctttgtcaagtctggcaacccgagtgccagagcttgaattaaagctttcttgatttccttgaaggccatgtcctgttcttttccccaaaggaggggctcctttatccccactttggtagcctcatataaaggttttgctaagagcaagtagttggggatccatatacggcagaaaccagccaccccaaggaactcccgtacatgccagtgtcgtgtctggccaaggaatgctacacacagtctcttttcgctctcgcacaagctcacgccgcccttggggaataggaaaaccaaggtactgaactccttggccacagatatgtgcctttttcttagacactttatagccagcctcccacaacactcaaaggagattctctgtcccttcgatacattcctttctagtgggtgcggccaacaataaatagtcaatatattgcagtaagatacaccggtcactaggtggcgtgaaagccttcaagtctgagacaagcccttcctcaaagataggggagttcttaaatccttggggaagtctagtccaggtatactgaggtggtccccactcaaaagcaaagatgtctcagctcataggggctaactgaatgcaaaagaatgcatcttttatgtccaggcatgtgaaccaagcagcactagcaggcatttgtccaagcatagtatacgggttaagtacaacagcatgctgtgtagccgccaccttgttgactgcctttcagtcttgtacaggttggtagtcaccagacggttttaacactggcagcaagggggtattccaggaggaggtacattcttctattatccagaactcaaggagtctttttaaatgtttttcaattccccaataggcctccatgggaatgagatattggcgaatccgcactggataggttctgcgcagtaactctactaccgcaggtgctctattcactgctagcccggtggggttgtcctctgcccagacacctggcaatttaaggagcagatctgtaaacagtttttctcctttagctacagtgtatctctttccacattcttgacaattgctttcgtaaagcctccattcctctgttttttgaatagtgagtgttaataccatagcctctttcagtcctaggcttaaggtcatatctccactgggtgtaaaggagatctgagcctgcaacttgtgtagcaagtctcttcctaatagtggcactgggcaatttggcaaaataaaaacttgtgttggacttcttggttcccaatcatacacctcctagatttgaaaaaaggtgtcttttctgtggtacctgtggctccgataatgttcacatagtcctttgataacggtccaattgtctgagtcacaaccgagtgttcagcacctgtatctatcatcaagtctgttttttggccccctactaccattgagaccataggctcctcggggcccagtgaaatggagcttggtctgtctcagtcctcaagataatcgttggctcctgccagcccagttagatccatgtctgctcctattatgtcctgttcagtggcagaaggaggtcctatccagccattccgtccctggttgttgcctttatcttttcccttctctgggcactcatttttccaatgccctctttgcttgcacctggcacattgatatctctctagtcttggctgtccttcctgacctgtcctggccttctggcctgacctagcttgttctctaccttgaccacatccttgaccatgtccatgccctcttgcaaatctggcttctctttcaaccaaagctgcggctaaaaactctgccttctcctttgccctacacttggcttccctcttagcttcttcatcccaattcacataaatcttggttgccacctggattaactgggatatgttcataccctcaaacctttctaatttctgcagctttcgttttatgtcattctgtgcctgacttacgaatgctgcattaaccatgcactgattccctgctgcttccggatcaaatggcgtgtagagccggtaagccttacaaagcctttcacagagctcactggggctttcatctggtttttaatggacctctgagacttttccaatgtttgttgcttttttccctccagcttttattccttgtactaacacttctcgatatctcaacaagttctgcagtccttgagcctgatttgggtcccagccaggctctatttcagttggtaaagcctgctgcgcatactgcttaacattggctgtgcccacaggggcattgctctctagccactgatgagccgtttgtattacttggcagcattcgtctgtattaaacagtgacaggaaaagttgtttgcagtctgcccaagttgggttgtgggttagaaggatggacttcattaggtcaatgagagcctggggcttctccgtataggagggagtatgttgcttccaattgaaaatgtcagtagtggacaagggctgatagacataaatctgctcccctccctgaacttcattttgtgcgtctaaatagatttgccctctggtctcttggaggggcatttgcgtggctcgggcacgtccggaccagagccagcctgccccgtcctgaaactcctcctttgatttatctggcagtggttccagtccttcccactatggggaagtttggggagtactctcttatgaatccaaccctccagaggtggctaccggagcagcctcttgcctaagcctctccagagatgggtagattggaatgtagtggggtggagtttccaactctttgggcggggcttgtaggacaggtttttctcattttccttgctgctccttctcctgagacagcgctttgtgggttctacagtgccctgatttgcatgagccactaaagtcttacaatcatcttcaaagcaggcctgtagccattttgggtggttctgaattacgctcagccaggagtctatatgtggaaactgatcagggtgcccaggttgttccccgactctggttaccacccagaacactcggccaattgtttccctatctatggttccctcggcagttccaccctacattaaaagagggccagtcaatttcaaaaagtgttctcagcctctgtggtgttaacttcattccataatcaccatcaaagcctttcctaaagttcttcaacatacattctgatggagctggcttccatgcatttcctcccatttcttccctttcggtgcactttcactctcactttcactctcagagtcaccagaccaggtcctattatgggaggttcagatgctgcttggccaagtcacagccaactactgctgtgaaggtataaacctgatcctgtcggccttatgcagcgacctaggtctggctcgtcccacactcacttccgaggacacagtctgcgctgagagacttatgcctcccaacatcactccccgcattggcctctcacaagactgtctctttcatgctttttcacacacctccccctttctcccaagaaccagtgtcctgagactggctcatgaactttgttcatgcccaatgccaatctgggcgtgagttttgtctgagtcaacaggcccctcccgttgattgctctctagagtaggactaatcgccgcaccctgagaggtgatcaggctccccttctgtccttatgggacgggctttcctagggcccaaatatagcatggttcagtagtctgcctgcatgctgctcctgtgactgtcctgcaactcccgagtcggttccgtttgcgctgtcaagtgaaggcttcaagacacgagagagccgttctccttctgggtaacttcacccagtggcgccaagggtcccaaatctcccgcgtcctggggctcaagcccataggtaaaggagacaaaaacctaccatctccaatcccggatgagcccccagaaatgttgcaggacaaatgagagatgggagagacagaacagagttcaggagagccctttattgttaaggtgatcacaggctcagtcggactagggtccagaaagtctgagccctgaacaaagggatcaatcaccttttaagtagtttgtggcgggagttacgtgctgcaggaagcgtacttgtggaagcaagaacaaaggcagttaatcttttttttacatttgttgcaccacatgtcttacatccttgggaatacatgtttttgtagcatttgcttatcaaccttgtgacttcacagccgcgctagggagggaagaaagaactcgctgtgcctcaaggaatgtgaaatgatggaacacagataagcctctctgagcatagaggagaaataagcagttaatattctctttcaacccaggcctctgggttgaggggctatattaaattctacctttaaggaaaagaataaatttcttgactattacactcataaaattcattaattcccccttcaagagtacacagtttgtatatagttgactacgcaaataaatatatgtatgtgtatggggatgtgcactgtatttgtatattctatatgcagtgaatgctctttagtaatttattttatctcctttttttaaaatgctgttgctggctgacaacattaaccttatgatccaccatggattaaaaaccagtttagaaacgactaaaaccttttcagagaacatccttatgttgctatagaatatatgcaaatacacgtgagaacccatttttgtccacctccttagcaattcagtgtttttagacaaaaagttcttctttgatatgggccacaaagacaacaacaaaaggtacagttactgatgaaatgtttgtcagttatcagcgtctgttttgcacaggtgaagtcttacttgcacagacaggaactcacaggcaaaagggacaaaaaatacacgtgacttcttgtcctcttggtatcacatgcaggctttgcctgggctgcagcatagctgaatgtcatctatggcatccattcacagggggacctccatttccctactgtgctcccatgttatgggacaagcaggagagttgcactgaacatggtaggtagtaaataatttggcctcaaccacaaagcaatctgagctcacatgtcagtgtttaccctgtgccctgaaacttgccagctgctcagaatctgtagactttgtcccacccaccaaacatcctgtggaaatctaagtttggtcatagattcccgtgcatggaagatgggaagctctgctcatgtgggaaattgagccctcccacaggtagactggctgtgttggtcccagctctgtttcctcccttagcagctagagagttgctagggtcatgtatcaggcaactcttctctctacagtgtcttttatactttctgttgcagcctgtgagtcacaagggctccttcacagcttccctgatcccaatcctattatgatcctttgaactcatccagcaagtctggagttatattccataggaatggcagcaggaagctcaaatttgacatgaaattcaagcctgccctttgagctggagtgaggccactcaggaatcattaaagtccaggtctgtgtgtgatggttaatattaagtgtcgagttcattggattgaagaatgcaaagtattgttcctggttgtgtctgagagggtgttgtcaaaggagattcacatttgagttggtgcgctgggagaggcagatccaccctcaatcatggagggtaccatctaatcagcttccagtgtgggtagaataaatcaggcagaagaaggtggaaaagctagacttgctgagtattccggccttccactttctcccatgctggatgcttcctgccctctaacattaggcttcaagttcatcagcatctggactcgtggacttccaccagtcatctgccaggggctttggagccttcagccatagactgaaggctgcactgttggcttccctacttttgaggttttggaactcggactggcttccttgcacctcaacttgcagatgacctcttgtgggacttcaccttgtcatcgtgtgagtcaatactccttaataaactccacttcatatttacatctatgctattagttctatccttctagatatcgctgatacaatacagcgatatatatatatagtatatatacatatacaatatatatagtatatatacatatacaatatatatagtatatatacacaatatatagtatatatactatatataatatattaatatattatatatattaatatattatatattaatataatacattaatatatattatatatatcgatatatattatatatatctatatatattatatatatagatatatattatatatatctatatatataatatatatctatatatattatatatatctatatatattatatatatctatatatattatatatatctatatatattatatatatcgatatatattatatatatctatatatattatatatatatgtattgtatgtgtgtatatatatatatatatatatatatagagagagagagagagagagagagggagagagagagagacggagacttgctctgtcacccaggctggattacagtggcaagatcccggctcactgcaatctccgcatcccgggttcaagtacttctcctgcctcagactccctagcagctgggattacaggcactcatcagctcaccaggtaatttttgtatttgtagtagaaacggggttttggcatgttggccaggctggtctcgaactcctgacctcaggtaatctgccccccttgacctcccaaagtgctgggattacaggcatgagccaccacgcctggcctccctcactttaaaagacccactttacgccaatttcaaaatcagaataaatatacctaaatccctttgacctctaacatactagtgcccctgtcaaggtagtgctctcccttacggcattatgcaaataatgtcagccctgccttatgaacaggctacttggctgatacttgaggagtacagtatatgatgcagatagtcaccactgctgtgcatcatgtcacagtagactgcgcctagatcctgtcatcaatatctatgaatatttctgaaccataatacacagtgtgaatgacctacaggtatattcaggtaaatcagttaccattccacagatttaaacgtgcaataacacaatcttaaaaaaagtaaacacgtgtgaatatatttagtctgcagaagagtttattccattacattcattagaagcatggcagaaaactgaaaaccagaggaaaaagtgattaatcaaagcatgtataaaaattggccaaggtgtgaggaccacttgagcccaggaatttgagaccagcatgggcaacagagtgaggcccccctctaaatataaattaattgcccaggtgtggtgttctcatctctagtaccacccacttgggaggctgcaccatgaggattgtttaaacccaggagatcgagagtttagtgaggtataggacacatcctccattaaaggtgacatgagactgtgtgttcacaatgtttctcaatgcatgagattgtttgggcaaacaaaaacaaaagctctctttagtctctctttccttctttccttctttctttctttctttctttctttctttctttctttctttctttctttctttcatggagtttcactcttgttgcccaggctggaaagcaatggcgtgatattgtctcactgcaacctgcacctctgggttcaagcgattctcctgcctcaacctcctgagtagctgggattacagacatgtgccaccacccccggctaattttgtatttttagtagagatggagtttctccatggtggtcatgctgatcttgaactcccgacctcaggtgatctgcctacccacctcggcctcccaacgtgctgggatttcaggcatgagccactgcacccagcctagtccccttctttctactataagcaccccgtggatgcgggtatgagaacagcaggaaaaccatggcccaccctgcaagtcctgcaagtgcctgactcaatgggcatgccccttgctatgtaagttcccgctgcccatgcaccttgctgtctgccttctgtccctgcagagctgtggaaggaaacgtcgtgactctttcttgccaactgtgacatagcaggtaggtctgcagatcagtcctcccagaagttgaagtgtcagtgagtgtgagggaaagcagagggcttcccatgggttggaccacttgttccatggcctcatagaggtcgtcatccttcaactaaaaggcagcaacaccgccatggccttgctgttgtggggtcccgggcaagggaggaaggagggccgtagaggggaggaaggccaagtaaacatggaattagttgaagcatgacattatctgaggtatttcagtctcgaaggcataaaaaaccacagagaagatggattccaaagtccttagtggggaccttggaaggggcagaggacagggcaggaccggaggaggaagggcagtgcagcccttaaggcaagagaggacctcactgtgcatgctcctcgggtgcccacctcagtgcacatgttcactgggcatctttccatctgcccctttgcccatatggtgaacgctacggggttgtcagcctgcagctcgggaccctgaggtctggattctttctccactactgagacgcagccggtaggtccacaggccaattcaactgggagttgaagtgtgaatgagggtgaggaggagccagtgggctttcggaggctcgggcatcgtggtcggtgactccaaaggagaagggctttgaggtcaccatccttttcatgccgcctggcgactatgggccttcttgtcttgttggagtctgaacaaagggagaaggagggcctcagagtgggttggggggtggtgtaggtgaagccagggtgatactggggtgctgttggtggtatccgagttccagaaacgcctgaaaaccccaacagaggacagattccagactcctcaagggggatcagggctgggacggcttgggcggtaaggaaggggcctggaaagtgggaactcttcggggtggtgaccttggctacaaggtgtgtatagtgccctgcagaggtgcccaaccagtgaggaccacccagcgctgtgtggcaacttctcaactccatcttggaagttccaatgggtggggctctgcgttccaacaaaacttgattttcagggggaaatgggcctagcaactgggtgtgtgacaaaagccatggtcagtttaattttaattctcaaggtgtattttcctaaatgcgtcatgatggagagtccagctgtgaaactaaacctcatcggaaataccatgtgtcttgccatgagcattaagacattgctcagctagcttgatcaaattaagtggctgtgcaagcattcgattcagaaggcatgcacattgatacatgccctgtgtcatacttttcaatatattaccaactttttaaaaaataacaagttaacatttagccatggaaatgctcaaatatagtatcctcttacatgcattttcccacagtattctgtttgcagagtgaaatatgagttggcgaggaagattaacatgtagatcaagacaatatttacagcctgttcagccgattgggcctctgcttgtgaatgtcttaccattcgatgttttctatttgcagaaagttatttttctgatagtgttgttggactcgtatagatacactgataaaggcctcccatgttgataaaaaatgattgtggcatctcatgaaggaaagactaacccaagaagactaagtactggttttgcgtggattttgctgatgattccttcctcatgcttatccatagcacattacatacattcaatccaaggtaaattaaaatggcttccaaagccattgaggataactgccttagagtaacctctctatgggaagagtaactttatgaagaataagtatgtggaatagtgtggggatagtgttggagcatgtctttcgacatgcttatgatcagaagtacctatgtaatctgtatattcatattattgacatgtattgataaaactttgcacacacacagacacacacacacacacacctcgtcccaggagcccagtgtgccagagccttaacaagaggaaccacaagctgaaagtcagaatggtacacctggtcagaagacagaagaagatcagggtgcagctgagattcgaggtggtgggaagggaaagaaagaatgtctatggggggaaggaggcctgtatgtgcatcatgccctatgccatgaccagtaacaggaggaaagaaaacattaggaaaggatctaaaacatttgctgagagttggctggaaacgtgacaggcatagtttgcagcttcttgcagtccctggatatgatgattcttctctttttcttcgagatgcattttgtaggcttgaaaatacagttcttcctaaatcagatgaaactgtttaattggttgtataaaaatgtacattatttcactcatttaatttgatcttcttaggatgttgcagtgtgacctcctcagccatgctgtccacagtgttgtaagcaccctttaataacatgtggagtgtcaagtcaccctaccttttaacatcctgaataaagaccatttgcaaagggatgttagccccattttatcaataagaaacctgagacttggagatagaggttttccaagaccacttgactcatggagaaggaattcatattttgttccaaggtttgcattctttctaccatctatgttgttagaaaatatgaatgattttgcttacgaatgtttaatactcggatgtctctgtactataagatacttcaatattggctcaggacaaaacacagttcagtgaagcaggatagcaaccccagaaaagagctcagtgaatgaaagccactgttgcgttttcctctgtatttttgacagtatgtttggtaaaagctggctaattcaggacactagcatacaggtagctatattagtaggattttgaaagggcttttaaaagttgtttaaatacttttgtaattagaaaccccaaagtacgataagattatcatgaaacagaaataatttcctcaatggataacattttaaaactaaacatagaccgaatttgggccatgtattattttagcaattcactgttgagggatttccagaatatgagtcaacaatgcccattaatttctttgcacttcagttccagtactctcactggaagacagtgattttgctattatattctgtactgtttcttaatggcaatcatgtatggaaagtcacatagagggcctttggacctaagcatcgctttaattaagtttaactccaacattttcaaggtacctcaacacgggaggagtgtcaggagtgtaagatttgtcatagggccaccaatacattgatctaattcttcagaaaattacatttaaggtatgatttaattgctttccatggggcagtcttcagaattcccagatagcagatactcactgtttataatacacaaggttaaagtataggaaacagaggtgtggtgtgatttatcctcagattgtcatttaagataaggtatcataatacaggaaaacaaaggcgtggcatctttgcatcacatttataaccacagttgcctacaggcttttattgcgtaacactgaggaaaagaatattatcatttccttagttatctcctttgcctgctttaattaataacctttgtgtttttcagcgcctgacctggcagctgatttccaggagctgtctcagtcaaagactggggtaaaggcagagatggtcctgatgtccaggggaagattctgccaaaatcagagcaatttaaaatctcataaggaggtatgttatccattaagattcagaattatatgctttctgttttccataaaattatatttttgataataaaaagagagaacatcactgcctctttaaacagagttcaaatgcagacctttcttggaaggtagttcagacccaacatgcctgactgcaagactgaaacactatcagatacagaaacaaacaggctcaaagccatattgaatcatcaaataggaaagcattttcttacttctgagtatatccaacagctaacaattttcatattattttctaatttctgcttttcatgaatgcataatacatttgtaatgccatcttatatgaaatatgctgatccctgaaggagatcctagtaccagctctaacataatttgtgagattctggacaaatcacataaatcctacacccatttttgcttttattgaaagtagtgaatgcacatcagatagactaaaatccatttcaatgctgatttctgcatgctctggttctgttggagagaaaacaaagatactctgattttcatgatttgtttttcgtaacaatcatcttcagttcaattgtaatatctgagttgagatttcattgctcctaagaaaatgagtggggactctgcttgatctttgtttttgtgaatggagactttcatgagtgttcttggattttgtcagattctgaattctcaggctcttaaacaatgattgcattttaaatctttcccgcagtgaaggctcgaatgactgaataataacatggcaagagacagtcaggtttctgtggccgataagtagggagcatgcatgtaggtcagtgatgctcaaggtgggtgtaagatgcctgtgctaagcatgatccctgccctccagtcccttcatgagctactgtgtgtaattagattgaagacacatatgataggatcacctctaaccatggtttctgccttcagtcatcagatgatacgatgtaaagttcaaagactgtaatgtaccaattcctgtgtagtagacataaatctcttttacacacattttcaaaattgctgacttaattagaagaacttctgaatttaaaggaagcattgcatgttcaagggagaaattacctaaatgtttttactctacactgcagaacccttccattcgactatttatattaaaagatagtttttcagatgattttcaggagcctattgaaaaggcatcagttgaattcttcagagagtcatagccttaaatgcacatcttattaaaatagatagcaaattacacgatacaagaaaataataccaagaaataaaaaaattataaaagagtcacagaatgaacttaaggaagaaggaagcaggcagtaaataaaaggtacaaatcattaacaaaaggaaaactaatctaaaattaataaatttaatagattgttcttttgagaaatagctgtgaagagagcatctagtagtttacacaatcttgaagaaaatggataaagcacagcacggaatatgagcaagacacagatattgagtgtagggcataattgaaagtgaatacactcttgaatactaatattttcagagtatggatgaaatatttggcatgctaggaatgcctacattattcaatctatccttttaatacctgaatatctgaacatcacaaagactctgtatgagcttgtgaaatttggcagttgtccctcacaacaattacttttagaagcaaatatttagctttcccagttgtctttctctcctttttcatttccctctccatttcttttttttgccacactgtttacgatgcgtacctctttcatagtgtaatatcaataatgacagtgacagcttaaaacttgtatgaccatttaattaattatacaaagaggaatactttctggtgaaaaaactatcattattcatattaacatgaggtctgcaggtgaaaactagatgcaaatggttactgtatgttaaaacacacacacacacacacacatacacagagagagagagagagagagagagagaagagtaaactagcccaaagcaatatttttacacttctgcataatagagaaaaaacaaatgcaatactggcctttctattcatttcacttatgtatttcctaatgtaacattaactattttctcaaaacatagttttctgactatttgcaggagcccattggatatccagaccatagtttcaagccaaaacattaaattatacatttttcacaaattccttctgtttcttaggttttttgtgttctggttttattttgagtaaaaccctacacaatgtttactatctaatttaacctcttttaataggttcactggatttaatgtattctgacctcggactgtcttttggtttccttctagcaccaaaagcaggttgtgtttaaaacatgttgctaatgtatatgcttggaagtctatcttcaaagtctctacagagatctagttgaatgctagccatagggtgacttttaggcttctggttttagtccactgtataaaactaaaactttggtgtcctttgtatacctttcatttcatctgaatacagttctgctagtaatgttccctcctgttatatttttgttgcaggtaaagggcaaccacaggtttaaacgaaaacaagctgaaagaatgcaagctgaatttttctgagatatttggctttaaaaaaatctcaataaagcttcacagctttctccaaagaagtcttgcacatcttttgttcatttattctcacatattagacgctaatgaaaattgtggctgggtgcagtggctcacacctgtaatcccagccctttgggaagctgaggcagcaggattgcttgagcttgggagactgagatgtgcctgggcaacatgggaaaataccctctctgcaaaaataaatgaatgaatgcatgaatgtattcatgtatggatgtagctgtagtcccagctactctggaggctgaggtgggaggatccctggagcccagcaggtcgaggatgcaggtagtcacgttcatgccactacaactccagcctgggtgactgagactctgtttgaataaaaaatagtacaatttttcaaactttgcattctcattgatctggtatccacaggtgtggtattgtgaaatatatatttggtcccacaccccacttactgatatacaactcctacaatatttagaatctccacatagtgatgccagtgagttgcctgaaggctagcagttcctaggtagctctaggatgggggattagagcattgggactttcagccccatccccaacattcagggcagggagaggggctgaaggttaagttgattgccaatggttggccaacgggttaatcaattatgcctatataatgaaaacctccgtcaaaacccaaagtatagggttcagagagctttaggctagctgaacacatggagggtagcatgcccatagagggcatggaagctcccttccccttccttcattccttcccctatgtaggtctttatatgcaccctttgttagggtatcctatttgccacaaaatatgtgagcattccctaggccatatagctggatgaaagaattagggcctaggtagaagaaaggggaaagcaactagggcaacttcctgaagcaaaattacttcggtcctacctacactgtctcttataagttatgatagccatgggtttctatcctgcttctcacacactggccttgacatggtgggcaagacacatcctgtgggactgtttacccatttctgaagttgaaattacaatatttacactaaacagttgctatgaagaataaatgaaataacataggaagcaggtattacatagcacataaatttattagttatatttccttaatccctttaaaattttaaataatgttctttcattttgcattataattacatctctagtatgttaccgatgctttggaatttcaagtaggaatatcaatctaccttcttaaatgcatttgacttcacaagcatattttatttaaatatgtaaataaaatagcaatgtagctggtatcagacatgacattgattctgaagctgatttgtaaataactgaggtgtgacaaggccaaccctatggcagcagtttgggccaaaaaatttctttgttgtgtgtgatgccatgaagaataagtcaatattctggtcaggtaacaccacataactcaaaacaatagtgtgtcagttgctcaagcagtccctaagcagccctgtggtggctaatggggccacaaggatcaccagtgcagttgcttttggcttgtcatatattcatagatttgctgggtaaaaagacaatgaactcaaattgatccaagtggttgaacacttgcagacgcagctaatgcagatcgacactgtctcagcactgtgtccctagccccgcaataccacactgaatcagagatactcagtgatagcatagatgttgggtctctctgcctgggagtagcccacagtcataccctaaggccaaattggaaaccacactgaatcctgaacccaagatcacccctgacagaactgcgactatgggacagcaggggtgacccagctcccaaacatcccacacagaacacttagtgatgtcatccacgcttgtgaagaggagaaactggtgtcaatgagtaccctgaacttactgccttctaacagtttgcctaaatcaaagacccaaatgaattgtttggactggaagaggaaccctaaagggaaaggtccctcagtgggaggccacactggaggccttggccagctcctgcctgatgaatgtatgacctgctgggggtgccctaacaagagtagattcttggtgcccaggagtaccacctatgccctctgggattgtttttacgtgtgtgcactcactatccatcactgccttatccctggaaggcattcacatcagcttcatcttcctggccagagttgtgctgagcctgaaatggtggctcacgctggacaaaaatggttaacacagaatcttaggaaggaggtcccctgcctttctaagatagaccttcatcattaataggatttgtataagacggctattatgggaaatctgatgtgtcaactgtgttatgccataaagcacaaaaaatgttcactttgaccatggtagatgtctctgtgaaaagttttctccacataagaactaacatgtacattggcagactttgggtatacctaattgccctctataatgtcggtgggcctcatccagtcacttgaaggccttcagagaaaaagactggggtcctttcaagatgaagaatttctgcctccacactgctcttggatttgagctctcatatcagctcttccccaggtctgcagcctgacatcctgctctgcaagatttggacttgccagcccacatagttgcatgacccagtacctcaaaatcaatgtctctcctcaaaatcaatgtctctctctctgtctgtctctctacacgcatgcaaacacacacacacacactcacatgaacacagagtaactctaaccaataggctgcttacatctgggacccttaaggggcataactgagatcactactgcaggttggtctcactctgctgcatggctcctaaggcagaggcctgtggcattcccctcacatcctctgcagactgacatccaaatggcttatcactgtgagtctgggtttggttatccaaccatgtagagatcactacaattccacaggtgttccctgccctccttctgcctgtgagttcttctgttctatcctgaggacacacagatctactgggtatgtttccaaacttccaggaaggacctgggagcctggtgagggagatacacctgcgaagggaacttcagtgcagtaacagcaatgggcataaccggtgtgttcaccaaatcacgagagatcacactaccaacatcgcccacttgattttccccatcaactaacagcttatcttggaaacgatagttttggtagctaagttagactccccttattctgttttccacaggaatccacagattcaaagcaaactgatactgaaatgttgtgtcaaattggaatgcaagaatggaatgccctgtagtggtatgatttctgaagcagtcaataagtctttataagttcccagatgaagcaacatacaagcattcctcagtttacagggagtgacatgtttggaaaatccagttacaagcttaatttttttttaactatagactccattttttaaaaaatttagtataattttcgaaattttgtattctgactcagctggtatgcacagttatgatattatgaaatacatatttggtcctagaccatgcttcctggtatagaactcctacaatttttaggatctctacgaagtggtgtctttttgtatgctagtgagttgactgatggctggcagcacctaagtagctctaggctggggaataagagggttgggactttcagcctcacccccaaacatcagggaagggagaggggctgaaggttaagttgaccacctgtggcgggccaacggtttaatcaatcacgcctacaaaatgaaaacctccatgaaaacccaaaaggacaggattcagagaggctccagcctagatgaacacatggaaggaagcatacctgtagagggcatggaagctccctgcccctttccccagacctcaccctatgtgtctccttatctgcttcctttcttagggtatcccatttgccacaaaacatgtaagaagtccctaagctacagaactggatgaaagaattagggcctaggtagaagaaaggggcaagcaaccagggcaacttgctgaagcaagatgacttgggtcctacctacactctctctttacaggttatggcatgaaatagtcatgggtttccatcctgcctctcacatactggccttgagatggtgggcaatatgcttacatcctttgggactgtttcccttcttccaaagtagaaattacaatatttacactaaatacttgctatgaagaatgaaggaaataacataccaagtaggcattacattgcagataaatttggattactacttagatttcctttttccctttagatttcaaacattttcatttcatttttccttataactgcatctctagtatgtgataagtgcttttgaatttcaatttggaatgtcaagttacttttaatctgcatttgacttcagaaaattatttgatttaaataaacgtattagtgaaatagcagtgtagctggtgtcagacatgttattgattctgaagttgattggaaaataaccgaggtgtgataaagccaaccccaagtcagtactatgtaccgaaaacctgtttgctatgtgtgatgccaagaagaataagtcaatattctggccattcagcaccacacaactcaatacagtagtgtgtcaagtgctcaagccatccgtaagcagccctgtcgtggctaacagggccacaaggatcaccactgcagttattagtttaccttgtcacatattcatagatttggccaataaggagatcatgagcccaaatggatccaagtggttgattgcttgcagacacagcaaaagcaagatcagcattgctttggcaccatgttcctagtcccatagaatgacagtgaattgggggttctcagtgacagcaaagatggttggtctctccacctgtgaggagcccacagccgtaccttaaggcagtgggcacttttatactccataactgtaccctaagatgaggaaaggtctgtgcttacctgaaactagggagatggatgaagaatggccttgtttcagcctccaaccagatagggaactggtgagaaataacctgtagcagttcccccaccatgcttcctatctccccttgctccaagggcattcaatgtattctgccaagactcaggttagactggaatctagttttgcatatgtgccctatgtggtgacctgttagagctccagggcaccgtggcagatgcattaccctagagtgtccagcacaaaatcaaggatcatatgtaaggtgcctggaaacatatcatctacaataatgtctcctaaacagaggcgatgcttttctgttaggatcattacagaagatagattattcaattcagtagacatgcactgatggcctgccatgttacaggaaatatctggggtgctggaaattggaagaccaaccaacaacacgtggtactttccgtgggggctatcacactgtggtggggtggagagatccttaaacagaagagcagctgaagtgcaaaggagaaacacagggaagggagccatgggaataaaaaacaatgaatgtagtggccaaagggaaggaagaatacatccttaaggtatgtgccttctatgccgattttgctgagggatttaatcataaagcgatgccggattttgtcaaatgcactttctgcatctgttgagatgatcatgtgacttttgtttctaattctgtttatgtggtgtatcacatttattgacttacgtatgttaaaccatccctgcattcccggtatgaaacccacttgatcatagtggattgtttttttgatatgctgttggattcagtttcctagtattttattgaggatttttgcatctatgttcatcacgtaacataaacctataatgtttaatcaattctccaaaggaaagaataaagagataagccaaggaatacatgaaaactgacagagagaagcaagtacaacaaaatagagtaatgtaaatccagaaagacaactaaagtacaatggcatcccccaaataaacacatagaccgagggaaaaaaatgcagagcccagaaataaatccatgcacttataatcaaatgaatttgacaaaggtgtcaagcacacacagtgagggacggacagccttcaataaatggtaatggcaaaatggtatatccacatgcagaggaatgaaattcaaccctcatctctcaccatataaaaaagtcaacttaaagtaaattaaaaccttataatgtaagacccgaatctatgaaattactagaagaaaacatagggaagaagctccatgacattggtctgggcaatgatttttttgggatatgattctaaaagcacagggaacaacaacaaaagtaaacaaataaaattatctcaaactcaaaaacttctgcacagcaaaataaacaatcaacagtgtgcaaagacactttgtctcctcctccttaatgcctcctccttaatgcctcctccttaaggcctcctccttaatgccgtgttatttcctttgtactgaccacaatatttctattcttttgatgtaaataagaagtgtgactatacttcttttcaatcataaacttgtggttaatagccagaatatcatcgcctactttgggatattttcgacatttccaagtgcagctgtggttgttggaatgattggtaggggctactggcatttggggactcagtgtcgcagggaggcaaacatcttttgccagagtcttcaataaaccggattttccatacatgtcacttcactgtaaactgagggaggctggtatgttgcttcatctgggaagttatgaaagacttactgactccattggaagatcacatcacttcaggccattccattcttggatcccactctgacacaacatgccagtatcagtttgctttgtagctctgcatgcccgagggaaacaatgaagggaatccatcttacctaccaacaggatcttttccaggataagcttcaccacacaccccagctggccccaaaccacttgttattgttgtttcagaaagggtctgttgctctgcctggagtgcagtggagaaaccatggctcactgcagccttgacctcccaggctcaagtgatccttccatctcagcctcccaagtagctgggaaaacacacaggttccaccacccctggccatttttttatttttttgtagaggtggggtatccttatgttgcccaggttgatctcaaactcctggattcaagcaatacttatgcctcaacctcccaatgtgctgcagttaggggcatgagccacctcacctatccctgaaccactttttttttttttaatcacagaaaccaagatagaggaagaaggagcctgcaagccctcctggggaaaattgtgtccttcttcatgctaccctgctatttcctctgcaccaactccaacattcctattttttgatgtaaataagaagcttgaggatactttgtttcaatcataaacttgtggtttattgccccaatatctttgcccactttgggtcattttggaaatttttgagggcagctgcagttgttggaatgattggcaggggctactggcatttggggactgagtgttacagggaagcaaacgtctttttccagagtcttcactaaactggattttccatacatgtcactccctttaaaccgaggggggcctgtatgttgcttcatctgggaacttataaagacttattgactgcttgagaaatcacatcactgcagcgcattccactcttggattctactccgacacaacattccggtatcagtttgctttgtatgcgtccattcctggagaaaatagaaaaaggggaatgcaacttacctatgaacgtgaccatttccaggataagctgttagctgatggggaaacttaagtgggagatgttggtaatgtgatctctcatgagttggtgaacacactggctatgcctgttgctgtaactgatgttgcatatgtatgtccctcaccaggctcccagtgccttcctgaaggctggaaacataccctatagatctctgtatcctcaggatggaacagaggacctcacatacagaaggagagcagggaacacttgtggaatggtagtgatctgtacatggttgggtgaccaaaccctgagtcacagtgatgagccccatggaggtcagtctgcagagggtgggaggagaatgccatgcagcagagtgagacgaacctgcagtactaatctcagttacgccctttaagcatcccagatgtaagcagcctattggttagggttcccgtgtgtgtgtgtgtgtgtgtgtgtgtgtgtgtgtgtgtgtgtgtgtgtgtgtgtagagattgagagagagagagagagattgagtttgaagacctagctcatgcaactgttgtgaatggcaagtccaaatctcacagagctggatgtcaggctggagagcctgggcagaggtgatatgagagctcaaatccaagggcagggtggaggcagaatttcttcatcttgaggaggaccccagtcttcttctctgaaggccttcaagtgactgattgaggcccacccacattggggaggtttacccaaagtctgctgatttgaatgctacttctcttgtaaagaaaaccctccacggagacatctaccctggtcaaagtgaacatttctcatgcattgtgacctagcaaagttgacacatcagatttcccatcatagccatcttatacaaatcctattaatgatgaaggtgtatctgacaaaggcaggggacttcctaagattctgtattaaccatttttatccagcccaagccagcatttctggctcagcacaactccggccaggaagctgaagctgatgtgaatgccttccagcaataagggagtgatgggctagtcagggcacacaggcaatcccagagggcacaggtggtacccctggacaacaagagtttacccttgttagggcacccccagcaggacatacagtcatcaggcaggagctggccaaggcctccattgtggcatcccacaaagaaacctttccctctagggttccccgttcagtctaaaaaattgatttgcatctttggtgactctcagtccattctggaaggtgggaagagagccagccagcagcattaaagccctactgtgtggcagggaagaagctagggaaagtccctcattttctgtcagttagccatggcatcaaccaggacagattatcattcccacttcccagatccagcacacaggaagcggctccagctgaatggcagagatgcctagctgagtactgccagaattccctttttatcttttcctaggccttcaatgatactgccaaatacttctctgagaaagaatgggaaaagatgaaagcctcagagaaaatcatccatgtgtatatgaagagaaagtatgaggccatgactaaacagggtaactgaaagttctaggtacagacaagtctggggacacatgagcatcccttttcctgctttggctacttcttaggctgcagaaagtaccccacattttccttttgtgcagggaaaaatcgcaaggcagcttctgggtgctctgctcttctgtattctgtcagggctgagggcagggactggccacagtggagctcatacctggatcctgcacgtttctctcccttaggagtctgttgtgatgagcccaactgtctctgtggcatcccaggcctcccccaccccgccaccgcccccaacacacccaccctaccttccttctctcggcttgtctctctctctctctctctgtcttttttttttttttttgagtctgagtctcactctgtcacctaggatagagtacagtagtgcaatcatagctcactacagccttgaattcatggcctcaagcaatcctccagccttagcctcccaaagtgctggtactacagacatgagccaccatggcaggcctaagcgtgtctcttaaggaataaatattttgcttcttactaggtttcacggctaccatcccaactttcatggatgacaaaggggccgcagactgccaggggaatgattttgataatgaccataactgcgggaatcagggtgagtagatgggaaggggctggaaagggtctcctcaagcccaactgcttttcagctcagctacctgggaaagagcctcaggcatttgttccctcatacacatcagggctgagtgaaaaaaaaattgcatgcagaaagttaactacagaggccattcatataaaattttaaaacatgcaaaacaagaatatatatttttatggataataagtaaatggtaaatgtatacaaacatgaatgtgaataaaaagccatcaaattaaggtgactggctgtaagtggaggagggagggagagcagggattgctgagtgctgcacacacagcttcagctgtgacttgtcgatagtgtgttttgtttgcttttgtttttgagatggagtttcactcttgttgcccaggctggagtgcaataaggcaatctcagctcactctgactttcacctcctgggttcaagtgattctcctgtctcagcctccagagtagctggggttacaggtgcccgcccccacacccagctcattttttaatgtttggtagagacggggtttcaccatgtaggccaggctggtctcaaacttcctgacctcaggtgatccacccgcctcagcctcccaaagtgctgggattacaagtatgagctaccacgctcagcctgtttgcagtatttctaatattctgaataaataaatcagacctaacatagctgggggtaatgttgagatccgaccagactcaatattattccccatacttttctgtttgaaatatttctttttaaaggacatgttgttcttcctaagcactgttaatgaatcaaaggacagttaagaaaatgttaaaagtgacaaaaaaagaaagaaactgttaaaactgtggatccgccaaaaacttcaagaggttgtttcattaacagcaagtaggtattggataggtatcttaggagtgagggtgatgaacacattatgtaataaagatcgctgtttttctgtatcttatcaaaaccaaatactcttctcattcccaaacaaccccaattctccgtgatgagcttggaagagagtttgaaagagtgatccctcatccaacacagagagagctttcccacttgtcagtgagcagagataacatggggtgaaaaaaagaaaggttcttggctagacatctttgtacatttcaggaatataaaggggacatatgtgtttactggctcttctgctctgacaacacaaatatacgacaaggtcagaatgtccaaaccgtctccaatagaccgataactccccaactaaacaggccagattctttcaactcccacaatcactataagagatctgaaatcaggtagcgtgatgcctccagctttgttcttttggcttaggattgacttggcgatacgggctcttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttcactgagcagtggtttgtagttctccttgaagaggtccttcacgtcccttgtaagttggattcctaggtattttattccgtttgaagctattgtgaatgggagttcactcatgatttggctctctgtttgtctgttattggtgtataagaatgcttgtgatttttgcacattgattttgtatcctgagactttgctgaagttgcttatcagcttaaggagattttgggctgcgacgatagggttttctagatatacaatcatgtcatctgcaaacagggacaatttgacttcctcttttcctaattgaatacactttatttccttctcctgcctaattgccctggccagaacttccaacactatattgaataggagtggtgagagagggcatccctgtcttgtgccagttttcaaagggaatgcttctagtttttgccaattcagtaggatattggctgtgggtttgtcatagatagctcttattattttgagatatgtcccatcaatgatactggtaccaaaacagagatatacatcaatggaacagaacagagccctcagaaataacgccgcatatctacaactatctgatctttgacaaactgacaaaaacaagaaatggggaaaggattccctatttaataaatggtgctgggaaaactggctagccatatgtagaaagctgaaactggatcccttccttacaccttatacaaaaattaattcaagatggattaaagacttacgtgttagacctaaaaacacaaaaaccctagaagaaaacctaggcaataccattcaggacataggcatgggcaaggacttcatgtctaaaacaccaaaagcaatggcaacaaaagccaaaactgacaaatgggatctaattaaactcaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaacaaacaaccccatcaaaaaatgggtgaaggacatgaacagacacttctcaaaagaagacatttatgcagccaaaaaacacatgaaaaaatgctcaccatcactggccatcagagaaatgcaaatcaaaaccacaatgagataccatctaacaccagttagaatggcaatcattaaaaagtcaggaaacaacaggtgctggagaggatgtggagaaataggaacacttttacactgttggtgggactggaaactagttcaacccttgtggaagtcagtgtggcgattcctcagggatctagaacttgaaataccatttgacccacccatcccattactgggtatatacccaaaggattataaatcatgctgttataaagacacatgcacaagtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcggtaaactatcacaagaacaaaaaaccaaacaccgcatattctcactcataggtgggaattgaacattgagaacccacggacacaggaaggggaacatcacactctggggactgttgtggggtggggggaagagggagggatagctttaggagatatacctaatgctaaatgacgagttaatgggtgcatcacaccagcatggcacgtgtatacatatgtaactaacctgcacattgtgcacatgtaccctaaaacttaaagtataataataataaaataaaataaaagagatctgaaaatccagtgcttgaatatctgccaagtttttgacaataaaggagtgtctttatactgaaaatatttcagagccactggactaaatcatccatggttcatcacacatttaacagcttaattcacataccacagtattcacccattttaagtgtacaatgatttttagttgttgtacatttgagtgaatatagttcagattcccaaccaatcaatttaattatttgggtaaaagtaaaacatatgtaatggaataagatgagactgtgatggggtttagtccaatgtgatgaaccatgagatggaaaattctgaattgatgccaccgataaatgaaccaaccatgactaaacataattcagaagcgaatctccaataactcctcaacaatgagtggactcataaccctctgctgcagaatgccctcatgcaatagaagtctctctagagtttggaaatctttaccaacaaagaaaaattctgatgtattctctttcagttgaacgtcctcagatgactttcagcaggctccagacttcgtgatctgcacacctcggcctcccaaagtgctggctttacaggcatgagtcaccgtgcccgggtgatttcccatgctctttctactccctgtcctgtatatctaagggatcctccctacccaggatgctgtgggctcccaaaccccaggtcagccctgatatgcgggccacaccttcctctagcctagaaattgataacccaggcgaggaagtcactttgacatgagcagatggttcacttcgaggaaccatggaaggcgtgtgcaggtcctgaggtaggacagaatcggagtgtgccgggtctgcaggtcaggaggagttgagattgagttatcaggcagtgggaactcatgccacttactttccttatctcctcttgcctcagcctcggggatatgacacatgcccatgatgagaaacagaacatggtcaccattcacgaacgtgggcatgtctgcggacccctcgtcatcaggtgcatagcaagtgaaagcaagtgttcacaacagtgaaaagttgagcgtcatttttcttagtgtgccaagagtttgatgttagcgtctccattgtattttcttacagtgtgctgttctgttagatattatccttttcattgatgagcaaggcatacttaatgcatatttcggtttgtgtatccatgcacctaccttagaaaacaggtattatcaggtattctctgcatagaacagtactaccctcctctctccccagatgtgactactgagggcagttctgagtgtttaatttcagactttttcctctgcatttacataccacaccacacacacacacacacacacacacacacaccaagtaccactataagcatctcacatctgcttttctccattgccatgtgtcctggtcaagcccagctcactctgtttcctgttcagcatgtactcccctcatcagattcccctgtatcagtcactgacgtttaagaaacctttgcaacattgcatccagtttttcacattcgctggcttacagaggctgacagcttagacccacaccaatacaggccaaatgccaatgaaagttttagcttctggctccttccgctgtcaggtttagattcccaacctcttcacttaagggaacattcacctatacctcctttcattcagcatgtatttaagggcacacaggcataccttgttttattgcacctcatttttatagtgcctcacagataccgcaattttgtttttgaaattctcaccaattttacacttttccattattattatatctggtatggtgatctgtcatcagtgagctttgatattgtgattgcaattgttttgttgttctttagtgttttaaatcttggttttttatttttgtgggtacatggtaggtgtatattcttatggggtacatgagatgctttgatacaggcatgcaatgcgtaatactcacatcatggaaaacagggtatccataccctcaaccatctatccttgtgttacaaacaatccacttacactctttattttttttaaatgtacaattaagttattattgactataatcacccagttgtgtgtcatggttttgggggtaacaggaactgcgcccataggagatgacgaacttaatcgaccaatgttgtgtgtgttctgactgctccatcgatgagcgcttccctgcctctcttccttttcttgggccttcctaattcctgacacacagcaacactgaaattaggatgactaagaaccctacaatggccgctaagtgttcaaatgaaacgaacagtcacatgtctctcacattaaatcggaagctagaaatggctaagcttagtgaggaagcatgctgaaagccaaggtaggctgaaagctaggcctcttgcaccaaacagccaagctgtgaatgcaaaggaatagttcttgaaggaaataatagtatataatgcaaagggaaagttcttgaaggaaataataatactaatactccagtgaacacactaataagaaagcaaaattgccttactgctgaaatagagaaagtttaggtggtcaggatagaagatgaaaccagccacaacattcccttaagccaaagtctaattcagagcaacacccaaactctcttcaagtccatgaaagctgagagaggtgaagaagctgcagaagaaacgtgtgaagctagcagaggttggttcataaggtttaaggaaagaagccgtctccataaaataaaagtgcaaggtgaagcagcaaaccctgatggagaagctgcagcaagttatccagaagatctagctaagatcactgttgaaggtggctacagtaagcaacagattttcaatatggataaactcgccttctaatggaaggagatgccatctaagactttcatagctagagaggattgactccaactttgaaagaagttctactgtgggtaaaatgctgtccaatagcaccacatactacagagatatgcttcacgaaagggagagctaatcgatgtggcaaatttcactgtgttcttttaagaactgccacggccactccagccttcagcaaccatcaccttgatccaccagcagccatcaacaccgggacaagaccctccaccaggaaaaagagtgtgactcactgaaggctcagaagattgttagcatttttaacaatgaattattttaaaattaagttatgtacatttttagacataatgctattgcacacttagtagactacaggatggtgtaaacgtgtttttacgcactacgaattcaaaaaagaaaaatgtgtgtgactctctttattgcagtggtctggaaccgaacctgcaatatctctgaagtacacccgtattgggtatcaggcattgagctgagtaagaaatgatcccaggtaatcaccgatagaattgcttgagcaccttccatatcatcagaccttctagatttaatttaatacctccaaacgatttatgaactatgattctttatttccatcttatggactaggaatctggagctgagaaaatttggaagacttgccccaaatcatgtggttttttatatggatgacaactccagtctgtgtttctggaagtcacgttagacatggcttcatctggagctgggcaagctcctctgcccagcctggacccaggcttgtctgggatcaatgccacacacccagtccacacacctgaaaatagccagaaaagccagaggggttgttcccgaattctttcttcttaccagatctcttgtgaatcttctcagaagtatttgctcttcttggggggcgcagctgtttcccatcgttttgtgggccagatgcttctggcactcccttcgaatcatttccttcctctgctgtcttcttgggcatgatcattataatgtgaaggtcacagataaacagtatcagtgacatttctatagtgtttcagagcttacaaagtgtcttcacatgcattaccttaatcaatgttctcaataacgctgggagagttacacttgcctaaattaggagaaacctgggaggtcagaagggaaaggaacggcccaaatgaatggggtttccagggctagaatgcttatcttcacactcttttaagactgacattcttgcaaacagcaaaaatctccatgtagttgagagtttgttatacaggagatttggagaaaaatagcattctaagaattcacaagttctacaaggggaagaggttctataaaatacaagggatcccatataagcttgtagacagctgctgggagagtaaatgtaaagacatagagaggggacaaaacactgctgggaaagatggtgtggggagattaatacagggaagggagagggaaagaaatggtttgctgaaattaatctaggcagcaaacaaagcagtatcacatatggcataccaccctaccgaggcaccaacattgaatgtggaattaagtgaggtggttcccataacaattctggttgctttgggatgtgtcactgacaaagctatttttttttttttttgacgcagtcttgctctgtcgccaggctggagtgcactggcgcaatctcagctcactgaaacatgcaactcccgcgttcaagcgattctcctgcctcagcctccctagtgtctgggactacaggcaggtgctatcacgccccactaagttttgtatttttagtagagatgaggtttcaccatgttggacaggttggttttgatctcttgacctcgtgaactgcccgcctcggcctccgaaattgctgggattacagtcgtgagccactgcacccggtcattaagctactttttattcagctccctcacttatgaaatagtgaacaatacatgtaaaataggctaagggaaagtcctctctgagcttgtaaacacggtttaaatgtagtaataataacaattaatacctttctgaatccttctttgaattcggtctccatactggtaacccaactcctagatccctttaccctctaaacaagagttgaatctgcagttgtggggtcactcattcaggggcctccgaggtatcccctgggctgggacgggggattcccggatgtcccagctgcaggcaaagccctcaaggagctcacagtagggaggggccaacagtcaaagcgattcttaagccatgccagtggccccagtaacagagctgaggccagctggtccttcctgttgtgagagtggatgtctcaatggaagcaccagcaggccctatggggtaaagccctagtgagcaacatctgaacttcataacaaatgcaaacgtgaatgaactttaaatggcttggagctctggattagactaccactgccactgcgcctcaggaaaattctttaacatctctgtaccccgatagcctcattttattattatgttgctgatagctatgatctaaaacatgaactgtgattctttacttccatttcatggaccaggaatctggagctcagagaacttagaagatttgcaccaagtcacatgacttttatatggatgaaaactcaactgtgtgactcgttattatttggagataataacagacacaacgtcacagaggtcttcttagggattaaataaattcatccatgtgaactgcttaaaatagtatctggcatcactatgaagacaaaagaagtaataaggatcacaactgttagtattatcaaaccgttggtgctacaccaggttttgtgatagatatggggagaaggaggcaatgagggcatttttgatattctcccactcttaccagtgttcacatccatgaagggacaaaggttctctggtccattagatttgagagatactcaccttcgggaagattctctggagcctgctgaaagtcatctgaggacattcaactgaaagagaatacatcagaatttttctttgttggtaaagatttccaaactctagagagacttctgtcgcatcagggtattctgcagcagagggttatgagtccactcattattgagaagttattggagattcgcttctgaattatgtttagtcatggtttccatctcatagtttatcaaatggggactaaaccccatcacagtctcatcttattccattaaatatcttttactttttcccaaataattaaattgattggttaggaatctgaactgtatccactcaagatgggcaacaactgaaaatcattgggtgattttcaaatgggtgaatactgtggtatggatgaatactgtggtaaatgggtgaatactgtggtatgtgaattaagctgttaaatgtgtgatgaaccatggatgatttagtccagtggctctgaaatattttcggtatgaagacactcctttaatgtcaaaaacttggcagatactcaagcactggattttcagatctcttatagtgattgtgggagatggtagaatctggcctgtttagttggggagtaataggtctattggagacagtttggacagtttgaccttgtcttgtaattgtgttgtcagagcagaagagccagtaaacacatatgtcccctttttattcctgaaatgtacaaagatctctaccgaagaacgtgtctttttttcactccatgttatctctgctcactgacaagtgggaaagctctctctgtgttggatgagggatcactctttcagactcactcccgagctcatcacagagaatcagggttctttgggaatgagaagactatttggttttgataaaatacagagaaacagcgatgcttattacataatgtgttcatcaccctcactcctaagatacttatccaatacctacatgctgttaatgaaacaaactctggaagtttttggcggatccatagttttaacagtttctttctttttttgtcacttttcacatttcttaactgtcttttgattcattaacagtgcttaggaagagcaacatgtcctttaaaaagaaatatttcaaacacacagaaaagtatggggaataatattgagtccagtcagatctcaacattaccccacagctgtgttaggtctcattttttcattcagaatattagaaatactgcaaacaggctgagcgtggtagctcatacttgtaatcccagcactttgggaggctgaagcgggtggatcacctgaggtcaggaagtttgagaccagcctggcctacatggtgaaaccccgtctctaccaaaaataaaaaaatgagctgggtgtgggggcgggcacccataaccccagctactccggaggctgaggcaggagaatcacttgaacccgggagttgaaagttggagtgagctgagattgccttattgcactccaccctggccgagaagagtgaaactccatctcaaaaacaaaagcaaacaaaacacactatcgacaagtcacagctgaagctgtgtgtgcagcactcagcaatccctgctctccctccctcctccacttacagccagtcaccttaatttgatggctttttattcacattcatgtttgcatatatttaccatttactaattatccataaaaatatatattcttgttttgcatgttttaaaattttatatgaatggcctctgtagttaactttctgcacgcaattttttttcactcagccctgatgtgtatgagggaacaaatgcctgaggatctttcccaggtagctgagctgaaaagcaactgggcttgaggagaccctttccagccccttcccatctactcaccctgattcctgtggttacggtcattatcaaaatcattcccctggaaatctgcggcccgtttattatgcatgaaaggtgagagggtaaccttgaaacctagaaagaagcaaaatgtttattccctaagagagaagcttaggcctggcactgtggctcacgtctatagtaccagcgctttgggagactgaggtgggaggattgtttgaggccaggaactcgaggctgcagtaagctatgattgcactactgcactctaggctaggtgacatggtgagagtctgactcaaaagagagaaaagccaagagaaggaaggtagtgtcggtggggggttgccaggatgccacagagacagttggactcatcagaacagaggcctaatggagagaaacgtgcaggatccaggtatgagctccactgtggccagtccctgccctcagccctgacaggatacagaagagcagaacacccagaagctgccttgcgatttttccctgcacaaaaggaaaatgtggggtactttctgcagcctaagaagtagccaaagcagggaaagggatgctcatgtgtccccagacttgtctgtacctagaattttctgttacctagtttagtcatggcctcatactttctcttcatatacacatagatgattttctccgaggctttcatctttcccactctttcttagagaagtatttggcaatatcattgaaggcctagaagaaaaaaaaaaggaattctggcagtactcagctaggcatgtctgccattcagctggagccgcttcctgtgtgctagatctgggaactggggatgataattcttcctggttgatgccatggctaactgacagaacaaggggcacctaccctagcttctcccctgccacacagtagggctttaatgctgctggctggctctcttcccaccttccagaatggactgagattcaccaaatgaagtgcacagtcatagacttgtctccagagatgctaggtgatgacagagcgagggtgggaagttcccaaggatccagatctcccccgagaccctgctccttgtctccagtgtctctgtcctcccctcctcagaaaccaggtcaccccacactgtcccctgggccactactatgccccctccaggtcacctcagcttttgtatcttctctggtatttgagcatcatccctagctctctttgcacagtcgttgtctccgttcatggcaccgggactagtctgacctgcaagagaaacagaatgagactttccagccacaggacctttggtcttgtggagggagaaatcagtgaaggccggccacactcagtcacctggaatcaggtgctgcatttctccatccggggcttatctgttcctgagtaaggccatggggagaagtcagatgaaaacaggaaaccagggatctctgggagaagtattgattggggataacaggtttcctatgggcaaagcagccttgagtctttaggagggggttggctactcttgttagtagtttccctggagctagccttgccctgaaagatgtacagacccttgttggggaggcaaggacatgactatgtaattgtattgggtgagggcgtgctgaaatatggggtatttcaagatgcagcaatcagccaggagcagtggttcacgccagtaatcccagcacattggccaatcctcccgcctcgatcttgggactacagtacaggcatgcaccacccagcccctactaatatttttatttttgttttttttagtggagagggttttgctatgttgaccaagttggtctcgccctcttgggctcaagcgatactcccgcctcagcttagggactacaggcatgcaccaccctgccttttgctatgtttccaggctggtcttgacctcctgggctcactcaatgacttgaacctgggaagcagaggttgcattgagccaacatcacaccactgcactccagcttgggcgacagtgcaagattgtcaaataaatagataaataaatacataagaaagaaagaaagaccagctgaatctccataagaatagtagtaagctttgtggtatttttacttaccctcatcccatctcatgctcccagcttggttctgttcattgctgatgaaatacagataggattggccagaactggtagagggctggctgttgatcatgaaaatgtcagacctgatatagtcctccttggaaaggccctttctaggggctgatactctgtgtcagtggtgctgtgagacaatgacataatgctgaccattaagccaggggaacgtgggtccacatacggtggcaatccactaggctgctgagtgaccatcgcagcccttgaggttttagaagaagaaaaccttgctgaaaatgcagaaaaaaaatgggtattctcttgagaaatgaacccatgaagctaccttctgatgttgtgactgccgtaagaggaaaatgattgttttatttattcatttagttattttattgagtcagagattcactccggttgcccaggctggagtgcaatgccacgattttggctcactgcaacctctgcctcctgggttaaagggattctcctgcctcagcctcctgagtagctgggattacagggatgtgcccctatgcccggctaatttttgtatttttagtagagatggggtttcgccttgttggccaagctggtattgatctcctgacctcaggtgatgcacctgcctcggcctcccaaaatgttggggttacaggcgtgagccactctccctaggaggaaaagaattattaaatgctattgttattcaagacaacaaagactgtgatgcttggaaggtgtatctacaacttcgagattatggatttctggcccagccaatccatggtgacatcatcagtttttgcctctgctagtggtcaaggaggatgagattcgagagtccagtgaaatcaataacaagaccatcttgtcgttctgagtgtagcagccattttcagtggtccctgggagccgactagagacaggtggtcctgtaaaagctctgctcttaatgtgggcacattccactcccatgtgtcttcaaaacctttttctggaatatatttttttttcagttgatacataatagaatagtgtttatgaagctgccttttgctttgtaacataagtaagagaatgtaatggcatctatattcagtgaaagtgttttgatgtgcagaacatggcgaggtgcagtggttcatgcgtgtaattccaggattttgggaggcaaggtgggcagattacttgaggtcaggagtttgagaccagcctggccaacacagagaaaccccatctctactaaaaatacaaaaattagctaggtgaggtggtgggtgcctgtagtcctagctacatgggagactgagacaggagaaccccttgaacccaagaggcagatgttgcagtgagccaagatcatgccactgcactcaagcctagatcacagagtgagaatccctttggaaaaaaaaaaggtacacaacacttccatcaccacaatgctattccttgtgctactcatttttagtaatactcactctcctcccacccaccattcctaacccctggcaaccactaatctgttttccacttctacaattttgtcttttctagaatgctgtacaaatgaaatcttatagtatatcacgttttaagggcttattccactcagcataattccctggagattcatccaaactattaatatctgtgtatcaatagttcattgttgctgttgttgttgagacagagtctcactctgtcactcaggctgcagtgcagtggaatgatcttggctcactgcaacgtccgcctccctggttcaagtgattttcctacctcagcctcctgagtagctgtgactacacgtgcatgccaccacaccctggtaatttttgtattagtcatagagacggggtttcaacatattggcaaggctggtcttgaactcttgacatcatgatctgcctgcctcaacctcccaaagtgctgcgataacaaggtaagccactgtgcctggccaatagttcatttttattactgagtagtattccataggatggatgttccacagtttgaccattcacttattgtaggacatattgattatttccagctactggctattacaaataaagctgctatgaacaattatgtacaagtttctggataggcatacattttaacttctctgaagtgtaattgttgaaatgtatggtcattgcatgtttagttttgtcagaaactaccaaactgctttccagagtggctgtaagattttaccttcccaacagcacttaatgaggtgtccagtttctctgcatcctcgtcaccatttggtgttgtcactatgtgctttatttcatctattgtaataagtgtgtagtgatacctcaccatggtcttaacttgcatctagtgaaggaaatgagggttgaacatcttttcatgtgcctatttgcttatttcctcttcagtgaagtatatgttcacatcttttcatgattttctaattggattatttgtttgtattttttaccattgaggtttattattattattactattattattattattattattgagacagagtctcactctgttacccagactgcagtgcagtggcacgatcttggttcactccaatttctgcctcccaggttctagcgattctcatgtctcagcctcctgagtagctgggattacgggcacgcatcatcatgcctgtctaatttttgtatttttagtagagatgggcttttgccatgttgcccagactggtcttgaactccaggcctcaagggatctgccctccatccacctcgacctctcaaagtgctgggattacaagcgtgagccaccacactcagcataccattgagttttgagagtactatacatatccattatatattctggatgtgagtcctttcttggatatgtggtttgcaaacattttctcctagtcaagacccagttttttcatccttttaacagggtctcttgcagagcacaagttttaaattggatgaaatctaatttacttgttttctttatggattatgctttttgaaccattcactataccctagatctcagacgtttgtcccatgctttcttgtaaaagatttttttttagttttatattttagatttaaatctatgatccacttgagttattttttgtataaaaatatgaagattaggtctttttttttttttttttagcctatggctctgcaactgctccagcaccatttgtcaagcagatgacccttccttctttttgtccctgtaaaaaatcattgtggggctatttctaggttctctattttgttccagtgatctatgtgtctattcttctcccagtactacacagacttgattcctgtagctatataagaaatattgaaatatggtagagccattcctcccaccttattcttcctttccaaaaattgtcttagctacatatatatatattgagatgcagtctgacttgtgttgcccaagctggagcgcactggggtgatctcggctcactgcaacctccacctccagggttcaagtgattctcctgtctcagcttcctgagtagctgggattacaggcatgcgccaccacacacggctaatttttttatttttagtagagagggggtttcgccatgttgaccaggctggtcttgaactcctgacctcaagtgatccgcctgtcttggcctcccaaagtgctgggattacaggcctgagccactgcgcccagtgttgtctaagctattggaaacttgttacagcagcaatcaaaaatgaaaacacatggaaacatttattagtgaaacaaaatagaaagtcaaaaaacagactgatctatatgcaaacttcagcatgcatttccaaacagtgggcaacagatgatgggttgtataataaatgattgcttgacaagtgtctatccatttcaaaaactaaagatgaaatccttactttgaagcatataaaataataaattctaaaaattcagtgacttaaatgtgaaaacgtgaaatcataaagaactagatgaaaatttaggaaaatattacagtgtaagacatcctgagttggcataggaacttcctgacattactccaaggctataaacaatgaatctgacataaagatgcaaaaattaaagtatcatctaattcaaaagacaccataaacaactgtttaaaaaggcaaatgttggggaaattggtgaagcatccccaataaactaacagtaactatctctaatatacaacaaagcttttgcatatcaataagagaaactggaacaactcaatgaaaaaatgtgttcaggcatggcactacttcactgtatagcacaaaaggattatgaaatagaaagtataaaagaaaaataataaaggaaatggagaatagatcccagaagtttcaaagttcatccaacagaagttccagagataggccaggcacggtggctcaagcctgtaatcccagcattttgggaggccgaggtgggcggatcaactgaggtcacaagtttgagaccagcctggccaacatggtgaaaccctgtctgtactaaaaatacaaaaattagctgggcatggtggcacgtgcctgtaatcctagctgctagccgtgctgaggcaggaggatcacttggacctgggaggcagaggttgcagtgagccgagattgtgccactgcactccaacctgggcaacagagcaagactccgtcttaaaaaaaaaaaaaaaagttccagaggtagagaatagaaagactgggccgggcgccatggctcatgcctgtaatcccagcattttgggaggccgaggcaggcaaatcacctgaggtcaggagtttgagaccagcctgattaacagggtgaaaccccgtctctactagggtttggtggtgggcgcctgaaatcccagctatttgggagttcagaacagttcccagtaacaaaacccttgatggtttggccccactggggagtgagatgtcttcgagtgggaaaaggtcagaggccacagatggaggatcagcccagttggagctttctaagttacattctttttttctccttgttttctcgatggcttattacctgttctgtaaacatacagagcagacacttggcagggctggcccagtggcagccgaaagtggcctgataacattaaggaatagggggcttggaaagctcctagagaaagtgcagactcatcaaagctggccagtaactgagcattcctttcctacctctttctctgccctctgagctaggcaattacaaccaatatcacccatccatagactccctccacactgtaaggcagaaatcctataagcgtctctgggggctcataggctagggactggaaagaagaattggctcagctcagctctagaggctctatatcctacgacctatcaatccagaaaccctgaaactcatatggagtgtctgggctgacacatcttcccaggaacaaagagttatacagaaaaactatcggataggcctggcatggtggctcatgcctgtaatcccagtattttggaagaccaaggtgggacgatcacctgaggtcaggagtttgagaccagcctggccaagatggcgaaaccccatctctactaaaaatacaaaattagctgtgtgtggtggtgcacgcctgtaatcccagttactcaggaggttggggcaggagaatcacttgaacctgggaagcagaggttgcagtgaggcgagaccacaccattgcacttcagcctgggcaacaatagtgaaactgtcttaacaacaacaacaaaaaaaggccgggcatggtggctcacgcgtgtaattctagcaccttgggaggctgaggcgggcgactcacctgaggtcaggagttcaagaccagcctggccaacatagtgaaaccctgtctctactaaaaagacaaaaattagctgggcgtggtggtgggcacctgtaatcccagctactcaggaggctgaagcacaagaatcacttgaacctgggaggtggaggttgcagtaagcaaccttgcttactacagtggctggatcccaccactgcactccaacctgggcgacagaggaagactccatctcagaaaacaaaaacaaaaacctaataaatgcagttaggaaactatcttaaaacacaaaatccccgtttttttagactgattgtttaaaagataaagaaaaacagatcaacatgttaagaaaacctatttcaaaacgagaggagtagactcaccctgctgcagtgcacccttgacactaatggtcgatttttagataaacggataaacaatttcttttcaatcacaaccaatctgatcatatataagactcccttcccaaggctcatccttcataaaccctcagcaacttgcctagaaagtccatcattttttatgcccagtcttagtcccataatttttcatttttatattggactccaattcaagttctagtaaaatgttagaggaaaaggataaactgaggaaaggactgttaagcaaaaaggatccagggaaattctcagcctatcaagattgcaaaagacactaaaattaggagaggcactgtcaggaaggtatgctctagagagaaagtcaagaatgtggccatgtttgctagtgctgaagagatcaggcacgtgactcaaggagctcttccactatgctcagccatagctggtaatagaaatgatattatcttggaagctacacaaaggacctgctggcctaaaggtgtgaatcactatgacatacattctgagaggagggctatgggaccagaggggagagcttcaagctacagaggattattctgagtacttgaaaccaaatggaatttgtcctgctagatttcaaaatggttggaagcggtgactcctttcttccagtttctcccatttgaaatggaagtatctgtaactattatcctacacctgtctcgccactttatttttggaacagataacttgttttctagtgtcacaaattcacagcaggagaattttgccccaggatgtttcataaccagagtctcacccatatctgttttagatgaggagatttggtaattttgagctgatcttatatggataaaatgttggacttcagctaatgttgcatggtttgagacatttgaggatttggggatggggtgcatgtattttgcatgtgggagagatgtgaatccttgggggccagagggcaggttgtggtagactgaacaatgcccctccaaaagatagtgacatagtaacccctggaacctgtgagtgctagcttacaacaaaaaaagtgattatgttggccaggtatggtggctcacgcctataatcccagcactttgggaggctgaggcggatgggtcacgaggtcaggagttcaagaccagcctggccaagatggtgaaaccccgtctctactaaaaaaaatatataaaaattagctgggtatggtggcgggcacctgtaatcccagctacccaggagcctggggcaaagaattgcttgacctgggaggcagaggttgcagtgagctgagatcacgccactgcactctagcctgggtgacagagtgagactccgtctcgaaaaaaaaaaaagtaattatgttaaagctcttgagatggggagattctcctggattatctgggtggcccctaaatgtaataatgagtgtccttatcacattgaggcagggagatctgacacagacagaagagaagacggcagtatgcctgccatggtttgaacgtccccaccaaaacttgtgttgaaatttaattgccattgtaacaatattaagatgtgcggctgttaggaagtgattaatgccattatcataagagtggattagttatcatgagactgggtttgttataaaagggagcttagccacattttctctgtctgtctcctgcacttgcttttgcctttcatccttccatcatgacacaaccctcaccagatgccagcgccatgttcttggactcctagcctctagaactgtatacgtaataaacttctatcctttataaattacccagtttgtggtattccattatagcaacagaaaacaaacgaaggcaatgaccatggagatagagattagagtgatgcagccatgtattagtccgttctcacactgttataaagaactgcccgagactgggtaatttataaaggaaagagatttaactgactcacagttccgcatggctggggaggcctcaggaaacaatcatggccaaaggtgaagaggaagcaaagactttcctcacatggtagcaggagacagaagtgcaagcaggggaaatgccagacgcttataaaaccatcagacctcatgagaactcactgtcacaaaaacagcatggggaaaacccgccccccccgtggggatttgtaatctgtggggattacaattggagatgagatttgggtggggacacagagccaacccatgtcaagccacaagccaagaaatgctggcaatcaccggaagctggaagaggcaaggaacagattctctcccagagcctctggaggactacagccccgctgacaacttgatttcaactcagtgaaactgatttcagatttctgggctccagaattgtgagagaataaattgatgttgtttatgccacaaagtttgtggtaatttgttacagcagccagagggaatttggggtgattgtaaggagttatgtaaattatgttaaagaaccattgcagttgtaagatgcattcattcattcaacaaatagtcgaggcaatatagaagagtaattaaaagcactgactttgaggccgggtgtggggtggttcactcctgtaatcccaatgttttgggaagccaaggcaggaggattgcttgaggccagcagttccttccagatcagcgggggcaacatagcaagaccccatctctaaaaaatattattttaattaaaaataaataaatacataaataaaagcacagactttggactcaattcatcttgggggtgaatcccagctctgtcacccactgactatgtgaacttgagcacactgcttaattctctgagcctcagtctcaacatctgcacactggggatgataatagtatttaactcaagagaagattgtgaaaatcaatgggaagatgcacataaagggctttgtgctgggctcaagggccattgccctgtccctgccctaacagagcttgctgtcatcctgggaggatcttagagagatcagggctgtagatggaaagcccagagaggaaaggggacttgttggaggtactagggatgggggtaggggaaacttcttagacaaattgacttatgagctccctgatgaacacagtgggccttaattacatactctttttaaaactattattataaatatttttaatatcaatgggtaaaatatatttctgcttctttggtcttttagaaaaaaacatacatagaagtgtagaagtggtttttttgtttaaatttcttttttaaaaatttttttatagagacgggggtctcactatgtatcccagattgttccagaactcctggcctcaagtgatccttccacctcctgcctcagcctctcaaaaagtgttgggattacaggcatgagccactgggactggctcactgaaatttttctttctttctctctctctctctctctttttaaagacaagatctcgctctgtggcccaggtaggcagcagtagccagatcatggctcactgcaacctcgtactcctgggctcaagctatcctcctacctcagcctcctgagtaacggactacaggcacaccaccccacctcgctaattttatttattttatttttttgtagagaaaagagacagggtattgctgtgttgcccaggctggggtgcagtggcatgatcgtggctcactgcaacctctgagtcccaggttcaagagatcctccagctgtggcctcccaaagtgctgggattacaagcgtgagccaccgctcaggcccaaatttcttacgtcactacagagttcctaggaaaaattccatacctgaaaaagttaggaactgacaggaaggatttgagatgatgacctgcttcatatacactccttattaaaactgaacaacaatccaccactgggggggtaagggagataggaaaaatggaaagagaaaatcagcgcatgcgtactctgattttggaagaatctaaagagaaaatcagagcatgcgtactctgaacttggagtagccaatcccaggggatgctttaggcgggaaaatcagagtctctgcctccattttgagaaggttctgtccctggagcctggactgatagaccccacatcagcttggcttttcccacctactgttctgacttctgattggccagatggagttcactaactgccctgattggtccatcatcctggagcagtgacattgcaggatattttctcctcctccagccacactttgtcaccaactgctgccaactcgccaccactgctgccgacctcgccaccactgctttgtctctgaagtaggttctctttaagggacaccctagatgggctaatcggggcagatagaaaaggaggaagcttctgtagggccgtcaagtgcttggggttccgaaaatcttgaggactgaaagacaactaatgcctttcaggacgatcatcatggaggattctcccgccttggccttgggtgtacaggcctgtatcatcccacccctggtatttttgggggggggtattttagtagagacagggattcgttatgttggccaggctggcctcaaccgcctgggctcaagcaatcctcccgccttggcctcgggactgcaggcacgcaccaccccaccctcactagtatttttttatttatttatttattttagtacagatggtttcgctatgttggccaggctgacctcgaccgcctgggcttaagcaatccttccgcctcggccccaggactacagaagtgcaccatcctgcccacgcttttcttttttttttttttttagtagaaaccgtgtttcactatgttggccaggctggcctcaacctcctgggctcaagcgatcctcgtaccttggcctcaggactacagatgtgtgccattctgcccctgctagttttgttgttgttctttttactagagacagggtttcgctatgttggccggactgggcttgacctcctcagctcaagtgatcctcccacctcagcctcggaactacaggcaagaaccacctcgctgatgttatttttttgttgttattactagtagtagaaatggggttttgctatgttggccaggctggcctcgaccttctgggctcaagagatcctcttgcctcggcctccggactacaggcgagcaccaccccgcccccactaatactttttattttattttattttattttttttagtagagggtttcgctaggttggctaggctggtaccgacctcgtgggctcaagcaatccgccccccttgaccaaagtgctgagatgctacaggcctgtgccactgcccccagctaaattttgtgatttttttttttttttgtagaaatgaggggtttgctatgtttcccaggctggtctcatcctcctgggctcaagagatctgcatgcctcggcctcccaaaatgctgggattacaggcatgagccactgtgcctagctgattgctgcaaattgaaacaccccacattttctgtaagtgatggcaggctcatctagtctcagagattctagctctcttccttctaataatttacaaatcaccgagtaatagcctctaaatctgttcatattagtgaaggtcatttctcttcaacagaacagaacccctcaaccctctgcctgatcagatccatcaccagagagaccaggttatgtctgggactcacttccctccctttatttattgagtgggggtgtcagaacgcccccactgaatagttacacagtcacgtccctgcctccccaacaagggtctgtacatctttcagggtaagcctagccccagggaaactactaacaacactagccaaccccctcccaaagactcaaggctgctaggaaacctgtcatccccaagcaatacttctcccagagactccaggctccctgttttcgtctgacttctccccatgtccttactcagggacagataagccccgaatgcagacatgcaacccctaattccaggtgactgagtgtggccgggcttcactgatttctccctccataggaccaagggtcctgtagctagaaagtctcaggctgtttctctcgcaggtgagagtgctcctggtgccatgaacggagacgacgcctttgcaaagagacccagggatgatgataaagcatcagagaagagaagcaaggtgaggtgacctggagggggcagagcagtggtccaggggacagagtagggtgaccaggtttctgaggaggggaggacagaggtactggggacaaggagcagggtctccggggagatctggacccttgggagcctcccaccctcgctctgtcatcacctagcatccctggagacaagtctgtgaccttgcactatatttggtaactctcagtgcattctggaaggtgggaagagagccagacagcagcattaaagccctaatgtgtgccacgggagaagctagggtaggtcccccatggtctctcagttagccatggcatcaaccaggacggattatcatcctcacttcccagatccagcacacaggaagcggctccagctgaatggcagacatacctagctgagtcgccgccaaaatttctttttttttttttaggccttcaatgatattgccacatacttctctaagaaagagtgggaaaagatgaaatactcggagaaaatcagctatgtgtatatgaagagaaactatgaggccatgactaaactaggtaacagaaagttctaggaacagacaagtctggggatacatgagcatcccttttcctgctttggctacttcttaggctgcagaaagtaccccacattttccttttgtgcagggaaaaatcacaaggcagcttctgggtgttctgctcttctgtatcctgtcagagctgagggcagggactggccatagtggagcttgtacctggaccctgcacttttctctcccttaggcatctgttctgatgagcccaacggtctctgtggcattgcagcacacctcccaccctaccttccttctctcggcttgtctttttctctctctctcccttttttttttttttttttttttttgagtcagagtctcactctgtcacctaggctagagtgtagtagtgcaatcatagctcaatgcagcctcgaactcctgggctcaagcaatccttctgcccagccaatggaatagctgaggctacaggcacatgccaccatgcccaactaattttattttatattttgtagatatgggggtctctctatgttacacagtctcatcttgaactcctggcctcaaacaatcctcctgcctcagcctcccaaagtgctggtacgacagacatgagccaccgtgccaggcctaagtttgtcccttaaggaataaacattttgcttctttctaggtttcaatgtcaccctcccacctttcatgtgtaataaacaggccacagacttccaggggaattattttgataatgaccgtaaccgcaggattcagggtgagtagatgggaagtggctggaaaggtctcctgaaacccagttgcttttcagctcagctacctgggaaagatcctctgacatttgttctctcatacacatcagggttgagtgaaaaaaaaattgcatacagaaagttaactacagaggctattcataaaattctaaaacatgcaaaacagtaatatgtattttcatggataataagtaaatggtaaatgcatgaaaacatgaatgcgaataaaaaggcatcaaattgaggagactggctgtaaatggagaagggccgggggcagggattggtgagtgctgcacagacagcttcagtcatgacttgttgatagtgtgttttgttttgtttttgtttttgtttttgtttttgtttttgtttttgttttgaactggagatttgctcttgtcgcccaggctggagtgcaatggcacagtctcagcccactacaacctctgcctaccgggttcaagggattctcctgcctcagcctcctgagtagataggattacaggcacccgccaccatgtacacctaatttttgtatttttagtagaaacggggtttcaccatgttggccaggctggtctcaaactcctgacctcaggtgatccacccacctcagcctccaaagtgctgggattacaggtgtgagctactgcacccaggccgtttctagtgtttctaacattctaaataaataaatcagatctaacatagtcatggggtaatgttgagatgcgactgaactcgatattattccccatacttttctgtgtgtttcaaacatttcttttttaaacgacatgttgttcttgctacacactgttaatgaatgaaaggacagttaagacaattttaaaagtgaaaaaaaggaaaatgttaaaagtgtagatcagccaaaaacttccagagattgtttcattaacagcatgtagatattggataaatatcttaagagagagggtgatgaacacattaggtaataaagatcgctgtttctctgtactttattaaaaccaaatagtcttctcattcccaaacaaccccaattctccatgatgagcttggaagtgagtttgaaagagtgctccctcatctaacacacagagagctttcccaattgtcagtgagcagagataacataggatgaaaaaaagacaggttcttcggtagagatctttgtgcatttcaggaatataaaggggacatatgtgtttacctgctcttctgctctgacaatacaatcataagacaaggtcggagtgtctaaactgtcctcaatatacctattactccccaactaaacaggccagaatcaaccatctcccgcaatcactataagagacctgaaaagccagtgcttgagtgtctgccaagttttgacattaaaggagtgtctttttactgaaaatatttcagagccactggactaaattatccacggttcatcacacatttaacagcttaattcacataccataagatccacccatttgaagtgtacagtgatttttagttgttcacatcttgagtggatacagttcagattcccaaccaatgaatttaattatttgggaaaaagtaaaagatatgtaatggaataagatgagactgtgatgggatttaacccccatttgacaaaccatgagatgtaaaattctgaattgatgccacagataaatgcaccaaccattactaaacataattcagaagcaaatctcaaataactcctcaacaatgagtggactcatacccctttgctgcagaatgccctcatgcgacagaagtctctctagagtttggaaatctttaccaacaaagaaaaattctgatgtattctcttccagttgaacgtcctcagatgacttttggcaggctccagagaatcatcccgaaggtgagtacctctcaaatctaaaggaccagagaacctttttcccttcatggatgtgaacactgataagagtgggagaatatcaaaaatgccctcattgcctctttctccccatgtctatcacaacaacttatgtagcaccgacggcttgataatactaacagttgtgatccttaatacttcttttgttttcatagtgatgccagatactattttaaggagttcacatggattaattaatttaatccataagaagacctctatgatgttgtttcttttattatctccaaatagtaatgagtcacacacttcggttgtcatccatataaaagccatgtgacttggcacaaatcttctaagttattggagctccagattcctagtccatgaagtggaagtaaagaataatagttcatgttatagaccataattatcagcaatataacaataaaatgaggctatcatggtacagagatgttaaagaattttcctggggcgcagtggcagtggtagtctaatccagagcttcaagccatttaaagctcattcacgtttgtatttgtttatgaagttcagatgttgctcactagggcttcaccccatagggcctgatggtgcttccattgagacacccactctctcaacaggaaggaccagctggcctctcttctgttaccggggccactcccatggcttaggaatcgctttgactgttggcccctccttgagctccttaagggttttgtctgcacctggggcatccgagaagccccagtcccagcccaggggatccctcagaggcccctgaatgagtgattctggaagtgcagattcagctctggtttagaaggtaaagggatctgggagttgggttgccagtatggagaacgaattcaaagaaggatccagaaaggtattcattgttattattattacatttgaacaacgtttacaagctcagagaggactttcccttagtctattttacatgtattattcactatttcataagtgaggaagttgagtaaaaagtagtttaagggccgggcgcggtggctcatgactgtaatcccagcaatttaggaggtcaaggcgggcagatcacgaggtcaagagatcgagaccgtcctggccaacatggtgaaacctcgtctctactaaaaatacaaaatttagtggggcctggtagcacctgcctgtagtcccagctacttgggaggctgaggcaggggaatcacttgaaccggggaggaggggaggaggagattgcagtgagccgatatcgcgccactgcactctagcctggtgacagagcgagactttgtcaaaaaaaaaaaaaagtagcttaatattgttggtcagtgacatatctcaatgcaaccagaattggtatgggcaccacctcactgaattccacattcaatgttggtgcctcggtagggtggtatgccatatctgttactgctttctttgctgcctagataaatttcagcaaaccatttctttccctctcccttccctgtattcatctccccacaccatctttcccagcagtgttttgtcccctctctatgtttttacatttactctctgagcagctgtctacaagcttatatgggatcccttgtattttatagaagttcttccttttttagacgttgtgaattcttagaatgctgtttttctccaaatcttctgtgtaccgcactctcaatcacatggagatttctgctgtttgcacgaatgtcagtcttaaaaaagtgtgaagataagcattctaatcctggaaaccccattcatttaggccattccttttgcttctaatctcccaggtttctcttatttaggcaagtgtaactctcccagcattgttgagaacattgattaaggtaatgcatgtgaagatgctttgtaagctctaaagcactatagaaatgtcactgattctgtttatctgtgaccttcacattataaagatcatgcccaagaagccagcagaggaaggaaatgattcgaagggagtgtcagaagcatctggcccacagaacgatgggaaacagctgcgccgccccgggaaaagcaaatacttctgagaagattaataagagatctggtaagaggaatcaatttgggaacaactcctctggcttttctggctatgttcaggtgtgtggactgggtgtgtggcatggatcccagacaagtctgggtccaggctgggctgaggagctcgcccagctccagatgagatgttagacatgacttccagagacacagactggagttgtcacccatataaaaaaccacgtgacttggggcaagtctttcaaattttctcagctccagactcctagtccataagatggaaataaagaatcatagttcataaattgtttggagacattaaatttaatctagaaggcctgatgacatgaaaggtgctcaagcgattctatcagtgataacctgggatcatatcttactcagctcaatgcctgatacccaatgcaggtgtacttcagagatattgcagattcggttccagaccactgcaataaagtgagtcacacacattgtttttcgattgttttgcagtgcataaaaacattatgtttacactatagtgtactctactaagtgtgcaatagcattatgtctaaaaatgtacataccttaattttaaaataattcattgttaaaaaatgctaacaatcttctgagccttcagtgagtcacactcttcttgttggtgtggggtcttgcctcagtgttgatggctgctggctgatcaaggtggtggttgctgaagggtgaagtggctgtggcagttccttaaaagaacacaacagtgaaatttgccacatggattagctctccctttcatgaaagatttctctgtagtatgtgatgctattcgatagcatttagccactttagaacttctttcaaagttgaagtgaatcctctctagctgtgaaagttttagatgacatctacttccaataaaaggctattttatctttattgaaaatctgttgtttagtgtagccaccttcatcagtgatcttagctagatcttctggataacttgctgcagcttctccaacagggtttgctgctacaccttgcacttttatgttatgaagatgacttccttccttaaacctcatgagccaacctctgctagcttcacacgtttcttctgcagtttcctcacctctctcagctttcatggacttgaagagagttcgggtcttgctctgaattagactttggcttaaaggaatgttgtggctggtttcatgttctatcctgatcactcaaactttctctatttcaacagtaagactgttttgctttcttattcgtgtgttcactgggtattagtattattatttccttgaagaacttttcctttgcattatatactattctttccttcaagaacttttctttgcatgcacagcttggctatttggtgcaagaggcctagctttcagcctatcttggctttcagcatgccctcctcactaagcttagccatttctagattctgatttagtgtgagagaatgcaagtcttcctttcatttgaactgttagcggccattgtaggattgctaattgtcctaatttcagtattgctgtgtctcagggaataggtaggcccaagaaaaggaaaagagtcgggaagcgctcatcggtggagcagtcagaacacacacaacattgatcaattacgttcgtcatcttctctgggtggagttcctgttacgcccaaaacatttacaaacaacagggtgactatagtcaataataccttagtcatacatttaaaaataactaaaagagtgtaattggattgtttgtaacacaaggataaatgcttgaccggatggataccctattttccatgatgtgattattacgcattgcatacatgtatcaaaacatctcacataccccataagtatgtacacctactgtatatccacaaaaataaaaaaaattattttaaagactaaaaaacaacaaaaacaattgcaataataacatcaaagctcactgatcacagatcaccataacagatacactaataacagaaaagtgtaacattggtgagaattcccctcaaaaaattacagtatctgcaaagcactataaaaatgaggtgccataaaacaaggtatgcctctgtgcccttaacaaatatgtgcagcatgaaaggaggtatgggtgaatgttcctgtaaatgaagacgttgggaatctaaacctgacaacggaaggagccagaagctaaaactttaattggtatttgtcgtgtattggtgtggatctaaggtctcagcctctttaagccagagaatgtgaaaaactggataaagaaggcccatgggcacttgggaggggggaggcatctcctttttttgagaaaacagagcctaacattcttcaacctacccagtcctcatcttccaactcttcttcatcataggacccaaaagggggagacatgcctggacccacagactgcgtgagagaaaccagctggtgatttatgaagagatcagagaccctgaggaagatgatgagtaactccgtaagtgaacctttggctcatcccccacatccctgcagatgtgctattctgttatggtactggtatcccatcttgtcatttgtttcccaaatcattcctttctcataattttctagtgtacagcattgaggctgaatgatgagatttcccatgctctttctactccctgccctgtatatccagggatcctccctacccaggatgctgtggcttcccaaaccccaggtcagccctgatatgtggccacaccttcctctagcctaggaatggataacccaggcgaggaagtcactgtggcatgagcagatggttcacttcgaggaaccatggaaggcgtgtccaggtcctgaggtagggcagaatcagagtgtgcagggtctgcaggtctggagaagttgagattgagttattgggcagtgggaactcgctgtcacttactttccttctctcttctcgcctcagcctgggggatatgacacatgcccatgatgagaagcagaacatggtgacctttcacgaacatgggcatggctgcggaccctcgtcatcaggtgcatagcaagtgaaagcaagtgttcacaacagtgaaaagttgagcgtcatttttcttagtgtgccaagagttcgatgttagtgtttccattgtattttcttacactgtgccattctgttagatactatccttttcaatgatgagcaagacatacttaatgcatatttcggtttgtgtatccatgcacctacgtcagaaaacaagtattgtcatgtattctctgcatagaacagcactatcctcatctctccccagatgtgactactgagggcagtcctgagtgtttaatttcagacttcttcctctgcatttacacaccacacaacacacacacacacacacacacaccaagtaccattataagcatctcccatctgcttttcccattgccgtgcatcctggtcaagcccccctcactctgtttcctgttcagcatgtactcccctcatccgattcccctctatcagtcactgacagttaacaaacctttgcaaacattccccagttgtttgttcctctcattattgtacacacagctctgtgcacatgtgtgaatatttctttagaaagattcttagaagtggaattgatgtgtcaaaggagtcatttattcaacaaaaccctaatgagtgtgtcctcgggctgagcgctattctaggtgctggagagacatcagggaacagggcagacagatgtttctgaccaccattctagaggaggatgtttccagttgttcgttttcttgatttgtttgtttgtttcttctagagatggggtcttgctctgtccaggctggagtgcagtggcatgattatagttcaatgcagccttgaacacctgggctcaagcaatcctcccaccttggcctcctgaagtactaggattacaggcatgagccaccgcacctggcctccagtttttattttgatagagactatacacttcagtcctggagcaggattctgtagcaggtggttgggcaatttggccttcgctctctgaacaattttcgggttctagggctgtgatggtccatttgggagtatgtgggaggagacacagatgaaatcgtcatctggggaacgtggaggaatgaggaagatgcatgcactgtagaccctgtgatggccagggaatagaagagtccacttagtctccatgcaggggatcagcagtgggaaagtcccctggacagaagcatgagactgcccatcaagggtctcaccaaccaaggtcctgggggctggggtggagatgatgatttgggaatgggacagttctttctcacaggtaccattgcaaggtgcagagaggaaacagttgtggggaagggaagggcagaggggagtctattttagaacgaaccattgtgtgtcaatggagacattaaggttccatttacacacagcggacttgaaacaccagccccaggtggaggcaggattggagctgttttgaccatccgtaacccatcaccttggcctcctggttctccccagccttagaaggaggacactatcatcattatgcctatgtaatagatgagagacagagtcccagagagatggtaggtgtcttgtcacaggtcctacagctggcaggtgcaggaggggctgagtttggagttcactgactctagaaacattaaggaggacaagcgtgtgtggtggagggagggagaagtgaacaagccccgggttctgtccccagtcacaaggtagatattgtgggttcatttacccaagacaaggagccctaggacagagagagtgcggggagggagaggcaatcacggatatagtggggacagtgggagacagagatattcagggtgggcagaagaggggcaggcaaagaagcaggggatacccaagaccaagtgtgggctgtcacagccaccagagggagaggatgccaggaaggaggttgtggggctccaggagcaacagaggttccccagatctctgagcatgccctgcctggcactgcaggaagaggtggctgccacccaggtcagtgtggacgtgcctctacctgtgtctcagaggaaacacattctgttttatcccaatatcattctgtattacacaaatgtaacattcagctactagatattgggtgccttatcctccatgcaagtagaggagaggataccctaaaagagatactaaaggatttgatttttctttctccctgggatgatgggatccgtaagttgggtcccccagcccacaagacaggtgcaaggaagggtggctggaagattgtgagtcatgacagggaacatttttcgttaggttccatgggtatataaagctcccgactatctgtctatcatgaatagataaagagtgaacatggtcccctctccacaaatgtgtttctctccttcattattacagtgaaggtctgaagttccgtcaagttctgatacattacttttttttttttttttgagacagagtctcactctgtcatccaggctggagtgcagtggcgagatgtcggctcactgcaacctctgcctgccagggtcaagcgattctcctgcctcagtctccagagtcgctgggaacacaggcgcgtgccaccattcccagctaattttttgtatttttagtagaaacaggctttcactgtgccagccaggttgatcttctgacctcgtgatgtgatggcctcagcatcccaaagtgctgggattacatgcgtgaggtaccgcgcccagtgatgcattacttttttttaaattttttttgagacagaatcgcagtctgttgctgaggctggagtgcagtgatgcaagtacagctcactgcagcctcaatctcccaggctcaagggattctcccacttcagcttacgaactacctgggactacaggcacatgccaccacacccagctaatttttgtattttctgtagagacaggatcccactatgttgcccagtctggtctcaacttcctggccgcaggcaatcctcctgcctcagcctcccaaagtgctgagatgacaagtgtgagccacctcaccaggccttcactttcttcaatgaacaattatcagagtttcatcttagaggcaaaagtgactattgccagccaatctgagtgtggtgttggaggggaatctggctgattcagacatttcaaatgaacttttaaattaacctacctgatgattatcctaaggccctttcttgctccatgtttttttgattctgggtttggagtttttcagaagctttcctacaaagagcatctcctggtcgggcacagtgactcatgctctagtgccagcactttgggaggccaagacaggcagatcacttgaggtcaggagtttgagaccagcctggcctacattgcaaaaactctgcctctactaaaaatacaaaaattagccagctgtggtggtgggcactggtgacttccagttcttgcgggggctgaggcacgagaatcacttggacccgggagacacaccgtgcagtgagccgagatcacgccactgcactccagcgtgggcgacagagtaagtctctgtctcaaaaaacaaacagcatctctcgcctacactcatttgagctgtggtcttgtctcctcgggtttctctgtcagtctgatcccatctactctatctaccaggaatgcctcaatatttctggtggaccactgacacgtcttcctattttcctctactgtcaaggattgactcttgaaaacattttcttcctactttgatggaatgttgagtggggcacgggatctagctgccatcttgttccaatcacctgttattagatatttcatgtatttttgtcacaatataagtgtaatttttctcaatttggttttctaaatggctattattagcatgtagaaaccctatctattattgttaataatattttgttacctgtctgggtacagcttcccatgcattttggcacaagactcaatctattttattcttcaaaacaaaactgacaggctgagtgtggtggctcacacctgtaatcccagcacgtagggaggccgaggcatgtggatcaactgaggtcaggatttcgagaccagcctggccaagacggtaaaaccccatctctactaaaaatacaaaaaaaaaaaaaaaagaaagaaagaaaaattagccgggcattggtggtgcacgcctgtagtcccagctactagggcagctgaggcgggaggatcatttgaactcgggaggcggagatcgcagtgagccaaggtggcaccactgcactccagcctcgtggacagaaactctatctctaaataaaaagaaaaagaataaaagaaaattcacttcaccggcaatagatagttataaaaggataatttatggaagatttcataggggagactgatggaaagaaaggaagtatacattttacagagctgagcagaactcactgcaaaaatcaccagaactgcctttttctccaaaagtgctacccataagctattctactactggttcttctagtccttttctctattccaaatcctcaaattgtccatttccttattggggtaattttcctctgcccagatctgggtcccccaccacacttaacactgtctgtgagggtgtgaattcccattattttagctcaggttcccaaggaaacaggctttgggccatacaggacacatctagacagactatactgagaagccatgcttggaacggtgcatggggagaggagagggaatttatgtacctggctctcactcatggttttttttttttttaattggtcaaaatttaccacataggcatgaactcccccacacttctagattgcatcatctgcccctttcacagctatctgggaagccagatcccacactttgaagtgtagtgtttcatacaatccaaaagtggtcatagaggccaggtgttgtggcttacgcctgcaatcccatcactttgggatgccaaggcaggcagatcatgaggtcaggagtttgagtctagcctggcaagcatggtgaaacccagtctgtactaaaaatacaaaaattagcccggcatggtggcacacacctgtaatctcagctactcgggaggctgaggcaggagaatcgcttgaccctgggaggcagaggttgcagtgagctgagattgcaccacggcacttcagcctgggcgacagagcaagactccatctgaaaaacaaaacaaaacaaaacaaacaatcaaaaaagtggtagcagaaaccagaaagtccacgtaggtagctaattgctttggttgtatagcagcagccaagggtgaaaactaaatactcccaggcaagtcctgagttcaccaaggaattggagtacccatctgtgctagttaattgcctttatctgaaggaaaaataaaactcgtatctctatgacaagcaggtgcttacagcttggagcaaggcacctaggcaaactcccctggtgacagggagactgggacgtcatcttcctccatgttcacatttcaaagagatggctcaaggccctgaagaaagacctttctagggactggacatggtggctcacacctgtaatcccaacactttgggaggctgaggctggaggatcacttgaggcctggagttcaagtccaagacattcccgggatatacagggccagaggcttacatatcaaagaaagaatttaccaacacaaattttctgaaggaaatgctctagggaaaggaaaatgggaaaaggtatcttcttcccttttggcaacaggaaaatctaaattttatgtgtagttaaccttacaatttcccccttttgttattttatagaaacattacaattttctaattatctccactgctgtttctatctttctctgggtagcgtacagccacatagatatccaacaagtccatagtaagatgcaaagcaaagcaattatcagaattataatagaatgactttttttttcgggacagagtttcgctctcgttgcccagactggagtgcaatggtgcgatcttggctcactgcaacctctgtctcctgagttcaagggattttccttcctcagcctcccaagtagctgggattacaggcgtgtaccatcatgcccaactaatttctgtatttttagtagagacagggtttcatcatgctggccggatggtctccaactcctgacctcatgatctgcctgccttggcctcccacagtgctgggattacaggcgtgagccaccacgcctggcctctgctaacacttttggattgtatgaaacactacacttcaaagtgtgggatctggcttcctagacagctgtcaaaggggcagttgatgcaatctagaagtgtaggggagtttgcacctgtggggtaaattttgaccaataagaaaaggaaccaggagtgagagtcaggtacgtaattccctctcctctcctctcctctccccatgcaccattccaggcattgtttctcagtatagtctgtctagaggtgtcctgtatggcccaaagcctgtttccttgggaatctgagctaaagcaatgggcattcaaacactcgaagacagtgttaagtgttgtggaggacccagatctgggcagaggaaaattatcccaataagaaaatggacaatttgaggatgtggaatagagggaaggactagaagaaccagtagtagtatagcttaggggtactatttttggagaaaaaggcagttctggtgattgttccagtgaattgctcagctctgttttatatatataaatatacataaaggatatatatatataaatatatatgtgtgtgtatatatatgtgtgtatatatatgtgtatatatatgtgtgtatatatatgtgtatatatatgtgtgtgtgtgtgtgtgtatatatatatatatatatatacatcattctttccatcattctcccctatgaaatcgtccataaagtatccttttataactacctattgcctgggaagtgaattttctttatcttttttctttagagatagagtctctgtcgcctgggctggagtgctgtggcacgatctcgactcactgcaatctccacctcccgagctcaaatgatcctcccacctcagctgccctagtagctgggactacaggtgcgcaccaccaatgccaggctaattttttaattttattgtatttttagtacagaagggggttcaccagcttggccaggctggtctcgaactcaattgatccaccagcatcagtctcccaaagtgctgggataagaggcgtgagccaccgcacccagcctgtcactttctttttggagaataaaacatattgagtcttgtgccaaaatgcaggggaagctgcacccagaaaggtaacaaaatattatatatatagatagataggttttctacataccaatattaaccatttagaaaaccaaattgagaaaaaatacacttatatagtgacaaatatacataaaatatctaaaaccagatgattggagcaagatggcagatagatcccatgccccactcaacattccattgaactgggaagaaaatgttttcaagggtcaattctcaagagtagaggaaaataagaaaacgtgtcagtggtccaccagaaatattaaggcattcctgggagatagagtagatgggatcagactgatagagaaacccaaggagacaagaccacaggtcaaatcactgtaggcgagagatgctgtttgagacagagacttactccatcgcccaggctggagtgcagtggcgtgatctcggctcactgcacactctatctcccaggttcaagggattctcctgcttcactccccactgtaactggaattcatagaggcctgccaccatggccagctgatttttgtacttttagtagagatggaggtttcaccctgttggccaggctagtctcaaactcatgacctcaactgatctgcctgcctcggcctcccaaagtgctgatattacccagcgtgggacgccgcccaggtgatgatctttgtaacaaagcctctgaaaaactccaaaccctgaatcaaaaaaacacagagccggaaagggccttaggataatcatcaggtaggttaatttaaaagttcattagaaacatctgaatcagccagattcccctccaacaccacactcagattggctggcagtagccacttttgcctctaagatgaaactctgataattgttcattaaagaaagtgaaggcctggcgaggtggctcacacttgtcatcccagcactttgggaggctgaggcaggaggattgcctgaggccaggggatccagaccagcctgggcaacaaagtggatgccgtctctacaaaaaaaatacaaaaactagctgggtgtggtggcgtgtgcctgtagttccagctagattggaagctgaagtgcgagaatcccttgagcctgggagatcgaggctgcagtgagctgtacttgcatcactgcactccagcctggtccacagagtgcgatcatgtcaaaaaaaaacacacacacacacacacacacacacacaaaagtaacatatcagaacttggtgtaacttcagcccttcacaaggagagaaacacatttgtggagaagggaccatgttcactctttatctatccatgatagacagatagtccggagctttatatacccatggaacctatggaaaaatgttgcctgtcataactcacaatcttccagccacccttccttgtatctgtcttgtgggctgggggaaccaacttatggatcccatcatcccagggagaaagaaaaatcaaatccttcattatctcttttggggtatgctctcctctatttgcatggaggttaaggcactcaatatctagtagccgaatgttacatttgtgtaatacagaactatattggtataaaatcgaatttgtttcctctgagacacaggtagaggtacgtccacactgacctgggtggcagccatctcttcctgcagtgccaggcagggcatgctcacagatctggggaacctcttgctccttgagccccacaacctccttcctggcaccctctccctctggtggctgtgacagcccacacttggccttgggtctcccctgcttctttgcctgcccctcttctgcccaccctgcatatctctgtctcccactgtccctgctgtgaccacgactgcctctccctccccgcactctctctctcctagggctccttgtcttcggtaaatgaacccacagcctttacattgtgactggggacagagcccggggcttgttcagttctccctccttccatcacacacctgtcctccttaatgtttctgaagtcagtgagatccaaactcagcccctcctgcacctgccagctgtaggacctgtgacaagacgcctgccatctgtctgggtctccgtctctcatctgtcacataggcataatgatgatagtgtcctccttctcaggctggagagaaccaggaggccaaggtgatgggccacgaacgggcaaaacagctccaatcctgcctccacctggggctggtgtttcaagtccattgtgtgtgaatggagctttgatgtctccattgacacagaatagtttgttctaaaatagactcccctctgcccttccttccccacaactctttcacctctgcactgtgcagtggtatatgtgagaaagaacagtcccattcccaaatcatcatccccaccccaactcccaggcccttgattggtgagacccttgatgggcgttctcatgcttctgtccaggggactttcccaccaattgctcccctgcatggagactaagtggactcttctattccctgtccatcacaggatctacagtgcacgcatctgcctgattcctccacattccccagatgacgatttcatctgtgtctcctcccacatccacccaaatggaccgtcccagaccttgaaaccgaaaatcattcagagagcgaaggccaagatgcccaaccacctgctgcagaatcctgctccaggactgaagtgtatagtgtatatcaaaataaaaactggaggccaggtgctggggctcacacctgtaatcccaacactttaggagaccaaggtgggaggatcgctttggcacaggaatttaagaacagcctgggtaacatagacagactttcttgacaaaatcttaaaaaaattagtgggtcatgatggtgcatgcctgtagtcacagcttctctgcaggctaaggtgggaggatcacttgagcccacgagttcaaggctgcattgaactatgatcatgccactgcactctagcctgggcagtgcaagaccccttctctagaaaaaagaaacaaacaaagaaacccaacaactggaaacatcctcctctggaatggtggtcaggaacatctgcctgccttgttcactgatgtctctccagcacctagaacaacgcccagcacgagaacacactcattagtgttttgttgaataaatgactcctttgacacagcaattcaacttctaagaatctttcctaaagaaatattcacacaggtgcagagacctgtgcgcacattaatgagaggagcaaacaactggggaacgtttgcaaaggtgtattaactgtcagtgactgatacggggaatcagaggaggggagtacatgctgaacaggaaacaaattgaaggggggcttgaccaggactcatggcaatggggaaaagcatatgggagatgcttatactggtacttggtgtgtctgtgtgtgtgtgtgtctgtgtgtgtgtgtttgtgtgtctggtgtgtaaatgcagaggggaaaatcggaaattaaacactcagatctgccctcagtagtcacatctggggagagaggagggtagtgctgttctatggagagaatacctgactatacttgctttctgaggtaggtgcatggatacacaaaccgaaatacacattaagcatgtcttgctcatcaatgaaaacgctaatatctaacagaatggcacactgtaagaaaatacaatggaaacactaacatcgaactcttgtcacactaagaaaaacgacgctcaacttttcactgttgtgaacacttgctttcacttgctatgcacctgatgacgaggggtccgcagccatgcccatgttcgtgaaaggtcaccacgttctgcttctcatcatgggcatatgtcgtatccccgaggctgaggcaagaagagagaaggaaagtaagtggcagtgagttcccaccacgtgacaactcaatctcaactcctcctgacctgcagaccctgcacactctgattctgccctaccccaggacctgcacacgccttccatggttccttgaagtgaaccatccgctcatgccacagtgacttcttcgcctgggttatccattcctaggctagaggaaggtgtggcccacatacagggctgatctggagttcgggaacccacagcatcctgggtagggagcattcctggatatacagggcagggagtaaaaagagcttacgaaggccaggcgcggtggttcacgcctgtaatcccagaactttgggaggccgaggcgggcggatcacgaggtcaggagaccgagaccatcctggctaacacggtgaaaccccgtctctaccaaaaatacaaaaaaaattacccgggcgtggtggcgggcacttgtagtcccagctactggagaggctgaggcaggagaatggcgtgaacccgtgaggcggagcttgcagtaagcggagatcatgctgctgcactgcagcctgggccacaaagggcgaatccgtcaaaaaaaaaaaaaaaacgtgggaaatctctcatcattcggcctcaatgctgtaccctagaaaattatgagacgggaatgatttggggagcaagtgacagatgggataccagtatcataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctccttctgttgtggggtttagattcccaaccttttcacttacgggaacatccacccttacctcctttcattcagcacgtgtttttattgagggcaccgaggcatacttttttttattgcacaacattttcatagtgcttcacagatgctgcaatgtttttttttggaaactctcatcaattttacacctttccgttattattatatctgttatagtgatctgtgatcagtgagctttgatattattactgaaattgtttttgttgttttttagtcttttaaaataattttaattttttaatttttaatttttattttattttattttgtttgagatgaagtctcgctctgtcgcccagactggagtgcagtggagcaatctcagctcactgcaacctctgcctctccagttcaagcgattctcctgcctcagcctcccgagtagctgggactacaggagcatgtcaccacgcctggctaatattttgtatttttagtagagacggggtttcaccgtattagccaggatggtctcgatctcccgacttcgtgatctgcctgcctcggcctcccaaagtgctgggatcacaggcgtgagccacggcgcccgtccgtgttttttatttttgtgcatacacagtaggtgtatatacttatggggtacgtgagatgttttgatacacgcatgccatgcgtaataatcacatcatggaaaatagggtatccatcccttcaaccacttatccttgtgttataaacaatccaattacactcttctagtttttttaaaatgtacaattaagttattattgacaataatcaccctgttctgtgtaattgtttggggggtgggtaccaggaactgcacccatagaagatgacaaacttaatcgattaatgttgtgtgtcttctgactgctccaccgatgagctattccccatctctcctccttttcttggacctccctatttcttgagacacacctatattgaaattaggatgattgacaaccctataatggccgctaagtattcaaatgaaaggaagagtcgcgtgtctcacactgtacatcagaagctagaaatggctaagcttagtgaggaaggcatgctgaaagccaagacaggctgaaagctcggcctcttgcaccaaacagccaagctgtgaatgcaaaggaaaagttcttgaaggaaataatagtatataatgcaaagggaaagtccttgaaggaaataataatattaacactccagtgaacacacgaataagaaagcaaaactgccttactgctcaaatagagaaagtttgagtggtcaggatatttgatgaaaccagccacaacattcccttaagccaaagtctaattcagagcaagaccagaactctcttccagtccatgaaagctgagagaggtgaagaagctgcaggagaaatgtgtgaagctagcagaggttggttcatgaagtttaaggaaagaagccatctccataacttaaaagtgcaaggtgaagcagcaaaccctgatggagaagctgcagcaagttatccagaagatctagctaagatcactgttgaaggtggctacactaaacaacagattttcaatgtagataaaatagccttctattggaaggagatgccttctaggactttcatagctagagagaattgactcgaactttgaaagaagttctactgtgggtaaaatgctgtccatagcatcacatactacagagaaatccttcatgaagcagagagttaatcaatgtggcaaatttcattgttgtgttcttttaagaaactgccacagccactccacccttcagcaaccaccaccttgatcagccagcagccatcaacaccgaggcaagaccctccaccagcaaaaagagtgagtcactgaagactcagaagattattagcatttttgacaatgaattattttaaaataaaggtatgtacatttttagacataatgctattgcactcttagtagactgcagtatagtgtaaacataatgtttttatgcactgctaaaccaaaaaaacaatgtgtgtgactcacattattgcagtggtctggaaccgaatctgcaatatctctgaagtacaactttattgggtatcaggcattgagctgagtaagatattatcccaggttatcaaagatagaatcgcttgagcacctttcatgtcatcaggccttctagattaaatttaatgtctccaaacaatttatgaactatgattctttatttccatcttatggactaggaatctggaactgagaaaatttggaagactagccccaagtcacgtggtttgtatatgggtgacaactccagtctgtatctctggaagtccagtcaaacatctcatctggagctgggcgagctcctcagcccagcctggacccaggcttgtctggggtccatgccacacacccagtccacacacctgaacatagccacggaagccagagggtttgttcccgaattctttcctcttaccggatgtcttgttaatcttctcagaggtacttggttttcctggagggcacaggtgtttcccatcgttctgtgagccagatgcttctggcactcccttcgaatcatttccttcctctgctggcttcttgggcatgatctttataatgtgaaggtcacagataaacagaatcagtgacatttctatagtgctttagagcttacaaagcgtcttcacatgcattaccttaatcaatgttctcaacaatgctgggagagttacacatgcctaaattaggagaaacctgggaagttagacgggaaaggaatggcctatgtgaatatcgtttccagggctagaatgcttatcttcacactctttaagactgacattcttgcaaacagtaaaaatctccatgcaattgagagtttggtatacaaaagattggaagaaggatagcatttttaaaattcacaaggtctacaaaaggaagagcttctatgaaatacaagggatctcatataagctcttagctgctgggagagtaaatgtaaaaacatagagaggggacaaaacactgctgggaaagatggtgtggggagattaatacagggaagggagaggtaaagaaatggtttgctaaaattaatctaggcagcgaagaaagcagtaccagatctggcataccaccctaccgaggcaccaacactgaatgtggaattcagtgaggtggtacccataccaattctggttgcattgggatgtgtcactgaccaacaatcttaagctacttttttttttgttgttttgttttgagacagagtctcactctgtcaccaggctgcagtgcagtggcacgatctcagctcactgcaacatccaactcctgtgtttaagtgactcatgcaacagcctccagagtatctgggactgcaggcaggcgctaccacgccccgctaagttttgtatttttaatagagatgaggttttaccatgttgggcaggatggtcttgacctcttgacctagtgatccatccacctcagcctcccaaagtgctgggattacagtcgctagccaccgtgccccgctcttaatctactttttattcagcttccttgcttatgagatagtgaacaatacatgtaaaatagtctacgggaaagtcctctctgagcttgtaaacactgtttaaatgcagtaataataacaattaatacctttcatgatccttccttcaattcggtctccacactagcaacccaactcccagatccctttaccctctaaaccagagttgaatctgcacttgtggggtcactcattcaggggcctccgagggatcccctgggctgggatgggggcttctgggatgccccaggtgcagacaaggtcctcaaggagctcacagtagggaggggccaacagtcaaaacgattcctaagccatgcaagtggtcccagtaacagagcagaggccagctggtctttcctattgcgagaatgggtgtctcaatggaagcaccagcaggccctatggggtgaagccctagtgagcaacatctgaacttcataaacaaatgcaaacgtgaatgagctttaaatggcttggagctctggattagactaccactgccactgtgccccaggaaaattatttaacatatctataccccaatagcctcattttattattatgttgctgataactacgattctttacttccatttcatggaccaggaatctggagctcagagaacttagaagacttgtgccaagtcacatggcttttatatggacgacaaccgaagtgtgtgactcattattatttggagataataatagaaacaaagtcatacaggtcttcttaaggattaaatacattaatccatgtgaactgcttaaaatagtatctggcatcactatgaaaacaaaagatgtattaaggatcacaactgttagtattattaagctgttggtgctacatcaggtgttgtgatagacatggggagaaggaggcagtgagggcattttttatattctcccactcttaccagtgtttgcatccatggagggacaaaggttctctggtcctttagatctgagagacactcaccttcgggaagattctctggagcctgcaaaaagtcatctgaggacgttcaactgaaagagaatatatcagaatttttctttgttggtaaagatttccaaactctagagacttctgtagcatcagggtattctgcagcagagtgttatgagtccactcattgttgaggagttatttcagttttgcttctgaattatgtttagtcatggttgattcatttatctgtggcatcaattcagaattttccatctcatggtttatcaaatggggactaaaccccatcacagtctcatcttattcctttacatatcttttatttttttccaaataattaaattgattggttaggaatctgaactgtatccactcaagatgtgcaacaactgaaaatcattgcacacttcaaatgggtgaatcttatggtatgtgaattaagctgttaaatgtgtgatgaaccatggatgatttagtccagtggctctgagatattttcagtataaagacagtcctttaatgtcaaaatcttggcagacacccaagcactggattttcagatctcttacagtgatcgtgggagattttagaatctggcctttttagttggggagtaataggtctattggagacagtttggacgttctgaccttgtcttataattgtgttgtcagagcagaagagcaaggaaacacatatgtgacccctttatattcccaaaacgtacaaagatctctaccgaagaacctgtctttttttcaccctatgttatctctgctctctggcaagtgggaaagctctctctgtgtgttggatgagggatcactctttcaaactctcttccaagctcatcacggagaatcagggttctttgggaatgaaaagactatttggctctgataaaatacagagaaacagcgatctttattacataatgtgttcatcatcctcactcctaagatacctatccaatacctacatgctgttaatgagacaaactctggaagtttttggcgaatctacagttgtaacattttctttcttctttttttctcttgtaacatttttttagcagtcctttgattcattaatggtgcttaggaagaacaacatgtcatctaaaaaagaaatatttcaaacacacagaaaagtatgaggaataatattgagtccagtcggatctcaacattaccccacagctatgctaggtttgatttatttattcacaatattagaaaaactacaaacaggccgggcatggtagctcacacttgtaatcccagcactttgggaggctgaggcaggtggatcacctgaggtcaggaagtttgagaccagcctggtcaacatggtaaaaccccgtctctaccaaaaataaaaaatgagctgggtgtgggggcgggcacccgtaaccccagctactccggaggctgaggcaggagaatcacttgaacccaggaggtgaaagttggagtgagctgagattgccttattgcactctaccctggccgagaagagtgaaactccatctcaaaaacaaaaacaaacaaaacacactatcaacaagtcacagctgaagctgtctgtgcagcactcagcaatccctgcccgccctccctcctccacttacagccagtcacctcaatttgatggctttttattcacattcatgtttgtatacatttaccatttacttattatctataaaaatatatattcttgtttttcgtgttttaaaattttatatgaatggcctctgtagttaactttctgcatgcaatttttttttttttcactcagccctgatgtgtatgagggaacaaatgcctgaggatctttcccaagtagctgagctgaaaagcagctgggcttgaggagaccctttccagccccttcccgtctactcaccctgattcccttggttacggtcattatcaaaatcattcccctggaggtctgtggcccctgtattatgcatgaaaggtgggagggtggccttgaagcctagaaagaagcaaaatgtttattccttaagagacaagctttgacctgtcacggtggctcatatctgtagtaccagtgctttgggaggctgaggctggagtattgcttgaggccaggagttcaaggctgcagtgagctatgactgcactactgcaaactagcctaggtgacagactgagactcagactcaaaaaaaaagaaagaaagaaagatacaagccgagagaaggaaggtagggacggtgtgggggtgccgggatgccacagagacacttggactcatcagaacagaagcctaagggagagaaacgtgcaggatccaggtatgagctccactgtggccagtccctgccctcagccctgacaggatacagaagaggagaacacccagaagctgccttgcgatttttccctgcacaaaaggaaaatgtggggtactttctgcagcctaagaagtagccaaagcaggaatagggatgctcatgtgtccccagacttgtctgtacctagaactttctgttacctagtttagtcatggcctcatactttctcttcatatacacatagctgattttctccaaggatttcatcttttcccactctttcttagagaagtatttggcaatatcatcgaaggactaggaaaagataaaaaaggaattttgtcagtgactcagctagacatgtctgccattcagctggagccccttcctgtgtgctggatctgggaagtggggatgatgccatggctaaccgacaacatgagcgacctttcctagcttcacccctgccacacagtagggctttaatgctgctgactgactctcttcccactttccagaatggactgagattcaccaaatgtagtgcacggtcacagacttgtctccaaggatgctagttgatgacagagcgaggatgggaggctctcaaggatccagatctcccccaagaccctggtccttgtctccagtatctctgtcctcccctcctcagaaacttggccaccccacactgtcccctgggccactactctgctccctccaggtcacctcaccttttggatcttctctggtatttgagcaccagccctaggtctccttgcaaaggcgtcgtctccgttcatggcaccaggagcagtctgacctgcaagagaaatagcctgagtctttccagccacagcagctttggtcttgtggagggagaaatcagtgaaggccggccaccctcagtcacctggaatcaggtgcttcatttctccatctggggcttatctgtccctgagtaatgacatggggcgaagtcagatgaaaatagggaaccaggggtctctgggagaagtattgatttgggatgacaggcttcctgtgggcaaagcagccttgagtctttgggagggggttggctaatgttgttagtagtttccctggggctagccttactctgaaagatgtacagacccttgttgggaaggcagagatgtgactgtgtaattttattcagtgggggcatgctgacaccccgactcaataaataatggaagggaaatgagtcccagagataacatcgtctctctggtgatggatctgatcaggcagagggatagggggttctgttctgttgaagagaaatgagcatggctaatatgaacggatttagaggctattactgggtgatttgtaaattattagaagaagagagctagaatttctgagactacaagagcccgccatcacttagagagaatgtagggagtttcaaggtgcagcaatcagccaggcgcagtggctcacgcctgtaatcccagcactttgggaggccaaggagggcggatcgcttgagcccatgagcttgagaccagcctggccaacataccgaaaccatctctactaaaacaacaacaacaacaaaacacacacacacacacacacattaacagaagcggagtggtgtgcacctctagtcccaaggcctacgcgagaggatcacttgatcccaggaggaaagatttgagtgagtttttttttttttttttttttgagtcatggtctctctctgctgcccaggctgggatgcagtggtgtgatcatggctcactgcaacctccgcctcctgggttcaagtgatccaccagctgtggcctccaaaactgctggaattacaagcgtgagccaccgtacccggcccaaatttgttaagttactagagttcccaggaaaaatcccatacctgaaaaagttagaaactgacaggaaggatttgagatggcgacctgcctcacatacactccttattaaaactagataacaaatgcaccacagaggaggggaggggtagtaagaatggaaaaagaaaatcagcgcatgcttactctgattttggaagaatcaaaagagaaaatcagaccgtgcgtactctgagtatggaagaatcgagagagaaagtcagagcatgcatactctgaacttaaagtagccaatcccaggggatgctttaggcgggaaaatcagagtctccacccccactttgagaaggttctgtccctggagcctggactgatagaagccacatcagcttcgcttatcacgctactgttctgacttctgattggccagatggagttcactaactgccctgattggtccatcatccctgcatagtgacattgcacaatattgtctcctcctccagcaacactttgttgccactgcgacaaagtgggtggtcctcaggcgccgtcaggagattttgaactctctgaagaccgtccctggatcttgggttaaaaatctgttttctagtctgaacagcgagaagaaaaaaatagtcggatctgtgatttttctacttgaaagacacaatgttttccagactagcacatttgcagagctttgctgtacttagtagtggctttcattcttcagtggcttctatatctgttgctactgaaaaaacagtccaaggccctccaacctctgattacatttttgaaagggaatctaagtgtggtgtgcacaattaccatcctttacctgtagccctggagagaggaaaatgtatttacttatgggatgtgattgtggtattggttacatccgccttggccaatcttcccgcctcggtctcgcgactacaggtgggaaccaccccacccccactaatattttttgtttttggattttttaaaagagacggtttcgctatgttggccaggctggcctcaacctcctgggctcaagggatccttccaccacggcctcaggactactgccattctgccctgctcatttttattttattttattttattttattttatttatttatttatttatttatttatttatttatttatttacttataggaaagacaggctttcgctacgttggccaggctggtattgacctcctgggctcaagcagtcctcccaccttggcctcggaactacaggagtgagccatcccacccacgcaatttttttgttgttcttgttgttagtagaaatggggtttcgctatgttggccaggctggcctctacctcccgggctcaaacaatcctcccgcctcagcctggtgactacaggctcacaccaccccaccaccactaatatttttaatttttctagcagagacagttttgctatgttgtcctggctggtccctacctcctgggctcaagcgatcctcctgcttcagccttgggactacaggcatgcaccgccctgccttttgctatttttccccggctgcttttgactttctgggctcgctcaatgatttgaacctgggaagcggacgttgcattgagctgagatcacaccactgcactccagcttgggcgacagagcaagactgtcaaataaataaatacatccatacttgaaagaaagaagaaagaaaagaaaggaaggaaggaaggaaggaaggaaggaaggaaggaaggaaggaaggaaggaacgaacgaaccagctgaaactctgtaaaaacagtaagctttgtggtatattaacttaccctcatcccatctcgtgctcccagcttggttctgttcattgctgctgaaatacagataggattggccagaactggtagatggctggctgttgatcatgaaaatgtcagacctgatatagtcctcctcggaaaggccttttctgggggctgatactctatgtctgcagtgctgtgggacgatgacataatgctgagcattaagccaggcgaccatgggtccacatacggtggcaatccactaggctgccgagtggccatcgcagcccttgaggttttagaagaagaaaaccttgctgaaaatacagaaaacaataggtattctcttgagaaatgaacccatgaagctaccttctgatgctgtaactgctgtaagaggaagagaattattgtgtgtatgtgtgtatgtatgtatgtatttagagtcagaggttcactctggttgcccagtatgcaatggtgcgatcttggctcactgcaacctctgcctgctgagttctagcgaatctccttgcctcggcctcctgagtagctgggattacaggcatgtgccactatgcccagctaattttcatatttttagtagagactaggtttcaccatgttggccacgctggtcttgaactcctgacctcaggtgatgcacccacctcggcctccgaaaatgttgggattacaggcgtgagccactgtgcctgggaggaaaagaattattaatttctattgttattaaagaaagcaaagattgtgatgcttggaaggtgtgtctacgacttcaagattatccacttctggccaagccaacccatggcgacatcatcaggtttcgcctccgctggtggtgaagggggatgagattcaagtccagtgaaatcattaacaagaccatcttgtcgttctgagggtagcagctgttttcagtggtccctgggagccggctggagacaggtggtcttgtaaaagctctgctcttaatgcgggcacattccactccatgtgtcttcaaaatctttttgtggagtatctatttttttcagttaatacatagcagaacaacgtttatgaagctgctgtttgctttgtaacgtaagtaagagcatgcaatggcatctatattctgtgaaagtgttttgatgtgtactttctaaggttaaacgtatctacatatacagacagtgtttaaattacatccttcagtatactttatatatgtttttataatttccttgctggtataaatgctttgcatttgaaaaagttatctctagggaattacataaaagacttcaccttataaagtcaaatcattgttatcattgaattttaggaaggatgaatggttaagtatgtataaaatactaatattaagtaaacttcctgttggccaacaccaggatgtattctatggatgtcattattttcaattaagaattagtgtttaacattcctaaattgttttgagtgcttgattataatttgttaaaaaatgtttatttttaatatttctttaaatttagtataaagcttatatttcagaaaaaaaaaagatacagaacatgcctgggtgcagtggttcacgcttgtaatcccagcactttgggagggcgaggtgggcagattacttgagatcaggagttcgagaccagcctggccaacatggagaaaccctgtctctactacaaaaatacaaaaaatacaaaaatacaaaaattagccaggcatggtggcacacgcctgtattcccagctacatgggaggctgagacaagagaatcgcttgaacccgggaggcagaggttgcagtgagccaagatcatgccactgcactacagcttaggtgacagagtgagaatccctctcagaaaaaaaaaaaaaggtacagaacatttccatcatcataatgctatcccttgtgctactcatttttagtaatactcactctcatcccatccaccatccctaacccctggcaaccactaatctgtttttcatttctataattttctcttttctacaatgctgtacaaatgaaatcttatagtatataacgttttaggggtttatttcactcagcataattccatggagattcctccaagatattgatatttgtgtatcaatagttcattgttgttgttgttgttgagacggagtctcactctgtcgcccaggctggagtgcagtgtctcagctcactgcaacctctgccacccaggttcaagcagttttctagcctcagcctcccaggtagctgtgactacaggtgcatgccaccacacctgggtaatttttatattagtaatagagatggggtttcaacatactggcaaggctggtcttgaactcctgacgtcatgatccacccgcctcggcctcccaaagtgctagggtaacagggtgagccactgtgccctgacgatagttcatttttattgctgagtagcattccaggggatggatataccacagtttgaccattcacttattttaggacatattgattatttccagctattggctattacaagtaaagctgctatgaacaattatgtacaagtttctggatgggcatacattttaatttctctgaagtgtaattgttgaattgtatggtcactgcattgtttagttttataagaaactaccaaactgctttccagagtggctgtaagattttaccttcccagcagcacttaatgaggtgtccagtttctctgcatccttgtcaccatgttgtcactatgtcttttattttagctattgtaataagtgtgtagtgatacctcatcgtggtgttattctgcatctagtgaagcaaatgagtgttgaacatcttttcatgtgcttatttgcttatttcctcttcagtgaaatgtatgttcatatcttttcatgattttctaattggattatttgtttgcattttttaccattgaggtttcttttattattattatttttcttgagacagagtctctctctgttacccaggctggagtgcagtggcatgatcttggctcactccaacctccgccttccaggttcaagcgattctcgtgccttagcctcccgagtagctgggattacaggcacgcatcatcatgcctgtctaatttgtgtatttcagcagagatgtgttttttgccatgttgcccaggctggtctcgaactcctagcctcaagggatctgcccccgcccccccgacctcgacctttctaagtgctgggattacaagtgtgagccaccatgctcagcctaccattgagttttgagagtagtatgtatatccattatatattctggatgtgagtcctttcttggatatgtggtttgcaagcactctctcccaggtcataacctgttttttcatccttttaaaaagatttcttgcagagcacaagttttaaattggatgaaatctaatttatttttttccttatggattatgctttttgaaccgttcactatgccctagatctcagatgtttctcctatattttattgtaaaagttttcttttagttttatattttagatttaaatctatgatccacttgagttactttcttgtataaaggtatgaaaattaggtcttttttttttggcctatgtctacaacatcttcagcaccatttgttcagcagacaatccttccttctttttgtctcttggtaaaaaatcagtgtggggctatttctaggttctctattttgttccagtgatctatgcgtctattcttctcccagtactacacagtcttgattcctatagctatataaaaagtattgaaatatgaaagagccattcctcccaccttattcttctttttcaaaaattgtcttagctatataaatattttttgagatggagtctcacttgtgtcacccaagctggagatcagtggagtgatcttggctcgctgcagcctccacctcccatgttcaagtgattctcctgcctcagccccccgagtagctgggatttcaggcactcaccaccacacccagttaatttttgtatttttattagagacggtgttttgtcatgttggccaggctggtcttgaactcctgacctgaagcgatctgcccatctcggccttccaaagtgctggtattacaggcgtgagccaccactcccagcgttgtcttagctattgacaatttgttacagcaacaatcaaaaatgaatatacgtagaaacagattagtgtaactaaatagaaagtcaagaaacagactaatttatataccaacttcagcatgcatttccaaacaaacagtgggcaaaagatgggttgtataataaaggattggtgacaagtgtctatccatttgaaaaaatgaagattaaatccttactctgaaccacataaaataataaattctaaatgttcagagacataaatgtgaaaatgtgaagtcataaagaactagatgaaaattcaggaaaatattacagtgtaagacatcttgaattggcataagcaattcctgacattacaccaaggctataaacaattaatctgacatagttaaagatgtaaaaattaaagtatcatctaagtcaaaagacaccataaacaaccgtttaaaaaggcaaattttaggcggggcggggtggctcacgcctataatcccagcactttagggggctgaggagggcggatcatgaggtcaggggatcaacaccatcctggctaccacgacgaaacctcgtctctaataaaaatacaaaaaattagccaggcacggtagcacgcgcctgtagtctcagctactcaggaacctgaggcaggagaatcgcttgaacacgggaggcagaggttgtaaatttaagaggaaggagaagatttcaataagcaatggtgaggagaaaaatactagaatttattgaaaagtgtaaagtttagattgtaaattaaaaaaattatagtcttgaactaaatttgcaggtattataaacatggaagatgggaggagggacagaaaagaaaagagaagttattttggtgttcaaggaatgcatacagatactaatgaatgatagaatggtagaatggttaaaaacacgagcattttattttgttttattttagacagggcctcactctggtgcccaggctagagttccatagcacaatcgtggctcaatgaagccccagcctcctcagctcaagtgatcctcctgcctcagcctcccatgtggctgggacttcaggtatgaaccaccacccctggctaattaatttttttttggtagagacagggtcttgctatgttgcccaggctgaccttgaactcttgtcctcaagcaatcctcccaactctgcctctcaaagtggtgggattataggagtgagtcactgtgcccacttaacactagtattttagagtacaaactctggaaccagacagcttgggttcagtttctggcttcccaacttattaagctatgtgaccttgtgtaagtcatataacctttccgtgtttcaggctactccagagtaaactggggataaccacactatctagctcatttgattgctatgattaaatgggcaagtacgtgtaaagcacttagaatagtgcctgtcgtgtggttaagttagtatatatcttttacttgttgttagtaatgacttcaaattacttttaaaatgtaaaggcatatctggttcaagaagaagatggtgaaccaggaatagctgctggcttccttcccaaacccaaccctgcagatgccacagaagaggtgggaagtggttggagttcagaacagttcctgtaacaaaacccttgatggtttggccccactgggggatgagacggcttagagtgggaaaaggtcagaggccacagatggaggatcagcccaggtggagctttctaagttgcattcttgttttctccttgttttctggaaggcttattacctgttctgtaaacatatagagcagacatttggcagggctggcctagtgctagcccaaagtggcgtgataacattaaggaatagggggcttggaaagctcctagaaaaagtgcagactcatcaaagctggccagtaactgagcattcctttcctacctcttcctctgccctctgagctaggcaattacaaccaatatcacccacccgtagactccctccactctgtaaggcagaaatcctgtaagcatctctgggggctaataggctaggaactggaaagaattggctcagctcagctcagctctagaggctgtgtatcctatgacctatcaatccagaaaccctgaaactcacatgtagtttctggggtgacacatttttcccagggacaaagagttatatagaaaaactatcagataggccaggcgcggtggctcatgcctgtaatcccagcactttggaaggcctgaggtcaggagttcgagaacagcctggccaacacgggaaactctgtctcttctaaaagtacaaaaattagctcggtgtggtggtgtgcaacggtagccccagctactcgggaggctgaggcagtagaatcgcttgaacccgagagtcggaggttatagtgagccaggattatgccactgcaccccagcctgagtgacaaagtgagactctgtctcaaaaaaaaaaaaattcctttctttcaacactttggagttattacaccattgtatccttgcctccagtgtggtgtttgagagacccaatatcagtttaattatttttcctctgtaagtaacctgctatttctctctgatcgttttaaaactactttttcttcctttcacaattttacatttcactgatcctgtgtgtgtgtgtacttataaatacctttaaatcttaagtcatttttctaaatctgagaaattctctttcattacttatttcagtacactctcttgtttaatgactatattctcttcttataaggctactattagatgtgttttgacatttattcttttatcctccctattaattaacttttctttcatttacttcatctgtatccattaccgattagttttatgaattctttagactcatttcctcaggtcagcctttgccttttcaactatatccgttttaatatccaacctatttcactgaattatttatttgagcatttaatgttttcatatccaatctatccaataggttattttttatttatttatttatgatggagtctcgctctgtcacccaggctggagtgcagtggcgtgatcttggctcaatgcacctcgcctcccgagtccgagcagttctcctgtctcagtagataattaaaaaaaaaaaaaaagctgcatttggtggtgtgtacctgtagtcccagccactcaggaggctggtgcaggaagattgcttgggccctggagtttgaggctgcagtgagctaggattgggtcaccgcactctagcctgagtgacaaaatgagactttgtctctgaaaattaaaaaaaaaaaaaaagatcgtaggcacgattttactcagaagggggagtaatatgagatgtacacgggccactgcaatgggtttttgtggtaggagagatattgggatcgacttggactccaccaaggacaagtggggatttatagtcaagagcagggtggtggggagcagggtcagaagatgggaaattacttggaggagacatcaggtgcagggggattctggctaaacagagttgacaggaattttgctgaaacaggcttaatgggcagagtccctggatggggaggtgtgagccacctcacctggccaacaggctatgtttaatatgtcagttttcataagtaatctaggtataattgttaaaaatgaataaacgaggtaaatgtgagatacatgtttataaatgaacttttcatgtaattggaaatcttttttctcttgctcttatcataggaagatgaaatattaaagttatgttgtgttagattaagtaataggtactcattaaatgtcgggatctttccaactaagaaaacagctgaaacaaatcgctaaacataaatacaagtttgttcttggcccttaagttttataaaacacaaaagatacttggatccattaataaaatgccctgttctacattgaaaattgttctggctgggtgtggtggctcacgcctgtaatcccagcactttgggaggctgaggcgggtgggtcacgaggtcaagagatcaagaccatcctggccaacgtggtgaaaccccgtctctactaaaaatacaaaaattagccgggcacggtggcgggcgcctgtagtcccagctacttgggaggctgagtcaggagaatcattggaacctgggaagtggaggttgcagtgagccaagattgtgccactatactccagcccgggcaacagagcaagacttggtctcaaaaaaaaaaaaattaaggttactaaaaattaaaagttcttagtatatgtagttccatatacaaaatatacagaaaacaatttttatatcaaaaaattttg

SEQ ID NO: 830 - DNA, 341240 bp, Homo sapiens
ggtatttaatcatctcctgagcactgcctaaatggagtattcattctgagggtgattagttctgagaggtgacagcatgctggcagtcctcacagccctcgctcgctcttggcacctcctctgcctgggctcccactttggcagcacttgaggagcccttcagcccaccgctgtactgtgggagcccctttctgggctggccacggccggagccggctccctcagcttgcagggaggtgtggagtgagaggcaggagcgggaacctgggctgtgcgcaccgcttgtgggccacctggagttccggatgggcgtgggcttggagccccacactcggagcagccggccggccctgctgtccccggccaatgaggggcttagtacctgggccagcggctgcggagggtgtactgggtcccccagcagtgccggcccacgggcgctgtgcttgatttctcgccaggccttagctgccttcctgcagggcagggttcgggacctgcagcccgccatgtctgagcctcccaccttctccgtgggctgctgtgcagcccgagcctccccaatgagcacaacctcctgctccatggcacccagtcccatcaccacccaagggctgaggagtgtgggcgcacagcacgggactggcaggcagctccacttgcagccccgatgcgggatccactgggtgaagccaggtaggctcctgagtctggtggggacgtggagaacttttatgtctagctaagggattgtaaatacaccaatcggcactctgtgtctagctcaaggtttgtaaacacaccaatcagcaccctgtgtctagctcacagtttgtgaatgcaccagtccacactctgtatctagctactctggtggggacttggagaacctttatgtctagctcagggattgtaaatacaccaatcggcactctgtatctagctcgaggtttgtaaacacaccaatcagcaccccgtgtttagctcagggtttgtgaatgcaccaatggacactctgtatctagctactctggtggggccttggagaacctttgtgtcaacactctgtatctagctaatctggtggggacttggagaacctttatgtctagctcagggattgtaaatgcaccaatcagtgccctgtcaaaacagaccactgggctctaccagtcagcaggatgtgggtggggccagataaaagaataaaagcaggctgcccgagccagcagtggcaacccgcttaggtccccttccacactgtggaagctttgttctttcgctctttgcaataaatcttgctactgctcactctttgggtccacactgcctttatgagctgtaacactcactgggaaggtctgcagcttcactcctgaagccagcaagaccacgagcccaccgggaggaacgaacaactccagatgtgccgccttaagtgttgtaacactcaccgtgaaggtgtgcagcttcactcctgtgccagcgagaccacgaacccaccagaaggaagaaactctgaacacatctgaacatcagaaggaaaaaactccagacatgccacctttaagaactgtaacactcactgcgagggtccgcggcttcattcttgaagtcagtgagaccaagaacctaccaattccggacactgttccacctcggcattggaagtatgtctcagtttgttgtccagtgctttagttgagcaaagtatgtgagcagcagataggatgcctctcactcctgtgaaacttttacaaaagaacattgttctgtgttagccaaacctataactttaaataactaattcatgttattgttaatatcaaccattaaggtgatgatatttggcagaggggttctaataaaggaagtagtcttttttaacactctgtaaactatagttagcctccagttattaaaagtggctttaagcatatgtcatactgggaaattgaaatttgagatggtagaatatctctttttcaactgcatgttgtgacaggtcataatccttcagtgtcttgcattagttagtatgtggcatatttaccacacatactgttagagaaaggttaactagttaccactgggaagcaccaaccaatagcataaaagcctaaggcttgttccataagttacttgttggctgaagaggtccactttaataatgggaaaataaggtagtccctaggggcactaccaggaaagaggcactttttagcaaaattaggccaattttaatgatcaagtgggtaattacccatgcattaattaacccctctcccaaagttgtaaactcctggatgggggttccttttgtgaaagaaaaataaacttcaggacccccaaatcactaagccaataaaaatatcaagctggtaactatgtcaggcaaacctgcctcccattttattcctaaataagatagctacagagattttaaaaagctagatttgtcatctgtaaacctccattgatgaggtgtgtgttaaggtcttcggcctatttttaaatgaggtgtttgttttcttcttattgagttttaacagatctttttatgttttagataacagtctttgccagatacatcttttgcaaatattttctcctagtgtgtggcttgtcttttccttctcttgaatttgatttctttttaagagtcaggattcttctgtcccctgtatagaaagataatggtagatctggaggcttgattagattcaatttcaaattttggcggcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagccgcctgccttggcctcccaaagtgccgagattgcagcctctgcccggccgccaccccgtctgggaagtgaggagtgtctctgcctggccgcccatcgtctggaatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgtctctgcccggccgagaccccgtctgggaggtgaggagcgtctctgcccggccgccccgtctgagaagtgaggagaccctctgcctggcaaccaccccgtctgagaagtgaggagcccctctgcccggcagccaccccatctgggaagtgaggagcgtctccgcccggcagccaccccgtccgggagggaggtgggggtggtcagcccccgcccggccagccgccccatccgggagggaggtgggggggtcagccccccgcctggccagccgtgccgtccgggagggaggtgggggggtcagccccccgcctggccagccgtgccgtccgggagggaggtgggggggacagccccccgcccggccagccgccccgtccaggaggtgaggggcgcctctgcccggccgcccctactgggaagtgaggagcccctcagcccggccagccaccccgtccgggagggagatgggggggtcagcccccccacccagccagccgccccgtccgggagggaggtgggggggtcagcccccccgcccggccagccgccccgtccgggagggaggtggggtggggtcagcccccccgcccggccagccaccccgtccgggaggtgaggggcgcctctgcccggccgcccctactgggaagtgaggagcccctctgcccggccagccgccccgtcctggagggaggtgggggtgtcagccccccgcccggccagcccccccgtccgggagggaggtggggggggtcagcccccctgcccggccagctgccccgtccgggagggaggtggggggggtcagccccccccccggccagccgccccgtccgggaggtgaggggcgcctctgcccggccgcccctactgggaagtgaggagcccctctgcccggccagccgccccgtccgggagggaggtggggggtcagcccccccacccggccagccgccccgtccgggagggaggtggggtggggtcagcccccccgcccggccagccgccccgtccaggaggtgaggggcgcctctgcccggccgcccctactgggaagtgaggagcccctctgcccggccagccgccccgtccgggagggaggtgggggtgtcagtcccccgcccggccagccgccccgtccgggagggaggtggggggggtcagcccccctgcccggccagccgccccgtccgggaggtgaggggcacctctgcccggccgcccctactgggaagtgaggagcccctctgcccggccaccaccccgtctgggaggtgagcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattgaaaaaataaataaaaaaaataaaaaataaaaagctatatacctccgtcacaatttgtcctttgtccacaagaaattttcttgtggagaaaggacaggcagaactcaaagtcatccctctgaggctcacgtgacataaatgcatgcctgattgcttcctctcccctattgttttactaagccaggctatagcataagtgaccattcctctacccttctctcacatataaattgtgtattcaataaaaggctaatcagagactcaaagaaatgcaaccatttgtttcttatctatgacctggaagtcccctcccccacctcgagctatccctcctttttggactgaaccaaaatacatattacacatattgattgatgtcttgcatctctctaaaatgtatgaaaccaagctgtgtgctgaccaccttgagcacatgtcaccagaccatcctgaggctgtgtcatggtgcatccttaatcttggcaaaataaactttctaaattcgttggttgagatctttcccagatattttggattcacaatttagcaaacacaaaggtattctgagtggaggtgtgcccaatctttgaaacatcttctgtcagtgcttggtaagagcctgagctatctttatggctcaaaccaacagaacaatttgctatgacctgggagctcccccttccagagaatccctgatctcacaaaatttggttgaggtctaaagtttattttgctgtaccactccttttttggagttttacctttttccaaaaagaaaggcaagttttcctgcttccatgacaattgaaagcacataacttctttatggagtttcagctagcttccaacagggaaagtgagtttgagtttttcctgcttttaggatggcagagagcaatcttcagcctgagactcatgcctacgtaaatagcagaattgaggttttggcttggctaaagttgagattgacaacgagctggtcttaatttctatcattcagtaaccatataaattgtgtgattgtttgttttgcttaatttgtttgtttggttctgcttttattattgttttggtttattccccactgagtttgaccaactctatatgacttgatcaaatccgaaggaaatttccaaattatggggaacaaggactataaattttctaaattcccacagcagaaaaacaaaaataatggccagccaataaatgtatatatatatttttattttgactacctgagggaccttattacatgataacgccactttttcttctagcgaagtcaaactgaaagagcagtggccatcaccccatgctgccatttagtaactaaagttctgccattttttttttcaccccgacagactgggtttgattactaaatcaagcccctttctggttagataattgtgttacttttaaaacgttggcaattttttctaacaaaaatatggtaatgttatttaaattgattttttaaaggagcttaatgattaaaagtcagcttaattaaaagctgatatccaagatatgtgatatgtgtgtgtgtgtgtgtgtgtgtgtgcgtatttaaaaggcttttacattttttccttcatctcctaggttcttgttttctttttttttttttttgagaaatatatttttttcttctcaattgacaaaattctgttttcttcttttacttctgctgtctctcttttcttttgtcaacctctgctgcatgagagacctaaaatagttttgttacctgaaagcggtcctgattcagacctcaagagagcattcttggatctcacccaagaaagaatttgagacaagtccagagtaaagtgaaagaaaatttattaagaaagtaaagaaattaaaaattgttgactccatagacagagcagcagcttagattgtttcactaaggatacttctagttattacttgattatatgctaaacaaggactgggttattgatgagttcttcaggaaagggtcgggatgagttttcaggaaagagcaattcccggaactgagggttcctcccatttttaaaccatcgaggttaagttcttaacattgtcatggcatttgtaaactgtcctggtgctggcaggagtgtgttttcttatgctagtgcattataattagcgtgtaatgagcaatgaagacaaccagaggtcacttttattgccataatggttttggtgtgttttggctggtttctttaccacaaatatgttttactgcaacctgttggccagctcctttactgcaacctttatcagcaaggtctttatgacctgtatcttgtgccaacttcctatctcatcctgtgactgagaatgacttaacctcctgggaatgcagccccataggtctaagccttattttacccagcccctaatcaagatggagtcactctgtttcaaacacctctgaaatatttctccctttctatttaaaagagaatcaataatcttaagctttgttgaggaacaaagatccatcttctgtaacttattcaggctgaataggggtgataatatttttgcctaactattggatcttttgcattaagggtagaaaggagctcactcaaaaaggatcagtatgctgagagtcattcataactctgagttctgacaaaaggtgatatgtggaagatcaataagtgttcaatttaagagaacattcagtaagtttatctgatatttttacacaaagagtaaaatagtaaagtcttctacaacagcaaagcaaaataagtaaaattatcacaagcaaactaaattagaaagctttctgtgaactggaaaattgctggaaccaagctgatgtgggattactagcagattccaataggtgccaaaaattagaatattgattcagatttttaaaataacaattcttcttgattcttattctttttttttttgttcaagtggtttattgtacaacatactgactatggttaataaatatatttttggaaattgctaagagaatagattttcattattacacgttacgttcaaaggtacatgcgcacaacgtgcaggttagttacatgtgtctacatgtgccatgttggtgtgctgcacccattaactcatcatttacattgggtatatctcctaatgctttccctcccccctccccccaccccacaacaggccccagtgtgtgatgctccccttcctgtgtccaagtgttctcattgttcaattcccacctgtgagtgagaacatgtggtgtttggttttttgttcttgtgatagtttgctgagaatgatggtttccagcttcatccatgtccctacaaaggacatgaactcatccttttttatgtctgcatagtattccatggtgcacatgtgccacaatttcttaatccagtctactattgatggacatttgggttggttccaagtctttgctattgtgaatagtgcctcaataaacatacgtgtgcatgtgtctttatggcagcatgatttataatcctttgggtatatatccagtaatgggatggctgggtcaaatggtatttctagttctatatcgctgaggaatcaaaacactgtctttcacaatggttgaattagtttacagtcccaccaacagtgtaaaagtgttcctatttctccacatcctctccagcacctgttgtttcctgacttttcaatgatcgccattctaactggtgtgagatggtatctcattgtggttttggtttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatattagccctttgtcagatgagtagattgcaaaaattttctcccattctgtaggttgcctgctcactctgatggtggcttcttttgccgtgcagaagctctttagtttaattagatcccatttgtcaattttggcttttgttgccattgcctttggtgttttagtcatgaagtccttgcccatgcctatgtcctgaatggtattgcctaggttttcttctagggtttttatggtttcaggtctaacatttaagtctttaatccatcttgaattaatttttgtataaggtgtaaggaagggatccagtttctgctttctacatatggctagccagttttcccagcaccatttattaaatagggactcctttccccattgcttgtttttgtcaggtttgtcaaagatcagatggttgtagatgtgtggtactatttctgagggctctgttctgttccattggtctatatctctgttttggtaccagtaccatgctgttttggttactgtagccttgtagtatagtttgaagtcaggtagtgtgatgcctccagctttgttcttttggcttaggattgtcttggcaatgtgggctcttttttggttccatatgaagtttaaagtagtttttttccagttctgtgaagaaagtcattggtagcttgatggggatggcattgaatctataaattaccttgggcagtatggccattttcacgatattgattcttcctatccatgagcatggaatgttcttccatctgtttttgtcctcttttattttgttgagcagtggtttgtagttctccttctcatctgcaaacagtgacaatttgactttctcttttcctaattgaataccctttatttctttctcctgagtgattgccctggccagaacttccaacactatgttgaataggagtggtgagagagggcatccctgtcttgtgccagttttcaaacggaatgcttccagtttttgcccattcagtatgatattggctgtgggtttgtcataagtagctctcattattttgagatgcatcccatctatatgcttttttactctttacattagtgtactattaatgtcaactccaattcttaatataaccttattcagttttaatgcctgactataaggtaagattttcattaacatttggtaaccctttacaaatttttgttaaagagcatgtcagtgctctttgagaaacttgttgtgcttttattttaatgttcaatttcaatgagataatacccttttaattttgttaatgttcacacacacaatttcttttaccagattaatttttcacaaactttccacaacttgcagaaacctccagttttttcctatataacttaaaataatcctttaaccctccacactaggcaaacaaaaattcacattcccatgaagcacattttactttccttataaaccttgcatgtaaaactgtttttatttcccaaagattgcttaagtcatgtgaactaaaaggcattgcactttttacttttctgacaaaatatttaagtgcttattattttaaacaaattaataaaacttttgcatatatagacatcacactcacaacacatgtaaatacacagacacaagatcctgtagttgtaaagttttccatttgccagtttttaaattggattactggtttcagggtgaagcccttggaggagcagggccaggaaagtatgcagtttctatgacttaataagcaggcatagctggaaggctaagacagatcccccatattaggaatcctatcctataccaggtcttggattcccaaaaaaagaaatgctatggaacaagacagtgcaataaatttactgtgcatttaattgcaaagcaacccaaagccaatcagcccattctgtgattagcccatcccccatgggggtgtcagctcacggtggaggtggagagtgggaacatcgccataccttccaggtgaccaacagcatgcttctctgatccaaactccaagtgcgcaaagaaccgaatataccgccccccataactgccattggttgtctgtccccaaaagtatatttcctacatagttagcacacaccaaagttctctcataaagccaagcaatttctgatactcccaaaagttaaaaacatcagataatgcaatgtgaaacagaacagagccttagattttgagatgaatctatccactttcaattcctgaggtttcatgaggaaaacagaggtttttcccaaaacgggggtctatggcacctcctgtttttcccaaggagtcccaagctgttagaacttgaatatctgcttttagttaagctgacttttaaccatagttctctaaaagtacctttaaatctcttattacccaactttagccatgccaaacccccaatatttctggcttttgcacttcaccaaaggtaacttcccaggtgaaaccaataagccttaaataaaggttatgatgtaaccacgagtgtacaaggtattttcaaaggggtggtaagcagtttttacaagatctagaatttccagtggtggctcagagaaaggaaggttcaagaaggtgagccagaagacgtacatggagcggaagagagtcaacaaatggtaaaggtcacacagatatcaaaccagaaaggactcataccctaagccaggattaaacccggactgtcattgtaaaattgctcagccacagcattgggcagtttccattgcccttccctgaaggagcctagagcagtcaattttgagcttgtaatggcttttagctgcttgagataatttttagggctatgacatgaacccccaatttcctgttttttggatggcagagaccaagagaaagtactggcacttggttacaaggtcaagctcccaagggcctaactgacgagtttgctgggccatcttgctcaaggcacaagccatcttaagcctgtgttctatcctaagatacccctttttctaacagaaagatgcagaaagagaaattcatagcacaaagtacaaccgatttgctacggcttaagactagcctcactaattctttttccaactaataacaactttacagaggcgataagcagtgatttttaccattccttcaactggtttgcacagagaggggaaagacaagggagaaaatcgttgtcttcagtagggtggggaaggtgaggtgctcaaggaggccagagaaagacccatccatccctgtaacactgaatcaaaagttcaggcagccgcttgtcaatctcaaaggtatcttttccagcagtcccagcagctctcagttttacccctttggggaggaaaaagctacccatgacttataatcctgtgcatgcctaatcctgtcatctatagctgtcagcaaagagtgtaaggcagattaatccaaagagaatggcagttaacagcccatggtgccaaacccattcttagccgagaaggactttaccaagagggggcctctaatgccctaaatcttaggaaggactctaactttcttaaattgggcctcaaacccaagtttggtcaagcatccttgcctgtaattgagaggagcctttaaccccttcagtcatagaagagactctaactcccctaagttgggcctctaacccagttccatcctctacctgggtaccccaccacttactcaacgtcatccaatcagcactgcagtgtatttcttttgggtcggcgggggggtctcctcagtatcaccccttcatggtagccaggaagatgttactgaaaaggtgccttgatccagactccaagagacagttcttgggtctcacccaagaaagaatttgaggtgaatccatagagtaaagtgaaaccaagtttattaagaaagtaaaggagtaaatgagtgactactccaaggcagagcagtggcttgggctgcttcactaaggatacttctagttatttcttgattatatgctaaacaaggggtggattattcatgagttttccaggaaaggggtgggcaattcctggaactgagggttccttcccttattagactatatagggtaatttcctgatgttgccatggcatttgtaaactgccatggtgctggtgggagtgtcttttagcatgctaatgcattataatttgcatataatgaacagtgaggatgaccagaggtcacttttatcaccatcttggtttgggcgggttttggccagcttctttattgcatgctgttttatcagcagggtctttatgacccgtatcttgtactgacctcctatttcattctgtgactaagaatgccttaatctcctgacaatgcagcccagtaggtctcagacttattttactcagcccctactcaagttggagtccctttggttcaaaagcctctgacagtttctaacaccctgggaatccttaagtaaaacagaggaggtgccagactcccttttggaaaaaaaaaaaaaaaaaaaaaaaaaattctatttttccttatgaaactccaagagtgcaaacacacaagtttgtgtcagatcttaaactgcttgcttttgtattttgtattttgttacctgactttttttaacctttgactaaaatagttactacaacagaggctattttgaggtttaaattacggaagcatgcagtttagacacttacagaaatgtctttgtttaagaaaaggtgcactgtgaaagtgtcacgtggtataacctcataataattttctctttttgaagacccaggattcatgatcagagatccagttaaaaggtacagaacaaatttacacgatgtatctgaataaaattgatcttctcatacaattttatcatagatttctatgaatttgtgtttgatttgccattcatttttaatctctctctagtaccaccaaactctttctctctgtactttgagttgtacgtcattttgctatctggtttttctcctaagagttgttcctctaatacgcaaatttaggactatctagctgacaattgcctagggtaatgaaatcggttatcaagaaattggaagtctaaaggaagagaaaaaaaagaggtcttatgaatttataagatctacttctatcaatgtgtctaatacttctgtgtatttatgtgtcatgtatatgatgtttcactactaagaatactaaaagaactctgattgattggctttaaaaagcactaaaatcaaatgctttatcagataaacagagactttaagacaaatgttttttcaagttcatgtgagttaagtaaatctctaacaaataagctggtttgtacaatgttggtgaaatagaattagaaatggctttagaattgccaacatacataatcgtttaaatttacttttcaagtggttttatgtttatctctgcttgatgtcaaaatatgtcatgagggttatacagctgtaaatgcagttcaaaaaagaattatcgttgcttatatagaatttgataaataaggcatttaatattttttgtttaatgaaaacagctaaatcctgagtgattggcaaaaaaacaaccctattaatgtaacctcaaggtttatacttggaaaaacctgaaattcacaagttataaaatgtgtaaacaaaaaaataacttaaaataataactatcagagttttcataagtaatctaggtaaactattaaaaaattaatcaactgggtaaatttaatggaataaatgcttgtaaataatcttgccatatgatttaaaatctaaagttatattaacttaaataatacatgtttattaaatgtctgggttactttccattttacaagttatattatagaaaaacattaaaaaaataaatgtgttcttatttaaaagaaaataaatgttgtctaaaggtcattttaaaaggtatttataaaacaaggtaaaggtaatcagtaaataagagcaatgtaaagaatatatatatttatatatgtatattaataaatacaaaaaggtatttttgaaaagaaaggttaaaagaaaataattttatacgagaaagaatctttttctttatttcaataggttttgggggaataggtggtgtttgggtacatctataagctctttagtgatgatttctgagattttggtgcaaccatcacctaagcagagtacactgtatccagtgggtagtcttttatcattcaccccctcccacccttttccccaagtcccaaaagttcacagtattacgtttatgcctttgagtcctcatagcttagctccaacttatgagtgagaacataagatgtttagtttttcatcacagagttacttcacttagaataatgatctccaaatccatccaggttgctgtgaatgaaattatttcattcctttttatggctgagtagtattccatggcatacgcatatatagatatgtaatattttctttatccactcatttattgatgggcatttgggctggttcaatatttttgcacttgcgaattgtgtgatgtttcaggcttcaggacagtagggaaagtgtccctgtgtagaaaccggttgtggctaaagcagttgggtaattttgcaacacccaatgttgggcagttgtctcagccttgacagaagtggctagagaagctctcagagagttccactgaggtcttaacatggggaggagttggagccacctgagtctcctgccaggacagcagaaaagctatccacctctcagtcactctcctgtcccagtgctcaagttattcaaattagagaggcaccattttttttcatatgcaggaatgttgatatttcaagtagagaggaattgtggctctgtctgtcatgcaagcctgaacctgtaaagtgttccttcttcaggaatggagtcaccctgaatgtcatgtcctcttcttcaagaccttcatatgcaccagggctgtttgactgttgggttgtagctgcagactttcctctctgagcccagcactaaaactgcgcctctgctgaaagaaacttcccaccagtggaaggacctgccactcaaggcctgctctccagattcttttgtctcatggggtgttcccttgatgtggtgcactctcccttcccttcccgtaggagtgggagtcactgaaagccagactattgtgagtgttgttgctcttctgggtctagccacccagtgaagttgccacacttcagcctgctactgggccatgtgtgcgaggggttcggtgatgtgatctgtcctcaagtttcccagcggtgggtagcagcaccagctctaatgggagtggcaggtgactgatgtagactatgtgagattttttagttaacgatacccttagtgtgttggctttctcaaatgccatttacagtagtaatgaactggtcatgtggacaaactcaggaccttctgcttaggcatagtggtgcaggcagtggtgatagttgaggttgtgcagccattttcttcttcttaggtgcagtgttattctaccaggagatgcttaatggactgtgtttcttggcctccagcaagaaagtggcactttcaaaggagtatcagctctggtagtaaccgtgggggtttctgcttgccttatgttgcccaaagggtgtgctctggtttctcaggcaatgggcgggaccatatagtatttattaattttcatatagcacttattggactatgtttctgtcctttgtgttaagccaccagggcaggtggtggggcaagggcaggtgggagcttggtcagtcagatcttttctctgactcaccgtgttcagggcaaggaggcacctctgtcggtgtcagggaatgggggtgattctcaagcccctggtttttacagaggggattgttgttgcctctgccgcatagaagggctcatgcaggaagtggggagtagcaggtggcagtaagccccacacagatcccacgcacttggtgaggcagatccacccctgcagtgttccactggtagcagtgagctaagttccaggaagcctgcactcagaactaacaactgccccaggttgtaagctttccccatggggataacaaccatggcttttaggccatgcccctccctgtctgctcacaaagccaggcacctcattcctgcacttctggctgcagctcacttttcacttacccccatcctggcgctggccaaaggagtttgtctccatccaaggatataccatgaaacacggtcaggggcttctttcagcctacaaccactgcctgaactatttggctgacctttgcagggtcccctgtgagaaacaataaagactggcttctttcagtctgctctggagattgggagtgcacgccagggtcttcctgctgctgctcctacttttatattccatgaccttctccaatttggttcctgcactgagtagggttaaggcttcccactgcggcctggattttcaggctccctgggaggggtgtgtatcccagaggcagtttcgtcccctctcacacactgaggacccacacttgactcgtggtgtaggctgcaacctgccacttccttcaaagggtctgtggattccttccattttcctgttcagttcctgcattgcttcatgaaaaatagttcacagtgtgaacctctgcacactattttgtccttccaagagggagagatatgctagcaatgcctctaatccaccatgttaaaaaaaaaaaaaagtatggtctttttaattatatcgattcttccaatccatgaccatgagatgtttttccatgggtgtcttgtgattctttatgtagagatctttcacctcccttgttaaatgtatttctagctactttacttattttgtaatcgatgtaaatgggattgccttattgatttcgtcctcagcttccttgttattggtgcttagaaatgctactgatttttgtattttgatttgtgtcctgagaccctgaagaattcatttaacaaatctagagtctttttggggaatctttagggtgttttggtataaaatcatatcatcagtaaacagaaagaatttgacttccacttttccaacttggaactcctttatttcctcattttgcctgaccgatctggctaagacttccaccagtatgttgaataggagtagtgaaagtggacatccttatattgttccagtttctaatgaaaatgccttcaacattttcctattcaaggtgatgtcaactgttgatttgtcatatacgtccgttattattttgaggtatgtttcttcaatgcctagattgctgagagtttttatcatgaagaaatgttgaaatttgtcaaataatttttctccatctattgagataatcacatggtttgtgcccttgatatatatttatgtactgtatcacatttattgacttgcatatgttgaaacatccttgtatcccagtaataaaattcacttggtcatggtgtcttatctttttgatgtgctgttacattttatttgctagtattttgctggtgatttttgcatcagtgctcatcaggaattatggtatgcacttctcatttattttggtagtgttcttatctggctttagtatcagggtagtaccggcttcacagaatgagttaggaagaattccatgcttctctatttttgacatgttacagaatgattggtatctgttctttgtgcatttgctagaattgagctgtgaatcattctgattctgggcatttttgttgctattgttgggagattattattactggttcagtctcactacgcaatattgggctgttcaggatttcttgttctccttggttcaatcttgagaggttcaatttttttcccccaggaatttatacatttcttctctgttttctagtgagaggagttaactagcttgccttaggtagacagcaagggaagggtccctggagagcccctgacccacgggtcagtgcctcatccccatataacacaaaaagctgcctgggggaaaaaaaaataagctgctggcactgataagggaactagcacagggggttgtgcctggagacatgcccgtggctgcatggataggagaacctccagcccattcagacaaaaacttgcacaaacccctggctcactcagataagggaacaaggcccaacatagaaatgcctttgtcctatgtataatcaacaggctccaaggaaaaagtttcctctccttttgtgggcatgaacatggtgtgcttcgttgggttcaagtgggcactttcctttcatttttggactgtgatcccagcctctatgaatcatcacttcagcccctgattggtcccgggccaaactttcacttcagctcctgataggtcccaggccaagctgactagcctctatgaatcatcaactcctgattggtcccgggccaaggtcctgggccaagctgaatcatgctttctccaagacagcccacagactaagcacatttctttcccctttccagtccataaaatccccagaccccagcctcatagtgggcaacccattcgggctcccctctctgctgcagagagctttcttctttcacttattaaactttcattccaacctcacccttgtgtccccgcttcttagtcaccttggacatgagacaaagaactccaggtattatctcagacaatgagagactgttacatcttggtgaactggcgagactacaacaccagtttatgagtacatagttgttcacagtagtctttgaggatcttttgtatttctgtggtatcagttgtaatgtctccttttttatttctgatttggtttatgtggatcttctattttggtttgtctagctagtggttggcacatttggttcatctttttgaagatttgacttttcgttttattaatcttttgtattgttttctgatctctatttcattcagttgtgctttgatctttgttatttcttttcctctgttaactatgatttgggtttgtccttgttttgttttagtcacttgatttataatgctatgtttacttgtgatctttctacctttttattttttaaaataagttcagggggtcatgtgcaggtttgctacatgggtatattgtatgatactgagatttgggtttttattgctcccgtcacccaagtagtgaccataatacccactaggtagtttttaaacccttgctcgcttctctcctttcccccatttggagtccccagtgtctgttgttcccatctttatgcccatgtgtacccagtgtttacatgctccttataagtgggaatatgtggtatttggttttttgtttctgcattagttcacttaggatagtggcctccagctgcaggcatgttgcagcaaaggacatgattttattttttcaatggctgtgtagtattccacagtgtatatacaccacattttctttatccaatctaccactgatgaacacataagttgatttcatgtcttcgctatgtcaacactatatgagtagtctggcaataaacatatgagtgcatgtgtctgtttggtagaacgatttattttcctttgagtatgtatgctgtagtgggattgctgggttgaagggttgttccacttttagcccttggagaaatatgaaaactgctttccacagtgactgaactaattcacattcccaccaacagtgtatgagcattcccttttcttcataggctcaccaacatctgctattttttcacttttcagtaatagccattttcactggtttgaaaggatgtctcagtatggttttgattttcatttctctgatgattagtgatgctgagcattttttcatgtctgttgactgcttttatgtcttttttgagaagtgtctgctcatgtctgctgcccacattttatgagatcatgtgttattttcttactggtttgattaatttccttatagattctagatattagtcctttgtgggatccatagtcttttaatattttcttgtattctgcaggttattttaaaaatctagtcatagtttgttttgctctgaatatgctctttagtttaattaggtccaaattgtcattttttgcttttgttaccttggctttttagaacataattataaattcttggcctaaaccactgcccagagcagtgtttcctaggttttttttttttttcatatataatttgatatcttacatttaggtctttaatccatcttgagttaatttctatatatagtgagaggtaggcatccagtttctttcttctgcatatggttagccagtttttccagcatcattcatggaatagtgtgtcttttctccgttgttaatttttgttgactttttcaaagatcagttggttgtacatttgcagcttcatttttgggttctctattctgttccatttgtgtacgtgtctgtttttgtaccggtgtcatgctactttgattagtgtagccttgtagtacagtgtaaagttgggcagtgtgatgcctctggctttgttttgttttgttttgttgcttagcctcaccttatgtaatcatgctcattttttgttccatataaattttagaatagttcttgtctaattctgtaaaaaatgaccttggtaactttgataataatagcatcgactctgtaggttgcattgggcaaaatggacattttagcaatattgattcttccgatccatgtgcatttaaggtttttccatttgtttttgctgtctctggtttctttcaacagtgtttttttagttctccttgcagagatttttcacctccttggttaggtgtattcctaggtattttatttttttctgactaatgcaaatggtatgttgtgtctccattttcatttatttcaaataatttttagatttttgtttactttccttatttaccccaaagtctttcagaagcaagttgtttagtttccaagtatttgcatggttttgagttcctcttggaattgatttctatttttatttcactgtggttaataagatgcttggtatgatttcaatttttcttgattcactgagacttgccttatggccaagcatgtggtgaaggcatgagtacccttcttgtgcagatgagaaaaacgtgtattctattattgtagagtggagtattctatagatgttttaggtctagttggtcaaatgtcaaatttaagtttagaaatactgttggcttcttttctgccctgacgtatctattgctgtcagtggggttatcattgtttggttgtctacatcatttcataggtctattcgtaattgttctataaatctgtgtactccaatattgaatacgtatatatttaagttagttatttattcttgtagtattaaacaaacccgttattattaagtaatgattttctttgtcctttttaatgttgctggcctaaattctgttctatctgacacaagaatagtgacccctgctctttcttgtttttcatttgcaggtaaatcttactccatctctttcctttgagcctgtaggtgtcgttacatgagagatgggtcccttgaaggaagcagatggttgggtgttcttttttaaattatatttgtcaatctatgtattttatgtagagcattaagttcatttacatttaaggttaatattgacattcgaggttctgttcctgtcatagtagtattcactttgtattctcaattgtgtaattgctttatgagatctgtgaatttgtacttatgtgttgttgtctggtagcaagtaatgtcctttccatgtttagaactcctcggagcatttttgtaatcccagtctggtgctgaataatgttcttagcatttgcctgtctaggatagactttatttctccttcatttatgaagcttagtttgtcaagttataaaattattggctggctttttttttttcctttaagaaggctagaattgggctccctatctcttcttacttgtaaggtttctctgagaagtctactatttatccgatggaattccctttacaggtaatttgaccctttttctctagctgctttaagattttttcttccacattgaccttgtaaagtctgatgactatatgccttggtgatagtcatcttggcattgtatcttgcaggtgttctttcagttccttctatctggatgtcaacctgtttaacaagattagagaaaatttcctaaattattccctcagctgtgttttccaagttacttactttttctcctttgctctcagtaatgccaataagtcataggtttggtcgttttacatagtttcatatttgaaacttgaagactttgttcattgttttaaacatgttttctttatttttttatctgactgagttaattcaaaagggcgtttttcaaagtcaaataatttttttctgctgtgtgtagtctattattaaagcttccaaatgtattctgaatatattttgaaatttctatagtgagatgtttaattctaggatttccattttatttttaaaaatataactattttgtctttcttaccttgtgttgtttttctgatttctttgtgttggatttaaattttctattggatcttgttgagttttcttgcagtctatattttaaatactttatctgtcatttcagacttttcattttggttaggattcattattagacaactagcgtgacctttggaacttgtcaagacacggtcttttggtactgccagcattcttgttccaatttcttctcttctgagggaactgccacttcttgtttttgaatttgctattatttagatggtaattttgtttttttttcttaattcttttttccctcgagtgtatgactggtgtatgttgtgtataatagtttggctttattctgagcgctttcagggggccaacggtctgtgtgtgtttcttggttatgtatagcttctgcaggatggttttcttagatgtcacttcttatcgtgatagatcagacatatgggccaacacattatctcttgcagggctgagagtgcagaggtcccaggaagcctcgtgcactagcactaagcccttctgacagcaagcttttaatttggtggtgcagtttaggctctagtccgctaggtggcacttaaaagtaaaagctaactcaccctcaggtaggctgatgatgactggaagcttctgtcctgatagtgtggtggtggggggagatcatgtgggggtgtacagaagtcttaggggaagggatgtgcaccagcttctcatcaatagaaggaaggaatgctatctgctttcctatcacaccccggtcacagggctcatgaccttcaacttgtataaactttgtcctttgattcttggcctcagtgtggctgtggactgaaggacatgcttctgtggcagctgccaccaaaatgggctcagggcagagcctctctcaccagtcctgagcaggcagctctgcagcttgtctggcctctgttgctgggaagctgtagttctgtgtagtgaggggcagttgggccccaccttcttgcaagtgcaagcagcagaggctcccttccaacaagaatgaagctgctattaaaagtatgagaagtgctttctcctggtgcatacatgctggcccctagtggggagaacctgtgctgcacccacaacagtagacagggaattggaagatgaccttctctctatgacggttcctggcagctggtgatgccccttcagtaattgacaccatgcccatacttcctttgtcccaaggtgggctatgatggaccctgtcccccttctctcaggggctgctcactccacaggatagattgtcaggggtcacacagcttcctggggactggccagccagagaaggttgtggggtgtgtttgtgggaaatctggtggtgtggtgaatcaagagcagagatttcccaggaagggaagtggcctaccatgggtgcacaaccaatatggtgcccttcatctcgtttaaggcctgaaggaagagcaagcacacctgtgccagctggccatccagttttctgtccctgggaagttctcaagtcacccaaaacagaattgtccttggtcacaagggcagaggggcttcccaacagtttggcattcagcaggttgctgaaggggtgatgagattagacaagcactcccacccgttctttccgtggggctccaagttcctcaagggtcattccctgccaaactcttgctgctctatttttctgtattccagcttctgcccatgtgcgctccaacaggtcctggctctcttccatcagtttttcatacagatcatgtccattttccagcacctgtagtcttcttactggggaaaactggcattcaatgttcccagtcagccatcttgaaaatccaccctcccctgttattacactgatttattcacatctgaataaacagttacatcttattttttaatttacttttgttgtggtaggacctgttttttgttgttgttgtggttgttgttgttgttttcttttgaggatgcgactatgatgtatgctgaacaagtctgtttggctttgtttctgtgtgcattcagtggcaaagacactatgttttccatggttataaatagttttagtgtggagttttctcaaatgccagttgtaatagtggtgtaccaggatggtgagcaggctcatgccctcttgggtagcttggattgcatgagcaatcatggtagcagaggttgcgagaagctcgtcttgttcctaagtgctgtgcgcaggtgtcagctgatgtggtgatgggatgtgcaagttgaccttcagaccagcaggtgtcacttgcaggtaaaagccaacttcagtggaggtggtatgctttatgcttgacctttgtaagccctgagaagtgcacccatgtcccagttggtcagttgggccctggagcaaacaagagcctgggtttcacccgctgtcatggaggggattggcaaagctgagtgatgccagaatgagaaagcctgcactaagtctttccaatgacaggcacaagcaacagctttgacaggggtggcaagggagtcttcggcctcctggtaaaatgcttgagcaatgagcaatcactgaggtgtctgtatggggaggtaggagaggtgccagtgccatagtcatggcaggaaggaaagggatcagccttcccctcacgcccgtcttagaatttggggtactcatataggttaggaactacagtttgcttttaagcaccaatgtagcccgcgaacacaggagaaatcagcccagccgctccacactaaacccctgtggtggctggaagtggatgtagtgtgaagtctccctccatggctccaaacacagctcttgggctctcctgctctctgtagcagcagtactgcatctctgcacagagagagggcgggaacccactgtttacacaagcctggccattggggtcacagttgcccctcacagccccagatggaatgccatacagtacatctgccccagcctcctgggacagcagcagtgcttgtggtttcaacagtgtgcatggggaagaagggtctcctctaggcctggttatgacactaaggctgctcatctgatgaaaggggatttcactgtttgcttggagagccaagcacaaattttgtgccactgctaaaaatgaagtcacttttcacagccccagtcaggaagcttttgggccctggaaagcatgcactttggtttcctttctctcaggggttgcctttttggtgtactgcactcttatttctcctaggagtagcattccctgaaggttaggttactggggaccctgcagctcctttgggtccagccagcactctgccactgcagccctttgagcaggactggagaatgtgagcaggagctcctgggttttggatacacaaggactgtggttcccagaagaggatacagttcccttacggatgcaccttcaacagtagcacagcatagcacctgcttgggtctggggaaatggtaaataataacccagtgtgaatccacagtccagtgcactgccctcaggggtctccacattgcggtccatgctattttcaggatttgggaggacagaggagctttcccactgtaaggatcttggcagttcacagcaagaatgaggactatcaaaatacttcaacttaccctttccctgaacactgagttcctctggactcctaaccaatgtcagctgcattggcctctagctttcttttcttttcttttctttccttttctttctttttttttttcttctgtggcttagggttttgtttttcataaattatattttgaattctagtattctctctttgatattctattagaggtatgattatctattcataatttaggttcttctttctagggagaacttgcatctgtcatctctagtcagccatcttaaacttccttgtttccatcttaatgtttttatctacccaacagtcatttaggagcatcttgtttaattttcacgtatttgtatagtctccagggtttctctgggtattgatttctagttttgtttcatggttaccttaaaatacacttgctatgatttaaaacattgttcatactcttttggtggcctcacatgtggtctatcataaagaatgttctgtgtgctgataaaaagaatgtatgggccgggcacggtcgctcatgcctgtaatcccagcgctttgggaggccgagccaggtggatcacccgaggtcaggagtctgagaccagcctcgccaacatggtgaaactccgtctctactaaaaatacaagaattagccgggcgtggtggtgggtgcttgtaatctcagctacgtgggaggctgaggcaagagaatcgcttggacctgaaggcagagattgcagtgagccaagatcacgccattgtactccagcctgggggacaagagcgaaaacttggtaaaaaaaagaaaaaaaaaaaaagaaaaaagaaaaaggaaaaaaaaaaaaaacagaatgtatgctctgcagttgttggatagaatgttgtgtaaatgtctttcaggtctacttggtctaacattccctttaaatctaatgtttcttttttgattttctgtctagatgatccgtctaatgccgagaatggggtgtcaaagtcccctgctgttattataatttagtcatctctctccttgggtctagtaataattgctttataaatctgggtgctacagtgttgggtacatgtatatttagaatttttgtatactcttgctggattgatttctttattattatataatgaccatctgtttcttattgttcttgacttaaagtgtgttttatctgatatgagtatagccactactgcttacttttggttttcttttatgtggaatcttttttccatttctttactttcatcctagatgtgtctttactggtaaggtaagtttctcgtaaccaacatgtagttagattatgtttgtttttatccatttatccaagctatatcttttaagaaaataatttaagccatttgcgttcaaggttattattgatatgttagtctttatttctgttatattattcattgctttctggttgtcttatctattatttgtttcttttttctcttatagtttgtcattgtgaattggtgaagtttggcagtggtatgatttgggccttttctcttttgtgtgatagttttaccaatgagttttgtactttcctgtgtttttataatggtaaatgttgtgctttcacctccaggcttaggactcccttgagcacttttttctagggctggtctaatggtacttaattccctcagcatttctttgtgtgggagtgactttatccttcatctgtgaaggataattttcttgggtgtcatattctttagtgggagattattttttatttcagcactttggatatattatcctattctgtcttggtctatgaggtttctgcttagaaattttctgcttatttttcttctctttatttttttgaaattttctttatagaggactagatgcttttcccttgctttttcatgtttcctgtgtccttccattgatgtctgtacatctctatattttcttcaatgagtcattctcttgctttataggagactagaatttcctctttaactatgacttgagacagtctgattataatgggctgtgtatagttttgcattgtatccacctaaggatcattaagactcctgtatctgaatctctaatctcttgctagacttgaaaagttttcatctattgttttgttagtagattttctaatcctttctttgatttttaccttcagggataccaatactttataaactcggtcactgtatgttttcctaaatgtcaccaagggtttgaccattcattttaattctttttaaaatgtttgcctgactggaatattttataatacctgtcttcaagttgtgtgattcttctttctacttgatctagtctattcttgaagcttttttatttatttatttattcattcattcattcattcattcatttttcgagacagagtttcgctcctgttgcccaggctggagtgcaatggtgcgatcccggctcactgcaacctccgcctcccgggttcaagcgattctcctgcctcagcctcccgagtagctgggattagaggcatgtgccaccacgcctggctaattttgtatttttagtagggatggggtttctccatgttgttcaggctggtctcgaactcccgacctcaggtgatctgccagcctcggcctcccaaagtgctgggattacaggcgtgagccaccgcgcccggcctcttgaagcttttaaatgtattttgtcttttcttcaatgagttattcagtttcagaatttttattagggtcttaaaaaatacctttctctttataagtttctcattcatatactaaattggtttttttgatttcttcatattattttcagaattctcttgactctcaccgaacttcttcaaaattaatattttgacttcttgactttggggttcaaaaaattcttttttaatcaaaatccttccctggagcattattgtgtttattaaatatgccatgttttcttgctttttcatgttttctgtggccttccattgacatctgtacatctggtgtaacagtcactcctttctatttttttaatttacttttgatgaggaggaatttttgaagatgcatctatggtttttggctggattggctactttggctttgctcctgggggcatacagtagtgtagtctctttatgatcaatttggccgtaaacagcattagtggtatctgtgatttcctcagtgggttagggcacgtttgtttatggaggctgtgatggtattgtgctggggacttgaatgccagttgggccagtcttccggccccagtgtagacagtggtgggcttagcatgcctatcttgtgccccagggtggtgcacactggcacctgtgctggcagttactaatgggttgatttttggagctccagatggcttgctaggattcctgtcgtggcagtggtggacgagattgttgggtgagttctccgtcctatgggcaactggtgttgcatggggaatgggagtagcaatggcaggaagattctctgggtctcacgtggtgtgcattgatgttggcactggctgcaatgttctgggtgggcaagtctccaggcccgcgggtggttcttacagatagtttccaggtgaggtggtagcagcgtgaagtttacgcccaatctcaggacccttggaggaatgctcacgtgcccaaggtggtggtttggcttgtgcaatactcaggtctctagattatgtgatctgtcttggaatggggagcaaactcggctggacagtcttgtgctcaggccccctattttgagagtactcaccagccacggtgggcagggggtaagggtatttctcatgccccagggagagtcattgggtgagggtggtggcctctgtgttggggataatgcccagagatgatgggctaccctcggtagtcacagcctgggccatggtgtggagaatgcatgttctccccttcacagctcagtcccagtgagactcaacttcttgcccagactgcaggagcccacactcagctcatgatcaagtcccagtggcaactcatgccctcttcatgacttcattttaggtcctggcagtgcaatactcattttatggcactggctgctaccatccaggcctcatgcacttcttagccccagctaaaggggtagtgctagctccctgcccagtcccagctgtggcagcctgagtttccggaacgtctagtcctggtgcctctgggtctcagaaaagcatgcagtttgctggaggctagttttgaaaatggcacctttctatcaacttagatctcagaaagggtgtcagcatgaactccctccctggagcagttctgtccccacagtctcctggcaactttctctgttagtttccaggttcgagaaggttaagcatttttcaagtggccaggattgcacacttctatggtggggtcatgggacactggcagtctcttactcatccctcccctgcactggggagtcagtactggctcttggccaatcctggccagggaggctgcctctcctccttctcctttcctgtttttagtgccccctgtcacttctatgttgaattccagcattttctctaggaagtgttactgtctatgcactactctggttcatccaagtgaaagaggtaggcataaaatatttctagtcagtcatcttgaaacccccttttgtttcaaaaaatttagatcaattttcttggctaatgccatataaacaataatcttatctatgagctagcctaagactctttatactttgtcttgagtttctcatttttactctcataataaaatgttttctgcgttgtttagagaaacgtatgcactattcactaaatttctcccctgttgtcatttcaaatgttccataatattatgtcaaagcaacatagggctacttgtattaagcatatatatatatatatatatatatatgtgtgtgtgtgtgtgtatatatatatatgcatatatatgtgtgtatatatatgcatatatatgtatatatatgtatatacatatatatgtatatatatgtatatacatatatatgtatatatatgtatatatatgtatatacatatatatgtatatatatgtatatatatatgtatatacatatatatgtatatatatgtatatatatgtatatatatacacatatacatatatatatacatatatatataaaatatatatattttttaattttctcttttctgatgtattgagatctggggccctgctgaccctggagggactgctcatcccagggttagccatttcctagagcaagaaaataactaatctgacagtgtgcttttcaaatacaagtcaatcaatacagaggatacacggttaaccacttccttttttggtcttttatctctgggccactatccctctgccttaatcactgccaatgcaaggtattcttgaaattattaaaaccagacacttgtaaaccagcttaaataggctcaccaatttcttcccataagaacaacaacagaggttcttgaccacaattctctcctcttcctctaccttctggcagaccctagtgcttttttatttggcctcccgtggcacggtgtgccccttccttgtgggaactgtagctagtaaactatcttattaatggcaatcatctccttgtatgttcgacttactcactatacctgaaattttctattaatacattacattttaaaacataacatagtacatctgttttgttatgtatatatgtatatttcagaaatacactcacacatatatatgtgcatatattcttaccattaatatataatcttaaaagcaagatatgcacactctcaggataagaattttgaaaatgagtatgctaacattaatgtagtcctgttatctaatttaggtgttagtaaactaaaacccgtgggacaactgcctgtttttgtaaataaaattgtgttggagcaatgccaagcctactggcttacctcttgtctacagctgtttttgttttacaaggacagagttcagtggtttcaacagtgatcccatgacccagaaagtctaaaatatttactctctggcaatttaagaagaagtactcctaccctgataatctaaaatcctcatttgaatttcaccatctatcccactaatgtcatttaaagccaaataaatatattcctttttctggtccaggatctgatacattatcaggtaccacatttagttgtaatgtctctttagtctctcttgatgtggattggttgtttaacatttgttttttattactttaatacttaaaatataaaggccagtattttgtagactgtccttcaatttgtgctttttgctggtttttttcctattaattcactcgatattgtacagtttaggaaggattagcacaccattgttactatgttattctcagtacgtcataacaggaagcaaagaataactatttgcaccattaaatcttgatattaaatttgatcgcttggctaaggtgatatctgctagatttgtccactgccaagttactgtgttttcctttgtaattaataaatacttttagggagatataatgtgagaatatgtaaatatctctagtctcaccatactttcacccaataattctagtatttattgatgattttcatcagaaataaatagctttatggtggtggccaacttgtgattttttttcatatcaacattttcttctacatttacttgcaattatattgtaaaaatgacctttgatgtttccagtacttatttattcatttatctatctaagtatgaatacacggatatgtccctgatttggtaagggaaatcctgttcaaactgtcttccgtgttctttgtgtgtacttatcagtctttgaaacttccttaattaatggcacaaaaatatatgtctggttcatcttgtattttctctgtactaaacatagagttagccatttctccaaggagctctggttccattgagtagataacagtaaatggaagccaagatctttgtgctagatgtgcttattgctgttgaggtgtccatgcttctacttactcctctcagggggcaagaatgcaaacatagaagattatatataataatgtatagatagagaaatatagatacagaaataaaaattagataatttttacacacatacacacaaaaacacatagaagcgtgtgcataatatctatagatgatagattgatagatagatagatagatagatagatagatagatagatagatagatagatatagatagatagatgatagatagagatagagatagaacataagctacatgtttgtttgttcatactaacatctataattctagtccaacaccaccgggctcattttcgcatttcctttaccacatttgtaattcacttctctaagaatagaaaatttggtttcaattatcaacaaaatacaatttcaatacacattaaataattttgaaatttctaacccataaatctatacagaacaaatctattacacggagctcaatatttgtaccatatattcttattgtggtaagtccacttaacataagaagttccatttaacaaatttttaattgtacaatacaatactggtaactactgttactgggttgtacagcaaatctctaggagttatttatcctgcataacaaaaattttaaacctggtaaacaacaacctcccatttttaatgccactagccccttgaaatcaccattctattctctgcttctttaatttttaatatttcagatatacaaggacagtcatgcagtgtttatctttctctaactggcttatttcccttagcataatatcctttatgattatctatgttgttgtttacggcatgatactctcctttgtgaagtctgaataacattctattttgtatataccacatttgtttcactattcatcagtcaatggctacttggattgtttctatatgttggctaccgtgaatgatgttgtaatgaacatgggagtacaaatttctcttcaggattttgatttctattttgcggggtatatgcacagcagtggaattgctgggtcatatagtagtcctatttttaatcttttgcagaacctccatactattttccatagcagctgcaccattttacattcccaccaacagagtacaaggggtcccattatttaacattttcttcgtaacttgttatctcccgtctttttcatagtagccatcctaactagtgtgaagtgacatctcaccatggtttgatttgcatttctcaggttagtgatgtggaacaccttttcatatacttgttggctgcttgtatgtattcattggagaagtgtctattcaagtcctttgatgattttttaaattgtgttgtttgatttgtgctattgagttgcaggaatttgttatatatttttatactaacgcagtaacagatatagcatttataaacatttctccctttcaataggctgtattttattttgttgattgttttctctgctgtgtagaggctctccagtttgatgtaataccacttgtatctttttgcttttgttgcctttgattttagtgacatatcaaaaaaatcattgcccaggttaatgtcagcgagtttttatctatactcttgtttaagagttgaacagtttcaggtcttatacttaaatctttaatctattttaagttgatttatgtatatggtataaaattaaagaacctactcaccaacgagatataataattataaacacatacataccaaacatcagagaacataaatatataaagcatacagtgaataactgagaggtaaaaatatacagcaatttaataatcataggagattttaatactgcacttttaacaatgcataggacatgcatacagaaaattgatgaggaaataacaaacttgaacaacattataaacagatgaacttagatatacgcagaacactgcaaccaacagtcccagaatacacactcttttcttcttcttcttctttttttttgtttttgtcttcaacttttattttaagttcacgtgtgcaggatgtgcaggtttgttacgtaggtaaacgtgtgccgtggtggtttgctgcaccgatcacctcataacctaggtattaagcccagtgtccattagctattcttcctgatgctctccctgaccccaccgtcctgacaggccacagtgtgtgttgttccctccatgtgtaaatgtgttctcatcattcagctcccccttgtaagtgagaacatgcgttgtttggttttctgtttctgcattagtttgctgagcctaattgcttccagctccacccatgtccttgcaaaggacatgatcttgttcctttttatggctgcatagtatcccatggtgtatatgtaccacattttctttctccagtctaccacggatgggcatttaggtagattccatatctttgctattttgaatagagctgtaatgaactcacacattgcatgtatctttataataaaattatttatattcctttgggtatatactcagtaatgggattgctgggtcaaatggtatttctccctggaggtcttttgaggaatcgccatgctgtcttccacgatggttgaactactttacgctcctaccaacagtgtaaaagcgttcctttttctctgcaaccttgacagcatctgttgtttcttgactttttaataatagccattctgactggtgtgacgtgctatctcattgtggtttttatttgcatttctctgatgatcagtgatgttcagcattttttcatatgtttgttggctgcatgtatgtcttcttttgagaagtgtctgttcatgtcctttgcccacgttttaatggttatatcttttcttgtaaatttgcttacgttccttgcagactctggatgttagaccgttgctagatggatagattgaaaaagcatttctcccatcctgtaggttgtctgttcactctgatgatagtttcttttgctgtgcagaagctctttagtttatttagatcccatttgtcagtttttgcttttgttgcaattgctttgggtgttttcatcattaaatctttgcccatgcctatgtcctggatggtattatctagattttcttctagggtttttatagttctgggttttacgtttaagtctttaatccgtcttgagttaatttttgcatatggtgtggggaaggggtccagtttcagttttctgcctatggctagccagttctttcagcatcatttattaaataaggaattctttccccattgctaatttttgtcaggtttgtcgaagatcagttggttgtaggtgtgtggtcttatttctgcattctctattctgttccattggtctgtgtgtctgtccttgtaccagtaccatgtggttttgtttactgcagtcttgtagtatagtttaaagtcaggtagcagctttggtctttttgcttaggattgtcttggctattcgggctcttttttggttccctatgaattttaaagtcgtttttttttttttttctctatttctgtgaagtctgtcaatggtagtttaatggaaatagcattgaatctagaaattactttgggcagtatggccgtttttatgatattgattcttcctggccatgagcatggaatgcttttctattttttttgtgttctctctgattcctttgagaagtggtttgtggttctccttaaagaggtccttcatttcccttgttagctgtgtttctaggtatttccgtctttgtgtagaaattgtgaatgggagttcaatcatgatttggctccctgcttgcctattgttggtgtataggaatgctagccatttttgcatatccattttgcagaatagacatccttttcaagcacacctggaacattctccaggacaagttacatgttacaccacaaaccaagtcttaacaaatttaagaagattgaaataatagcaaacctctttttcaatcagaataagatggatctagaaattaataacaacaggacaattggaaaatacacaaatatgtggaaacaaaacaacacacacatgaataagcaatggatcaaaaaagggaaatcatgaaatatcttgagacaaatgaaactgaaaacacgatatagcaacacataagggataccgtgaaggcagtttcttttccgaatttcaacttttgtttaagatacagggagatacaggggttacatgtgtaggattgttacatggcaattttggacccaggtagtgagcctaacgttcaataagtagtttttcaaccaacattccattccctaccacctacctctaggagtccacagtgtctatatttctcgtgttcatgttcatgttcccatgctcagtgttaagctcccacttatccatgaaaacatgtggaattttgttgtttcttcttgtgttaactcccttatgattatggcctccccctgcatccatgttgctgctaaaaagaaaaagaaaaaagattttattacatttttatggctgcatagtattccatggtatatatatgtaccacattttccttatccaatctaccgttgattgtcatctgggttgattccatgtctttgctactgtgaatagcacagcaatgaacataagagtgcatatgcctttctggtagaatgatttattttcctttgggtacatagccagtaattgaactgctgcatcaaagggtaactccgtattgagatgtttgagaaatctccagagtgttttccacagtggctctactaacttacatttccaccaggaatgcataagtgttcccttttctctgcagcctcaccagcatctattgttttttgactttttaatacccattcagactcgtgtgagatgttgtctcaatttggttttcatttgcatttctctgatgattagtgatgctgagcattttccatgagtttttgttgcttatatgtcttcttctgagaagtgtctgttcaatgtcattgccaatttttttttattatactttaagttctagggtacacgtgcacaacgtggaggtttgttacatatgtatacatatgccatgttggtgtgctgcacccattaactcgttatttacattaggtatatctcctaatgctatccctctcccctccccccaccccacaacaggccccggtgtgtgatgttccccttcctgtgtccaagtgttctcattgttcaattcccacctatgagtgagaacatgtggtgtttagttttctgtccttgtgatagtttgctgagaatgatggtttccagcttcatccatgtccctacaaaggacatgaactcatccttttttatggctgcatagaattccatggtgtatatgtgccacattttcttaatccagtctatcattgatggacatttgggttggttccaagtctttgctattgtgaatagtgtcgctgtcattgccaatttttaatggagttatttgtttcttcttaatgatttttttaaagttctctatagattctagatattaggccatcgtagaatgcatagtttgtggatgttttctcccattctgtatgttgtctgtttactgtgttgatagtttcttttgctgtgtataagctctttattttaattaggtctcatatatctgtttctgttattgttgcaactgcttttggggacttggccaaaaattctttgccaaagccaatgtcaagaagagtattgcctgggttgtctcctaggacttctgtagtttgaggtcctacatttaaatctttaactcatcttgagttaacttttgtatatggtgaaaagcaagggtccagctttacctgcctgtggctagtcagttatctcagcaccatttcctgaataaagagtcgttttcccattgcttgtttttatcatccttcttgaagatcacacggcagtaggtgtttcattttatttctaaattttctgttcttttctttccattagtctatgtgtctgattttgtaccagaaccatgctgtttacattactgtaactttgtagtatcatttgaggtcaggtagtgtgatgcatccggctttgttcttttgcttaagatgtctttggctatttaaggtcttttttggttctgtctgaatgttagaaaaagtttttctaattctgtggagaatgacattggtcatttgatagaaatagcattgaatttgtaaattactctgtgtcatgttgacattttaatgatattgattcttccagtccatgagcatatatttttgttttgttttgtttctgtcatctctgattttttaaaatagtgttttgtagttattcttatggtaatctttcaccttcttggttaactgtattcctaggtactctgttttctctgagcctactataagggaacttccgtttttgatttcactctcagcctacgtgttgttggtaaaaatgctactgatatttttgtacattggttttgtatcctgaatctttacagaagtagctgatcagttctaggaaccttttggcatagcctttaggattttctacgtatggaatcatattgtcagggaagagagatggttggactttttcttttcctatttggatgccttttatttctttctcttttctgattgctctggctagggcttccagtactgaataggagtagtgtgagtagatatctttgtcttgttccacttctcaaggagaattgttccagccttttctcactcatataatgttggctatgggtttgtcagagacagcttttattattttgaggtatattcccttgatgcctagtctgttgaggtttttttttttttatcatgaacagatattgaattttattgaaagcttttactgcatctatttcaatgatcacattgtctttgctttaaattctgtttatgtgctaaagcacatttataatttgcataagttgaatcatcctttcatcccaggaataatgcttacttgattatggtgtactaactttttgaggtgttgctctgctgctggatttggtttggtattattttgttgagcatttttacatctatgttcacaatgaatattggtctgagatttcttttgtgtgtgtgcgtgtctctgtcagattatgatacaggtctgatgctcatttcatagaataagttaaaaaggagcccttctttctcaaatttttgagatagtttcagcagggttagtaccagttcttcttcgcatgtctggtatccctctttttctttgttaacctaagaaagggtctatcaatcgtatctatttttctgaagatccaattcttggtttcactgatagtttgtatagatttttgcaattcaaatttattaagttattcttttttattttttttattatactttaagttttagggtacatgtgcacaacgtgcaggttagttacatacgtatacatgtgccatgttggtgtgctgcacccattaactcgtcatttaacattaggcatatctcctaatgctgtccctccaccctcccccctccccacaacaggctctggtgtgtgatgttccccttcgggtgtccatgtgttctcactgttcaattcccacctatgagtgagaacatgtggcagtttgtccttgcaatagtttgctgagaatgatggtttccagcttcatccatgtccctacaaaggaaaggaactcatcattttttatggctgcatagtgttccacggtgtggtgtatatgtgccacattttcttaatccagtctatcattgttggacatttgggttggttccaagtctttgctgttgtgaatagggccgcaataaacatacgtgtgcatgtgtctttatggcagcatgatttataatcctttgggtatatacccagtaatggcattgctgggtcaaatggtatttctagttctagatccctgaggaatcgccacactgtcttccaccatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcttgtaaatttgtttgagttcattgtagattctggatatcagccctttgtcagatgagtagattgcaaaacttttctcccattctgtgggttgcctgttcactctgatggtggtttcttttgctgtgcagaagctctttagtttcattagatcccatttgtcaattttggctttcgttgccattgcttttgctgttttagacatgaagtccttgcccatgcctatgtcctgaatggtgttgcctaggtttacttctagggtttttatggtttcaggtctaacatttatgtctttaatccatcttgaattaatttttgcataatgtgtaaggaagggatccagtttcagctttctacatatggctagccagttttcccagcaccatttattaaatagggactcctttccccattgcttgtttttgtcaggtttgtcaaagatcagatggttgcagatatgtggcattatttatgagggctctgttctgttccattcgtctatatctctgttttggtaccagtaccatgctgttttggttactgtagccttgcagtagagtttgaagtcaggtagcgtgatgcctccagctttgttcttttggcttaggattgacttggcgatgcgggctcttttttggttccatatgaactttaaagtagtttttttttttccaattctgtgaagaaagtcattggtagcttgatggggaaggcattgaatctataaattaccttgggcagtatggccattttcacgatattgatttttcctacccgtgagcatggaatgttcttccatttgtttgtatcctcttttatttcactgagcagtggtttgtagttctccttgaaggggtccttcacatcccttgtaagttggattcctaggtattttattctctttgaagcgattgtgaatgggagttcactcatgttttggctctctgtttgtctgttatttgtgtataagaatgcttgtgatttttgcacattgattttgtatcctgagagtttgctgaagttgcctatcagcttaaggagattttgggctgagatgatggggttttctagatatacaatcatgtcatctgcaaacagggacaatttgacttcttcttttcctaattgaataccctttatttccttctcctgcctgattgccctggccagaaattccaacacagtgttgaataggagtggtgagagagggcatcccggtcttgttccagttttcaaagggaatgcttccagtttttgaccattcagtatgatattggctgtgcgtttgtcatagatagctcttattattttgagataagtcccatcaatacctaatttattgagagtttttagcatgaaggttgttgaattttgtcaaaggccttttctgcatctattgagataatcatgtggtttttgtcgttggctctgttattctctaattttagttttttcttttaattttctgctggattttgggttggtttgttctttcctttctagttcctttatgtgaaaagttagattgataacttgaaacatttctaacattttgatgaagacgtttagatctatacattttgctcttaacaaacactgatttggctgcatcccagagatttcaataagttgtgttcctgtttttattaatttaatttttgttaaatttctgccataattttgatgctgttcaagagtaagttgttttattttcaggtgtgcatgtagttttgagaggtcttcttgactttgatttctatttttattgcactgtggtctgaaagtatgcttggtatgatttcaaaatttttgaatttattgaggctttctttatgactgaacatgtggtcaatcttagaaagtattttatgtgcagatgggaagaatgtatttttttttttattgttggatgaatgttctgcagatgtctattaggtcaattagtcaggtgactggttcaagtccagagtttaccatttcctaccttgatgatatgcctactgctgtcagtgggatgttgaagtccttcactactattgtgtggttgtataagtctttttgtaggccaagaagaacttgttatatgaaactgcgtgctctaatgttgggtatgtatatatttaggatgatagttgaagcttcttgttggattgtagtctttatcattatgtaatgtccttctttactcttcttatcttttattggtttaaagtctgttttagctgatataagaacagcgactcctgctcttttaattttgcatttgcatggcagatattactctccctttttacattgagcctttacgtgtttctacatgtgagataggtctcacgaggacaacaaatgattgagttttgttttttttttttaatccagccttccatgctgtgtcttttaagtgggatatctggcccttttacattcaaggttactgttgatatatgtgattttgatcatctcgtcattttcttagctggccgttatgtagacttgatgacgtagttgctttacagtgtctgtgtgctatgtgctgaagtgtgcttttgtggtaacaggtattgttctttcgaatccacgttttgcactcccttaagggcctcttgtaatgctgatctggttgaaatgtattcccccaacatttgcttgaatgaaaaggattttatttctccttcacttaggaagtgtagtttgacaaaatataaaatcattggttgatttttttttccttggagatgttcaaaatatgcgcccaatctcttctgtattgcaaggtttctactgagaggtctactgctagcctgatggggttccctctgtaggtgaccagccccttctctctagctgcctttaatttttttctttggcattgaccttggtgaacctgattaccatgtgccttggggatggttgtcttgtatagtatctgcctggagttctctgtatttcttggatttgcatgtaaacctctctagtgagaggaagataattttcatagactataacttcaaatatattttccaagatgtttattctctctcctatctcagggatgctgattaatcatcgattgagtctcttcacataattccatatttctcagaggttttgttcatttttgttagtttttttctctttaattatttatttgtttttgactaagttgatttgaagaactggttttcaagctctgagatttctttctcagcttggtttattctggtattaatacttctgattgtgttataaaattcttgcagtgaatcctttcaactcaagaagtctagcctgggattggcttaaaatggctattttgtctttcagctcttgaatcatttcactggattacttggttttcttagattgggtttcagctttatactgaatcttgaagagcggccttgccatccagataattccatgtctgtcatttcatttatttcagactggttaagagccattactggtctcattttaattttattattattatactttaagttttagggtacatgtgcacaatgtgcaggtttgttacatatgtatacatgtgccatgttggtgtgctgcacccatcaactcgtcatttagcattaggtatatctcctaatgctatccctccaccctgcccccaccccacaacagtccccggagtgtgatgttccccttcctgtgtccatgtgttctcattgttcaattccctcctatgagtgagaacatgcagtgtttggttttttgtccttgcgatagtttgctgagaatgatggtttccagtttcatccatgtccctacaaaggacatgaactcttcattttttatggctgcatagtattccatggtgtatatgtgccacatattcttaatccagtctatcattgttggacatttgggttggttccaagtctttgctattgtgaatagtgccgcaataaacatacatgtgcatgtgtctttatggcagcatgatttataatcctttggttatatacccagtaatggcattgctgggtcaaatggtatttctagttctagatccctgaggaatcgccacactgacttccacaatggttgaactagtttacagtcccaccaacagtgtaaaagtgttcctatttctccacatcctctccaccacctgttgtttcctgactttttaatgatcgccattctaactggtgtgagatggtatctcattgtggttttgatttgcatttctctgatggccagtgatgatgagcattttttcatgtgttttttggctgcataaatgtcttcttcggagaagtgtctgttcatatcctttgcccactttttgatggggttgtttgtttttttcttgtaaatttgtttgagttcattgtagattctggatattagacctttgtcagatgagtgggttgcgaacattttctcccgttctgtaggttgcctgttcactctgatggtagtttcttttgctgtgcagaagctctttagtttaattagatcccatttgtcaattttggctttcgttgcctttgcttttgctgttttagacatgaagtccttgcccatgcctatgtcctgaatggtgttgcctaggtttacttctagggtttttatggtttcaggtctaacatttatgtctttaattcatcttgaattaatttttgtgtaacgtgtaaggaagggatccagtttcagcttcctacatatggctagccagttttcctagcaccatttactaaatagggactcctttccccattgcttgtttttgtcaggtttgtcaaaggtcagatggttgtagatatgcggctttatttctgagggctctgttctgttccatatgttctgtatctctgttttggtaccagtaccatgctgttttggttactgcagccttgtagtatagtttgaagtcaggtagcgtgatgcctccagctttgttcttttggcttaggattgacttggcgacgcgggctcttgtttggttccacatgagctttaaagtagttttttccaattttgtgaagaaagtcattggtagcttgatggggacggtattgaatctattaaattaccttgggcagtatggccattttcacgatattgattcttcctacccatgagcatggaatgttcttccatttgtttctatcctcttttatttcattgagcagtggtttgtagttctccttgaagaggtccttcacatcccttgtaagttggattcctaggtattttattctctttgtagcaattgtgaatgggagttcactcatgatttggctctctgtttgtctgttattcgtgtataagaatgctcgacactctggctttttgcattctcagagttcttgcatttattcttcctcatcttgggaggctcatatttttaactgtgatgtaaattgagtatggctagttggctttgtttctggaagttttcagaggaccaagtctctgcacggggtgttcgttgttgaattcttgccccttcggtttcacagcgagtagttttttgctcttgtagttttgtctgtgttccagtagatggcgcttgagagcaatgggcggtaggtaggctgttagttgcgtggtttctttgtgcatccttgtgcttgcagttctgttgtgaggtgcgaggggaagatagttaaccctctcgccagacctgctcctgggcctttcaggagccacctacaatcactggcactgtgcccacaattttgttgttattgatgttgttgtcgggtcttttgggccatggggggggggctcctttaaggggaagtcccctttcccaggcactgtccggggctgggaaccagacttggtgttcaggtactccgtgccgtgttcccagtttcctccctttacagcctcagcatctgcttctcttctccgtccacatttggcattttctgtccaaagatctgttcaatttatgttggtgtagttgaaatcatattttctttccgtgggagcaggacttctcagctgcatctagtcaggctgcttgctcagaatttttttgaattttttgagacttgctttgtggagtaatatttggtctatcctggagaatattccatgtgctgatgagaagtatgtgtattctgcagctgttgcatgaaatgttctataaatgtatattaggttcacctgatctagagtgacgattaagttgaacctttctttgttgagtttctgtctggttgatctgtgcaatgattaaaatgaggtgtttaggtcacctgctaccattgtctctctcttttttaatagtattttctttatatatcggggttccatacaacggttatattctcttcctgatttgaccactttatcatcatgtaatgatcttctttgtctctttgtgtagtttttgtcttgaaatctattttacctgatataagtgcactactcctagtgttatttgattctgatttccatggaataaccatttctattcctttatttttaatctatgcatatcttcacaggtatagccactttcttgtgggccgcatatagctgaatcttgttttttatccattcagctgttcttaacttttactgaataatttagtgtaaatttaacctgattattcattggtaaagagtagtactgccacttttttactttttttttttttttccgttgtcggtggtgctctcttttttcttgtcttcctttgtgtaaaaaaggattttatctagtagcttgttttgatttcttgattttcaatatttaaatctatgttataggggtttgtttgtggttgccatgaagctgatgaataacatcttataacccatttttaaactgatgacaactctgattgccaaaaagagcaaaacaaataagcaaagagaaaactatgaaaacattctacactttaacttcatttcctctgatttatgactttgtctgtctctgtatctttttatattgtctatctattgaaagatgtttgtcactatcagttttggcagtttatttgtcttcctgctaaagatatgagtggctaagacactgcaattgcagtgttatagtattgtgtacttttctgtgtacttgctattactgacaggttttatatcttcagataatttctttgtcattttgtaactgccttttctttctgattgaagcactctctttaccatttcttgtaggacaggtctgatgtagacatgatctctcagcttttgtttgtctgggaaagtgtttatttcttcttcatagttgaaggataattttgctgaatacgatattccatgttgggatttgtttttcttcagcattttggatatgctatctcactctcccctggtctataagaattctgctgagaagtctgctgccatacatattggagctcctttatgtgctatttgtttatttttctcttggtgcttctagtatcctctctttatctttgacttttgagaatttattaaatgcctggagatgtttcatttggctttaatccacttggtgttctaggaccttctcgtacctcggtattcctatgattctttaggtttggataattgtctgttactatatctttgaataaactttatcccctttctccctacgtcttgttcaaggctaagaactcttagatttgcccctttgcaggtattttctatatctcatagtcatgctttaatttttaaattattttttctcttctgtgtattttcatatagcctgtctctaagcttactattttttttctgctttatcaattctgctgttgctagggtctaatgcatttttttcagtatgttaattgtacttttcagctccagcatttctgctagatttttcatagtttctcagtctctttttacaattcatctaataaaattgtgactctattgtctgtattatcttaaagtttgttgagcttcatcaaggcaggtattttgaactctctgtctgaatggtcacatatatctgacacttcatagttggtcactggtgccttacttagttcatttggtgaggtcatgtttttctgtatgttcttgatgcttgtggatatttttcagtgtctgctcattgaagagttaggtatgtactctaatcttagtattctgcacttatttttacccatacttctcgagaaggctgtttacatattcaaagggtatttagagtggtaatttaactttgtggtcactgcagccatatcaggattgtaaggcacactaagttctaaattcagtaacagcgcagctcttgctgactccttgaagcaccatgttggtggtgttggttaagttaagggaaaatttcccgggttaccagaaaaattatctcactctcttccctctctttgtcctaatcaaaaggagtctctctctctctctctctctctctctctctctccctctctctctctctctctctctctctctccctctccctctctctctctctctctctctctctctctacatgctgggctgcctgaagtttttggaggagtgccacaagccatcccatggccaccgcaggtagcactgcactggatgacacttgaagccagtacactgttggattgcacccaaggctcatggcaatgactgcctggctactgcttatggttattcaaggcccagaagctcttatgtctgaatgtggtgaactctgtcagaactaagttttattttttttttaatttctttcagaacggtggattttcttttggtccagagtgggtctagaaatgctgtccagtagctaaggcctggaatctagagcttcagtaatctgcttggtgctttatttcagtgtgactaaactggtacccgagttgcaagatgaatttctctgtactcttccctctcattttctaaagtggaaaaattttatccctgagctgcactgcctggaactggggagctgttacacagtcttaataaactattttattaccctaggcaattgtctgctagatagtcctaagcttgcatattaaaggaaatcttacgttaaaaaaaatatggtaatgacatttacatctcatagtacagagagaagtagtctggtgctagagggagattaaaaatggatgccaaataaaaattatagaaatccgtcataggactgtaaggggagaccggttgtatttagatagagactacctatcttttaactgtatctctgagctctggatagggcccatactgaatcctgggtctccagacagggagaattattatgaggctagaccacatgatgcttttacagtgcacttttaaaaacattaacaaagaccgttctaaatgtctaaactatcctctttcttaagtacccaagaatagcctccgttacaataactattttagtcaaaaaatctggtaacacaatgcaaaagcaagtactttatgatctgagacaaacttttctctttacccactctcggggttccataaagaaaaacaagtttctccccagaaaagagtctggtgctttgtctgttttcttcagtgaatcctgggctattataagctgttttaggcccctcatgcagcagacggaggcaagagaaagcagagacagcagaactaaatgaagacaatgaaattcaataaactgagaaaaaaataataaacttctgctcagaggagacaaggtcttaggagagaaaaaaaaccataaagtcttttaatgcaaacatacacacacgtgcacatgtacacacacacacacacatgcacacatcttggatgttagcttttaattaagctgacttttaaccattgagctccttaaaataatatttttaaatctcattgttactgtaaaggagtccagatccagaccccaagaaagggttcttggatctcatgcaagaaataatttgaggtgaatccataaagtgaaagcaagtttattaataaagttaactaatgaaagaatgtctactccataggaagagtagtggcttggcctgcttcactaaggatacttccagttatttcttgattatatgctaaataaggggtggattattcatgagttttccagaaaaggggtgggcaattcccagaactgagggttcctaccatttttaaaccatatagggtaacttcttgatgttgccaaggcatttgtacattgtcattgcactggtgggagtgtcttttaacatgctaatgcattataattagcatataatgagcagtgaggacaaccagaggacacttttgttggcatcttggttttggtgtgttttggccagcttctttatcacaaacagttttatcagccaaatctttataatctgtatcttgtggagacttcttatctcatcctgtgaattagaatgcctaacctcctgggaatgcatcccagtaggtctcagtcttattttacacagggactattcaagatggagtttctctggttcaaatgcctctgacatatttaccccctcccttttataagagaacccttaatcctaagggctgtagagagaggaagattcatcttctgtaacttcttcaggctgaacaggggggatgatattcatgcctaacctcttgcattcaggttagagaagagctcagtcaaaaagcatcattatggtgagggccattcataagtcttgagttatgacaaaaggtgatatctggaagattaataagtgttcagtttaagaatacattcagtaagagaacccttaatcctaagggctgtagagagaggaagattcatcttctgtaacttcttcaggctgaacaggggggatgatattcatgcctaacctcttgcattcaggttagagaagagctcagtcaaaaagcatcattatggtgagggccattcataagtcttgagttatgacaaaaggtgatatctggaagattaataagtgttcagtttaagaatacattcagtaagagaacccttaatcctaagggctgtagagagtggaagattcatcttctgtaacttcttcaggctgaacaggggggatgatattcatgcctaacctcttgcattcaggttagagaagagctcagtcaaaaagcatcattatggtgagggccattcataagacttgagttatgacaaaaggtgatatctggaagattaataagtgttcaatttaagaatacattcagtaagcttatcctgcattcctacgtaaagagtacgacagcactatatttcacaacagtaaaacaaaataagtaaaattatcccaagtaaactaaataagaaggcttttcatgaactgggagactttggaaccaaagtgatatggagttgctatacatgctatacattccaatatgtgctcagaattagaatattgatccagattttttacattacccacctctcttgttacttttgaacagccataagagatcactggttggttcacagaaataagcaggttcagtctaaatcgtagaaagaaaactcaaaaataactgatgagatcacaattttataacaagtgtaccattgtttttaaaatatgttttttctatctctccattctcccatttttactaaagacaaatcctaacagggctgatttgtttgcaaaaatacgccatagtcttacacttagcctgattatttgtgtaaagtacagcaaaaataatcatttttcacataggctttttaaattggctttgattggactttgttccacaaaaggaatctcagataaggtttttttccaaagccaagcctagccataggtttgtactatcaaatatttatcagttaggtaaattcctcttttttcgaggtcccaagataacctagggctcctgggcctgttagaaagtgacattctttatttactacaggtcaggaaccctgtacgggacagtgtagacagggtatgaggccagttttcccaaggggcttttattggccctgtaagccaaattcgattccttaaaggaaagcatgccattccagtcaaagccttggtaaaataactggtttcttttattttgtcctgttacaaaagaaaacattcttattgcacttatgcaaataactatattgtcataagttaagaatactcacaaatagtttccaaattctggagaaatcaggtagagagaaacaaatatgctccaaattttgttcacaggagtatattttacttacttgttaaaagctgcaaatcactcaaaagaaaagttttattggctctgaaaaacaaaacagaggatccttttaagcaaaaagtcaaaaagattactttagtcttctattagtccagtccatgttgttaactcctgttctgcctgatattcgtgaacatttcagcactccaggagatcctgaaagttttttcttctattctaacatcaaaatctccaaatttatcagaaacctgcatttaagaacacctattagagttctgtagctgattatgaaaccacctctaaagaaaaaaaaaaaaaaaaaaaaaaaaacaaggcaacaattgtccctggatgacaaaacactttagggcagtctctattaaagccacaattgactaagaattttggtgacttctgtggcatacaacaattttacataacaattattataactattaatagcatacactaagttatatcagagttacagaagtttctaataattttggaacacctaccaaaaacatatattcacaaatacagcctaaagaaagaactcttaggaaccattggtggaaaaacctggattgtaggtgattttaactatgtactacctttggagcctaggacacagaaagaagtgcagataaggtttgactatccagcataactaggaggcatggctaacaccacatatccccaggctttacctagaatctgcttcaaagtaagtaggttgaacaattttcaaaaatcaaagaagccgtttatgaccctaacacatctagcaaacttaatatttaacctacttcagaccaaatgtctgaattttgaagacatttgaattttaccaatgatcttcaaaactgtttttatttctgaaactttactaaagtcacatggactaaaaggcattcattcgtttttattttctgatagaatgttagatttaagctcttatgatttttgaaaacaatcaaagctctttcatatcacacacacacaacacatataaatacatagacagaaatgttccagtagttttaagattttttatttgccaggttcttaatcagattactgcttcagggtggagcccttggaggaacagggccaggaaaacatgcagtttctatggcttaataaataggcagagctggaaagcaaaaaagatcccccaaaatttaagggtcccattttatatcatatcttaaatcccaaaaaagacaaatgctacagaacaagacagtgcaatgattttactgtgcatttcactgcaaagcaattcaaagccactcaacctactctgtgattaccccatcttccatgggagtcttaggtctcagtgtggggcagggatgagcacattgccataccttctaggtggccaagagcatgctcctctgatccaaacatgtgaaaagccaagtattcacctttaactgtcattagctattccccaaagcatatttcctacccagttattacacaccaaagttctattataatgtggagcaatttctgatccccccaagggttaaaaacacctgataatgcaatgcaaaagagaaaagagccttagattgtgaagggatctctccacttctggttcctggggtttcatgagaaaaaaaaaaaaaaagagttttttcccaaaacaaggtctgtggcactacttgttgttcacaaggagtcccaggcttttagagcttgaatatcctcttttaattaggctgacttttaaatgtaatactctttttaaaaagatccttttaaatttcttattacccaaatttagccaggccaaatggccaatatttctgtcctcaaagaaagaaaaattcaacatggtttgtggaggggaagataatcaacaaatggtaaatgtcatgcagatatcaaaccagaaagggcttattccctaagccaggaattgaaccctgaacctgtgccaccactggaaaacacaaagccttagctgctaagctgcagaattggaaatattttattgctcttcccaggagactagagcagtcaattttgagattgcattggcttttaactgctcaatttaattttcagagataactatgacatgtacccccaaattcctcttccctggatggcagagaccaagagaaagtaccaccacatgtatacaagatatggcagagaccaagacaaagctcccaaggacatttttcaacatgcgatctctgggcaagaaggttcccctgaatgacagaaaagataggacagggaaagaagagaaagagagaaaagcattgcctgaagcagagtggggaaggtgaggaactcagggaggccagagaaagacccacccactgcagttagacttaatcaaaagttcaagcagctgcttttcagtcacaaacggatcttacccagaagtcccatcagctctcgagtgtctcccttttggggaaaaatagctcgccatgtcctttgatcctgaatatgtttaattctgtctcccgtagccatcagcaaagagtgcaaggcagataagtccaaagaaaatagcagttaacatccagtagtgccaaacccacttttagccgagaggaactttactgagaggggcctccaaccccataaatcttaggaagggctctaaccttcctaagttgggccccaaacaggttcagtcaagcacccttgccttttattaagagggggtctttaaccctctctatcttagggcagactctaacttttctaagttgggtctctaacccaattccattctttaccgagttaaatgcgcctcacttacccaaagttggccaagtggtgctgcacacagaagattttcctttgggtcgggggtcatttcagtataatcccttagtggtttgccagaaagatgttaccagaaaggagtctgaatccagaccccaagggagggttcttggatctcacacaagaaagaaatcaaggcaagtccataaagtaaacacaaatgtattaagaaagtgagggaataaaagaatggctactccataggcagagcagtggcttgcactgctccattaaggatacttctagttatttctcaattatatgttaaacgtgggctggattattcatgagctttctgggaaagggatgtgtgcttctaggaactgagggttcctcccctttttagaccatatagagtgacttcctgacattgtcatgacattggtaaactgtcatggtgctgttgggcgtggcttttagcatgctaatgtattataattagcatataatgagcagtgaggacaaccagaggtcactttcatccccaaattggctttggtgggttttggccggctttttttgctgcaacctgttttatcagcaaaggaagactttataacctgtatcttgtgctgacctactagatcatcctgtgacttagaatgcctaacctcctgggaattcagcccagtaggtctcagtcgtattttacccatcccccattttagatggagttgctctggtttaaacacctctgacatcattaccacattttagctaggacagattgttgatatttcagaggtaacaagtatcaaaacacaaaggtcttgatttaggaagcaaactcaggctgtcatagggaaaataagaaagaaaggagaacctcagctatgaaactgcagcatggggtgacagcccttgctctttcagtttggtttgtctagcaaaaagatgggcttattatgtaaataaagccagttaagtagtcaaaataaaaaatcgtttttgttgtttgctgtttttctcccaacccattccccatcttttttatttttattttttgtgtgtggaaatttagccacttcagaggccttgttctccataatttggaactttcctttggatttgatcaagtcggatagagttggtcaaacccaatgggaaaaagaccaaatcaacaacaaatacagaaacaaacaaagaacaacaagaaaccattaagcaaaacaaatgatctcccaatttatctgattactgagtgctctaatgttaaggagaaattaagaccagcttgttgttagtcttaactttagccaagaaaaataccccaattcagctacatacctagggatggatctcaggctgaagactgttctctaccatcctagaagcaggaaaaaacttaaacttttctcccgttggaaacaagctcaaactccagaaaggagttacctgcctttcatcatcatggaaacaggaaaacttgccttccttattggaagcaagtaaaactccaaaaaaaaggagctgtacagcaaaatacactttagactttaaccaaattattgaagatcagggattctctggaagcacgggggaagttggcggggagggggaaggtggcttccagacctcagcaaaatgttctattagtttgagccttaaggatagctcaagctggtaccggacaccaataggagttttgtcaatgtcagggcacctccactaagaatcccttaatggttaccaaactgtgaaccccaaatatctgagactgatctcagcaaatttagaaagtttattttgccaagtgagaacatgtgccgtaacacagcctcaggaggtcctgaagacatgtgcccaggtagtcagggaacggtttggttttatacattttagggagacatgagaattaaatcaatatatgaaagatgaacattggttaggtccaaaaaaggtgggatgactagaattgaggagtgggcttccaggtcataggtagataagagacaaaggttgaattcttttgagtttctcataagcttttccaacagaggcaatcagatatgcatttacctcagtgagcagaaggatgactgaatagaatgggaggcaggtttgccctaagcagtttctagcttgactttccctttagctcagtgatttgggggtcccacgatttatttttcttttgcactacagtacacctgttgttagattctagtcttgcctcatgtttttgaatttttattattttctacagcatggactgaattctaaaatttttcctggctacaagtcttcaaaataatacttacaattttattttctttccttccccctcccaacttttcctgatttgaaatcaccaaaaattaacctgtgctttctttaagccctgcaaactgaagcgagaaaaggtaaacttcagaagaaaatgaaatggcagcaacctacttacatatataaaccacttgcatacctgcctactgatgtatgaacttcagagtaagatggcctatattgatttttcaggattgctcttcatattttttttgctgttgtttttctcccttcttcctcctgttttttctttgtagaacgtaagaattcacaacctactaaaaatgacctttcctgataacgtgagacctacctgtctaggaaaaaaccatcctagccatgaggcaaatctggaacaaaaaaaacctctttttcttctaaaatgctttctccaaaagattttaaaaaggggttaaatgtcaaaggaaaataaatcttgggaccccccccacccccggcaaatcactaagccaataaaaacatcaagctggggactatgtcaggcaaatctgtctcccattttattcctaaacaagatagctacaaagattaaaaacaaaaaaaaaaagctacatatctccctcattatttgcccacaaagaaattatttgtggacaaaggacagacagacctcaaagtcatccctcttaggccaagggcatgtctgatttcttcctctaccctattgttttactaaggtcagactaagggataagtgactattactatacctcctctcacatgtaaattgcgtatttggtaaaaggctaatcagagactcaaaggaatgcaaccttttgtttcttatttatctatgacctggaagtcacctccccctcctccagttttcctgcctttctggacagaaccagtgtacatcttacaaatacagattgatgtctcctgtctccctaaaatgtgtgaaaccaagctgtgcccagacaaccttgggcacaagtcattaggacctcttgaggctgtttcatgggcatgtccttaaccttggcaaagtaaactctctaaattggttgagacctgtctcaggtattttgggttcacactttaaaccgcgagtggtttatgggttaaatccttaagaagttactgggccttaggacaatagatggaacaagtctcttcctccagctgataactagttcctccttgttggtcttttccttttggcttttctattttattattttgcatgtagttactggcaatgtagtgggtacattatcccagttatcccagttcctattatggtgacacagttctacttcttaaaaaagggtgctggttgttttcccatgattttccttgccagctcagcttaacttatttcccctggggagtttgagcttttaaatcccttctgagtggcaccctggtgagaaattgtcaaagacagggcccaacatatgtctcacggtttgcaacattttttctttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacagggtttcaccgtgttagccaggatggtctcgatctcctgacctcgtgatccacccgcctcggcctcccaaagtgctgggattacaggcgtgagccaccgcgcccggccatgcaacattttttcatgagtagccacctcctttggagtctttagagaatcaggaatatagatttccatgtatttactcgttttaagtaatgatttagctggctcagtccaaaggtttggtgtggccatatcccgctggggagagactagaatttacatcacttttagcagcagatcagatgggacaacagcagaggcatgatatttacaaagctgctgcccctaacttcacttagctgactggcctagtcctgcatctcagcttcactggctccttaacctgccatagtagtccctaaggatgaagatgccttctcattaaagaattccccaaaccaccagtcccactgcaggaatctccattatgggatcaaagaaaatccattttttttctctagaggcctgcatttcttctctttcttattaaggcccacaggtattacaatattcagagcctgcctagtgaggggtcccagtaaatggtttagcctccttccctgagtatctcaacacctgtaacacagaaattcagttttcatgatgtaggttcaaagacattttggtgcttcctcggtcagactaatgagacacaggagaaaaccatgaaaactatagagtataatacagcatgaagcaatgccatgtcaaactaaagcagaggtgttttacattttaagccccaaccacttaaagctatccaggatcattatgtcaatggatggtctcactggctaggcagtcttcatgcccatactctaatcgccaaaatcccatctttgtcatcacctgtttgagtccagggatttggggctaatcaaggaagaagctatgatgatgagaggcagtaacactcaagaagctttattaggcaatgctttcacatgacaggataaaactttcacagcctgaaactgtcccgaagcatatggccaggggtccatgacacagaaggggaaaagacaagggaactctctgaagagagcacagatgtatcagagaggggcctatatgtctaggcgatgtcactcagtattatagaaagaagtctctggatcagatgttcaaaaggaaaaaagcaattttgatgtgcaaaaattcatttggcaccagcaggtttttgagctaacagttatcatattgcagtgaagaagtaaacagcaacttaaacaaatttacgagaaaaaaacagccccatcaaaaagtgggcagaggatatgaacagacacttctcaagagtagacattaacgtggccaacaaatatattttaaaaagttcaacatcactgatcatcagagaattgcaaatcaaagccacaatgagataccatgtcacgccagtcagaatggcgattattaaaaagtcaagaaacattagatgctggcgaggctgtggagaaataggaacgcttttacactgttggtggaaatgtaaattaattcaactattgtggaaaacagtatggtgactcatcaaggatctagaaccagaaataccatttgacccagcaatcgcattactgggtatatacccaaaggaatatgaatcattctactataaagacacatgcacacatgtgtttattgcagcactatttacaatagcaaagacataaaaccagcccaaaggcccatcaatgagagactggataaagagaatgtggtacatatacaccatggaattctatgcaggattgggggacgaggggagaaaacttagaggatgggtcactgggtacagcaaaccaccatggcacatgtatacctatgtaacaaacctgcacattctgcacatgtatcctgtttttttttttttagaagaaataaagaaaaatgaaaattaaaaaaaaaacacacacacaggagaaaagaattaaacaacctagggttcaatacacataggtcatctttggctcattatactacactgttatcattgccatgattcaaaaaggtattttatattggaatgtgtatatgtgtattagcaattccccatgctgccatacaccccacctttaggtagtgactctgctgcatatttcctacatattatcttatttcattctcaaaataactctttgaggtgtatatcactgatattgctaatttgacaatttaagtgtgcgaatattattctaaaccagaattctggaggaccacaataggctaatatttactagtaagcactggaattgattttaattttagtcctaatagcccttttcatttacccttgtaatgttataggatattctgtaacactatgtggagtcctttgctaccttagagcatcctgcccaatgatttgttcctccctttacaagcagctaccttctcaatgtggctaatattacttctagatctctcatgtcaatgctggggtcattcttcctgtcccacttatgtgacctttgataagaaatgtatacatcaaatatacctcactctcattgacatgaacctttcaacaaacaaaccaaaaatatttcatgattttgatgactcatttccatgagttcttcatctgagccttaaagttatcagtgccaactggaaaaattgggaatttctgataaatgattgtcacatttctgcaaatgaagattcataaaggctcatctgcatttttcagaacatatgcacatccattcctaatgagcttgccttctactaatgccttaaaatttaaataagtggatttaattcaccttaccatcaaatagaaacagtgaaatcctgaaaatattactttgctgtatatacccagcagccacttaatggaatcttcaggataaagcaagataataaaatcacaaaggggaagtaattcaatttaaaagtgcttgagatttcatgacttttccctggacatgttttatttatatggttttgaagcatatctttaattatttatcaggtatctggaattggccttctctggttagcagacccatagaaaccataaggaatctatccagattatcaacacttcatggccattggatgctttacatggaaatttagatgtagtggcctcatgaaaaatttttgtttattcaaaaataaataatattttttaagatctctattacaactttcagtcagattgaccattctgaaacactgcatgatgtaagcagtaacttcagcagggtggcagaatattaaagccccatatgcttcttcacccaaggaaacaagaattgaactaaaacatatgagtcagtagcctttgtgacaaatccaaaaaccagttaaaaggttcctgcaccaaggtgagctgaagccaggaaaaaaaaaaatatctatatatatatatgtgtgtgtgtgtgtatatatattatatatatattatatatatttttatgtatattatatataaaatatatattatatatataatatatataatataatatatattatatatatataatatatatataatatataatatatatatatatataatataatgtgtatatatatatatatatgtgtggcatttactcaacagagcacccccttccccagcacagtacaatgtgattgggaggaaatccctaatttctaacttctcctttgaaatggaaaggagtggaatccacagctaacattctgacttctcatggtgctgtccaagcaactattttctaacttgcctgcatctaagtgatgacaggagtaagtggccaaattgcagaccactgaaaacgagaacatgactaattctacaactagagtcagcagtaccacagagagacactaggtagggcttcagttctatagcttactgccccacttagaggctgcaatatcgcagagagacactagagggatttcctaagcagaaacatgcatgttgtttcaattaagaaacatgcacactcaaagaaccagaagaggaaaaaaaactgaacccaatattagcagatgaggaataattaataaagataaagaagagataaattagtgaacagaaaaacaacagaaaaaataaaaccaaaagatagttttttgacaagatcaataaaattgacaaatctttagttagaatattacaaaaagtagaagactgaaataactgaatttagaaatgaaagaggggatataacaactgatgtgacagacaaaaaggagtataaaaattatatagcaaaaattataacaacaaattgaatatagaaaaaaacgataaacttaacagacatacaacctactgtatatgaatcataaagaaatgaaaaaaattctgaaaggactataactagtaaggagatacaagcaataatcaaaaacttcccataccaaaacaagcccacaatcagctgtcttcactgatgaattctaccaaatgttcaaaaattagcaccaattttcaaactcttccaaaaaattgaagaagagggaacactttcaaactcattttatgaggccagtattattctaataccagaaccagagacaagaagaaaataaaaccacagaacattatccgtgatgattattgatgcaaaaaatactcaggaaaatagcaaatcaaatgcagtagcaccttaaaagtattatacatgctgataaagtgggatttatacctggaatgcagaaatggttcaaaacaaaaaatcaatcaatataatacactatattaacaaaataaagagcaaaaattgtgtcctggcctcatttaatgaaaattcaacatacctttttttataatataaagcactcaacaactggaaataaaagaaaaataccttatcgtaataaaagccatatataaaaaaccatcagataacattatacttcatggtgaaagattgaaatagctctctctaatatccagaagaaggcaaggaggccattatttccactactgttcaacatagcactggtagtcttagacagaaatatcggataataaaaagtaatgaaagacatccaaattgacagaatcgtttggcagaaaacactaaagattacatgcacaaaaaaaaactgttgaaactgatacatgctttcaaaaaaatttcagtaaccaacacaagcatacaaaaatcagttgtttctatgcactataaattaccaatgggaaaaggaaataaagaaaacaattccacttactataacatcaaaaggataaaatacttggcaataaacaaagaggtaaatgatgtacggcgaaaaaaacaaaacattactaaaagactcaaataagaaacaaaaatattaaaaacaatctgtgcttatgtattggaccacttaatattgtgaaaatgtccagaatatgtaaagcaatctacagattcaattgaatcgctaccaaaatctcaattttttattattttacagaaatacaagaaaaaaatcctaaaatttataaggaatgtcaggaaatccaaatagccggaacagtcttgtaaaaaaaataataaaatgagagaactcacacttcctgatttcaaaaaagtaatcaagatagtaaataatttttacaaagttagagaattaatcagtaatacaaaacagagagccaagaaatgaaccttgcatatataaccaaattattcttgagaagggtaccaaactacacaatgagaaaggaacagactcttcaataaatggtgttgagaaaactggatatctacacacaaaagaataaatgtggacccttaaattacaccatacagaaaagttaactgtaaaagaattaaagatctaaatgcaaggcctgataatataaagtcatagaagaaaacatagggataactctcaaggcattagatttggcaattatttaataaagatgacatgagaagcgtaggtaacagaagttaaaatagacaaatcaaactatatcgaacttaaaaacttgcacacgtcaaagaaaaaacaacatagtgaaaaagacaacatggaagaaaatatttgcatattatatatctgataaggagttaaaaagaatatataaaaaacttcaattcaccaccaacgaccaaaataaattacccaattaagatataggtaaaataacacgaatagacaaataggtatacaaatagtcaacaaacatatgaaatgatgcccaacatcactatcataagttgaatgcaaatcaaaaccacattgatatatcacctccataccccttaagatggccactattaaaattacatacaataacaaatgttggaatggatgtggagaaactggaatctttttgcactgttggcgggtatataaaatcatgcagccattatgtaaaacattatggaggttcctaaaaaattaaaaaatttaatttccaagtgatctggcaattccactcctgggtatatatccaaaagaacccaaagtgggacctcaaagagatagttgcatgcccatgttcactgcagcactgttctcagtagccaagaggtataaataacctaaatgtccatcaacagataaaatgataatgagaaagtatataaacaacagtctgatattaaagccttcaaaaaaaaaagggaaaataccgttatgtgctacaacatgggtgagccttgaggacattatgttaagcaaaataaaccagtaacaaaaggacaaatattctgtaattccacccatatgaagtatctaatgtggtcaaaattataaaaacagagaataggaaggtggttatcaagagctgggggaaggagtcagggacttcatgcttagcgtatagtttcagttttgaaacataaaaaacccaaaatctctgttgcacaacactgtaaatatacttaacatgaaaagacctgaaaaacgtacttcagtaagtgggacttctccaggatgcgcacatagatgttcaatgatgtggtctctgagccttaaaattacatgtcttattaaattaccccttcaagaaagataataaaagtattattcaaagggtatctctcattgatgtggacaaattatttccatgaagatcttttctgattataaagtatacatcatgccctcaaatttatctctgcagatgtagaaaactaactttgtcttaaaagatttcctgttgttttaaatattgcatgaatcacaggtccaggaatttgatgatgtactcaaattccataaagaagcttctctaaatgaactaagaaaaaatcctccctaatagacctgctttcttctagggaaccacaattttttacatccatatattactttaaagagacccttacattttatagatacaacaaattcttgataagattttctaaatatgaacacatactcatttaatggaggcatccagcaaattacaaaagtatacttcatttagttttgacttattttaggcccattttgccttttccactggaattttgaatattcttaactctttagaattttattacacttcaaaaacagtagactcttgagtggaccttttctagcacacaaacataaaaactaataaatacacaattcacaggagtattcttgtacaaatcactcctctttctagattctactatgcaatttctaggcgcagaggcccttctgcagtgtttctgttcactccaaacatacaagccccacaaaaaggttcattactcttttcacatgaaaatcctataaagttgattggtaaatctaaaagaaaatagcacttctatgaatgtggatataggcaaccttggagatcctttatatattcaagtcttagctgctctataaaatgtgattcctatgattcacagatacctccacaacaattatgggggctattctatcttgcatatttatcttacctatgatttgatcttgatgctttaagaatacatcagttacattaaaaattcaataaaaaattattcatttcaaagggcattttcaagtttttatttaaattactccaagcaggtgataaaaattatggaactaaatagtaatgattgctgtacatatttgtaaatatattcaaaaccattaactgtatactttaaatgggtggatttcatggtttgtaagttatacctcaataaagctgttacaagaaattactcacaagtaaatgtatcttattaattaatgacctagtttccttttaagtttactctgtgtagctgggacttaagcattgtgaaaaatacactaatgttttatgaaaacacaaaattaataaatgggaacccagtctttagcagtaccttcctgcctaaaaataagcaatttttttccacaaaatgtctaatatggtttaccatattatattttccataaattttatttacactatattttaataatgaaatggcaaggttttgtaaaattttacagtaacaactaattcactaaaacatcatctgccattatgcacataccactattattataaactcaactttccattaaagaagggtaaattcacagtgggaaattcctcccatgtaactacacttcagactcatatggtattccctgaagattcttggcgtacctgaccagtcatgatttcttgcctctttaaaataacacaaaaaatttgagtgagctctctgtgcattagaagcctacagacacccaattgatgtctgttatgtagacttaaacacactgttataaaatttaagacctaatattctaagagtgtcaacaaaaagagtcaaattctgtaaaatattttaagagatttattctgagccaagtatgggtgaacatggtccatgatacagccctcaggaggtcctgagaacatgtgcccaaggtggtttgggtacagctgggtttcatatattttagataggcatgagacatcaatcaaataaatctaagaaatacattggttttgttcagaaaggcaggacaactcaaagctgggggggtttccaggatataggtaaatttaaacaacttctgactgacaattggttgagtttgtctaaagacctggaattgaagaaggaaaatgttcagataagacaataaatgtggaaaaggcgtttgacaaagttcaacaccccttcatgctaaaaactctcaataaactaggtatgatggaacgtatctcaaaataataagagctatttatgacaaacccacagccaatatcatactgaatggacaaaaactggaagcattcccttggaaaactggcacaaggcaaggattccctctctcaccactcctattcaacatagtattggaagtcctggccagggcaatcaggcaagagaaagaaataaagcatagtcaaataggaagagaggaagtaaaattgtctctgtttgcagatgaaatgattgtacatttagaaaaccccattgtctcagccacaaaactccttaagctaataagcaacttcagcaaattctcaggatacaaaatcaacgtacaaaaatcacaagcactcctatgcaccaataatagacaaacatagagccaaatcatgagtgaactcccattcacaatcacttcaaagagagtaaaatacctaggaatccaacttacaagggatctgaaggacctcttcaaggagaactacaaaccactgctcaaggaaataaaagaggacacaaacaaatggaaaaacagtccatactcatgtataggaagaatcaatatcgtgaaaatggccatatggcccaaagtaatttatagattcaatgccatccccatcaagctatcattgactttcttcacagaattaggaaaaactactttaaatttaatatggaaccaaagaagagcctgcatacccaagacaatcctaagcaaaaagaacaaagctggaggcatcacactacctgacttcaaactatactacaaggctacagtaaccaaaacagcaagatactggtaccaaaacagagatatagaccaatggaacagaacagacacctcagaaataatgccacacatctacaaccatctgatctttgacaaacctgacaaaaacaagcaatatggaaaggattccctatttagtaaatggtgttgggaaaactggctagccatatgcagaaaactgaaactggaccctttccttacaccttatacaaaaattaactcaagatggattaaagacttaaatgtaaggcctaaaaccataaaaatgctagaagaaaacctaggcaataccactcaggacataggcatgggcaaagacttcctgactaaaacaccaaaagcaatggcaacagaagccaaaattgacaaatgggatttaattaaactaaagagcttctgcacaacagaagaaactatcatcagagtgagcaggcaacctacagaatgggagaaaatttttgctatctatccatctcacaaagggctaatatccagaatctacaaagaacttaaacaaatttacaagaaaaaaacaaacaacccatcaaaaagtgggcaaaggatatgaacagacacttctcagaagaagacatttatgcagccaacaaacaagaaaaaaagctcatcatcactggtcattagagaaatgcaaatcataacaacaatgagataccatctcacaccagttagaatggtgataattaaaaagtcaggaaacaacagatgctggagaggatgtggagaaataggaatgcttttactctgttggtgggagtgtaaattagttcaaccactgtggaagacagtgtggagattcctcaatgatctagaaccagaaataccatttgacccagccatcccattactgggtatatacccaaaggattataaatcattctactataaagacacatgcacacatttattgcggcactgttcacaatagcaaagacttgaaacaaacccaaatgtccatcaatgatagactggatgaagaaaacgtggcacatatacaccatactatgcagccatagaaaatgatgagttcatgtcctttgcagggacatggatgaagctggaaaccattattctcagcaaactaacacaagagcagaaaaccaaacaccatgtgttctcactcataagtgggagctgaacaatgagaacacatggatgcagagaggggaacatcacacaccagggcctgtcagggggttgaggggtaagggagggatagccttaggagaaatgcttaatgtagatgatggcttgatgggtgcagcaaaccacaatgtcacatatgtacctatgtaacaaacctgcacgttctgcccatgtatcccagaacattaagtataatttaaaaaaaaattaaaaaaagattgtggagaccaaagttcttttgaagtcttatagtggctgtccttagagacaataggtgaaaaatattccctattcagatctttaaaaggtgctactttcagttaatctattcaggattggaagggcctggaagaaaaagatctaactatgttaatagagattcttcacagatggagattttcagggccattagagaaacatgttttggggtaaaatacttttattttcttccttgtctcagaatgttatgccagagtcagattggaaagtaagtcatgatatatagggttaaataaaacccatctgatgagaatttatggtttgtagggcatgactccccagactccttagataggaatttgggcaaggtaaaaaaatcagagcttattcttcagtgccacctcttggccaaaaagcattccatggaatgcatatgcaggccaaaaaactcccacagcactagggaggctcattcctaaagttgtctgatttggccatttggcagggtcccatggtgctaggaagacttgttcctagagttctctgacttgatggtaataattttaaatattaacgatttggacaatgtggggaggacatggtctgacctgatgtaatagccaattgtttaaggggtgagatggagtcaggccaagggtttagtctaaaaaaattccagatcagatctattttctgagctatcatgatccaggtctttaactgtgccttttccttctgctgtatctggcataacatttacaagaaatgtctaatgttaatatagtaacaaacatcataaagatagtgaatatttgggtgtccaaggttataggtagaatcagagggcagtaaacaacccaaccaaacagaaaaaaaaactctgcatgcatcattatattatttgatcagactcacaatgtgtttaccctccttatcaagggttacttgacctttatggtaaatcttatttgagaattgtaggaccaacattaagtttgaatttaataaatttaatttctcttccagccaatttatctccatagatatagcatcctgagaagggtatatattacatgcaagaaacacctcatcctcattgtgtaaattgttatagacttgttaacagtagacaaatctatttttcccaatacttttgtattgcaccatatactggtattcgggagagaaaaggttctgtcacaggagaagtcatgtaattctacagtgtcattttttcctcagcaggactccctatggccgaggaccttcagagtcaaaagacttatacccaattattttaggccatataggaatggatgtggaaaggcattcattacttcttaaaattattattttaagtttaaaaagctgacaataaaaccaaaaggcaaagttacaagactgacttatttttaacttttatgtgttgagctacagtaagcttggtttctgttacagacttacagcaattagctatacaaaacataagcattattttaaaatataataaaaaatatgtataaatatatttttatctttacaacttatacttggagtatgatactcaggaggctttgtttcaagttattttatcctgttagtaaatatttttctttaattttatcgtaagcagaaaatttttatggttggtgtggatgcaaaagtgacatattataatttagaaggcaactaaagttgttttactaattgtttaggcatttttttgtacccccttcttgatttggagggtttgatcttgacctaatttattactgaaaaccggcccttacaatcttatgcacccacctcttctgtgatagtccctgggcctaggggtgaggcagcttgtatagttttggcagcagaacattagcagtgaaacagatcggggccggtgggatgccaaatgaaggagattcatatctctggtcttcagaataccatgattttggtttccttggaagtaaaacaaggagagataaataacatttatagtttgacaattatagaataatttgtatgttagaacagaaaaaggaaatagaaaggtgccctattctattagggcaccaactaaaaatatgaagaaaaattacaatctggtactttctagaggattattgtagccaagaacaataatttaatctgcacttaaaaagttaggactgaaatctagtattaagtgtcacacttttcccttaaaacaattattttttaattatcattaaactaatgcagacaattataatgttataaaatcacaatctgaattttggagaactcagaaaggtaaatttgcttacaaaaacatactttttccaaataacttaaaaaaaaatgtcttgaccctcttttaaccagagcagcagcttttaagacaagatgtttgtttaccttggaaatgtcatttacaaaccaaacagctcatgagagctatttggcactatagaatttagcagcttcttacaattagtcctagaaaaaggctctctgcttattatatagcaagattttatgtaaaccatttttattttaccatggaactttttggaaaacattattcccattagtataggggtagctccagttaatattccacagcaaggcagtaaatgccccacgaagtagaaattctctagctcagtcgttgttactgaaaagtacacacggtttttaccataagccccataaatgctccaaacaaaagactatgcagtggaggatttacatgagcagatttacatgtcttcagctttacagtactagaaagaggaaaacattccacagttagatatactatccattttcataagacatttaggtaaaaggggttacaactacctcacagagagcttgtttaaacatcttacattttataattctattaatctgtatgttttatgttctggtccccagaagtcttttttaaccccagaccactttaatttttctggtgaaaaggacttgggttcccagcagggagttgcatctttaaggcatatgagggacagatttgataagccttcttaaaaagacccataattctgtgagaggggcacccatataaaagggccccccttaaccatcaaatataccatgacccagacgatagacaaatttggtgggaggatatcacagttattataaagctagtctctcacagcttgcatatgaaatatattaacggcttcatctggggtacttcacttgctatttttttttattattattacattttaagatttagggtacatgtgcacaatgagcaggtttcttacatatgtatacaggtgccatgttggtgtgctgtacccattaactcaacatttagcattaggtatatctcctaatgctatacctccaccctccccccaccccacaacagtccccggtgtgtgatgttccccttcctgtgtccatgtattctcattgttcaattcccacctatgagtgagaacatgtggcgtttggttttttgtccttgcgatagtttgctgagaatgatggtttccagtttcatccatgtccctacaaaggacatgaactcttcattttttatggctgcatagtattccatggtgtatatgtgccacatattcttaatccaatctagcattgttggacatttgggttggttccaagtctttgctattgtgaatagtgccacaataaacatatttgtgcatgtgtctttgtagcagcatgatttataatcctttgggtatatacccagtaatgggatggctgggtcaaatgggatttctagttctagatcgctgaggaatcgccacactgacttccacaatggttgaactagtttacagccccacaaacagtgtaaaatgttcctatttctccacatcctctccaccacctgttgtttcctgattttttaatgatcaccattctaactggtgtgagatggtatctcattgtggttttgatttgcatttctctgatggtcagtgatgatgagcattttttcttgtgttttttggctgcataaatgtcttcttttgagaagtgtctgttcatatcctttgcccactttttgatggggttgtttgtttttctcttgtaaatttgtttgagttcattgtagattctggatattagccctttgtcagatgagtaggttgcaaaaattttctcccattctgtaggttgcctgttcactctgatggtggtttcttttgctgtgcagaagctctttagtttcattagatcccatttgtcaattttggcttttgttggattgcttttggtgttttagtcatgaagtccttgcccatgcctatgtcctgaatggtattgcctaggttttcttctagggtttttatggttttaggtctaacatgtaagtctttaatccatcttgaattaatttttgtatagggtgtaaggaagggatccagtttcagctttctacatatggctagccagttttcccagcaccatttattaaatagggaatcctttccatattgcttgtttttgtcaggtttgtcaaagatcagatggttgtagatatgtggcattatttctgagggctctcttctgttccgttgttctatatctctgtttcggtaccagtaccatgctgttttggttactgtagccttgtagtatagtttgaagtcaggtagcgtgatgcctccagctttgttcttttggcttaggattgacttggcaatgcgaactcttttttggttccatatgaactttaaagtagctttttccacttttgtgaagaaagtcattggtagcttgatggggatggcattgaatctataaattaccttgggacacatggccattttcacgatattgattcttcctgcccatgagcatggaatgttcttccatttgtttgtatcctcttttatttcattgagcagtggtttgtagttctccttgaagaggtccttcacatcctttgtaagctggattcctaggtattttattctctttgaagcaattgtgaatgggagttcactcatgatttggctctctgtttttctgctattggcttataagaatgcttgtgatttttgcacattgattttgtatcctgagactttgcttactttgcttatcagcttaaggagattttgggctgagacggtggggttttatatatataccatcatgtcatctgcaaacagggacaatttgacttcctcttttcctaattgaatgccctttatttccttctcctgcctgattgccctggccagaatttccaacactatgttgaataggagtggtgagagagggcatccctgtcttgtgccagttttcaaagggaatccttccagtttttgtccattcagtatgatattggctttgggttttcatagatagctattactattttcagataagtcccaccaatacctaatattgagaatttttagaatgaagggttgttgaatttcgtcagaggcttttatgcatctatatagataatcatgtggtttttgtctttgtttctgtttatatgctgcattacatttatagattttcgtatgttgaaccagccttgcatcccagggatgaagcccacttgatcatggtggataagctttttgatgtgctgctggattcagtttgccagtattttattgaggatttttgcatcagtgttcatcagggatactggcctaaaattctctttttttgttgtgtctctgccaagctttggtatcaggatgatgctggcctcataaaatgagttagggaggattccctctttttctattgattggaatagtttcagaaagaatggtaccagctcctccttgtacctctggtagaatttggctgtgaatccatctggtcctggactttttttggctcgtaagctactcattattgcctcaaattcagagcctcttattggtctaattcagagattcgacttctttatactttagtcttgggagagtgtatgtgttgaggaatttatccatttcttctagattttctagtttatttctgtagaggtgtttatagtattctctgatggtagtttgtatttctgtggaatcagtggtgatataccctttatcatttattatagtgtctatttgattcttctctcttttcttctttgttaaccttgctaacagtctatcaattttgttgatcttttcaaaaaatcagctcctggattcactgatttcttgaaaggttttttgtgtctctatttccttcagttatgctctgatcttagttatttcttgccttctgctagcttttgaatgtgtttgctcttgcttctctagttcttctaattgtgatgttagagtgtcaattttagatctttcctgctttctcttgtggacatttagtgctataaatttccctctacacactgctttgaatgtgtcccagagattctggtatgttgtgtcttttttcttgttggtttcaaggaacatctttatttctgccttcatttcgttatgtacccagttgtcgttcaggagcaggttgttcagtttccatgtagttgagcggttttgagtgagtttctttatccggagttctagtttgattgcactgtggtctgagagacagtttgttataatttctgttcttgtacatttgctgtggagtgctttacttccatctgtgtggtcaattttggaataggtgtggtgtggtgctgaaaagaatgtatattctgttgatttggggtggagagttctttagatgtctattaggtctgcttggtgcagagctgagttcaattcctggatatccttgttaactttctgtctcattgatctgtctaatgttgacagtgaggtgttaaaatctcccattattattgtgtgggagtctaagtttctttgtatgtcactaaggacttgctttatgaatctgggtgctcctgtattggatgcacatatattttggagagttacctcttcttgttgaattgatccctttatcattatgtaatggccttctttgtctcttttgatctttgttggattaaagtctgttttatccaagactaggattgcaacccctgcctttttttgttttccatttgcttggtagatcttcctccatccctttattttgagcctatgtgtgtctctgcatgtgagatgggtttcctgaatacagcacactgatgggtcttgactctttatccaatgtgccagtctgtgtcttttagttggagcatttagcccatttacttttaaggttagtattgttatgtgtgaatttgatcctgtcattatcatcttagctggttattttgctcgttagttgatgcagtttcttcctagccttggtggactttacaatttggcatgtttttgcagtggctggtaccggttgttcctttccatgtttagtgcttccttcaggaggtcttttagggcaggcctggtggtgacaaaatctctcagcatttgcttgtctgttaagtattttatttctccttcacttatggagcttagtttggctggatatgaaattctgggttgaaaattcttttctttaagaatgttgaatattagccccatctctcttctggcttgtagagtttctgccaagacgtcagctgttagtctgatgggcttccctttgtgggtaacctgacctttctctctggctgcctttagcattttttccttcatttcaactttggtgaatctgacaattatgtttcttggagttgctcttctcgaggagtatctttgtggcattctctgtatttcctgaatttgaatgttgccctgccttgctagattggggaagttatcctggataatatcctgcagagtgttttccaacttggttccattctccccatcactttcaggtacaccaatcagatgtagatttggtcttttcacatagtcccagatttcttggaggctttgttcatttctctttattcttttttctctaaacttctcttctcacttcatttcattcatttcatcttccatcactaatacactttcttccaggtgatcgcatcggctactgagtcttgtgcattcgtcatttagttctcgtgccatggttttcagctccatcaggtcctttaaggacttctctgcattggttattctagttagccattcgtctattttttttcaaggtttttaacttctttgccttgggttcgaacttcctcctttagctcggagaagtttgatcttctgaagccttcttctcacaacacgtcaaagtcattctctgtccagctttgttccattgctggtgaggagctgcgctcctttggaggaggagaggtgctctgatttttagagcttccaatttttctgctctgttttttccccatctttgtggttttatctacctttggtctttgatgatggtgacaaacaggtggggttttggtgtggatgtcctttctgtttgttaattttccttctaacagtcagcaccctcagctgcaagtgtgttggagtttgccagaggtccactccagaccctgtttgcctgggtatcagcagtggaggctgcagaacagcggatatggtgaactgcaaatgctgctgcctgatcgttcctctggaagttttgtctcagaggagtacccggccctgtgaggtgtcagtccgcccctactgggatgtgcctcccagttaggctactcgggggtcagggacccacttgaggaggcagtctgcccattctcagatctcaagctgggtgctgggagaaccactactctcttcaaatctgtcagacagggacatttaagtctgcagaggttactgctgccttttgtttgtctgtgccctgcccccagaggtggagcctacagaggcaggctggcctccttgaactgtggtggtctccacccagttcaagcttcccagctgctttgtttacctactcaatccttggcaatggtgggtgcccctccccccacctaactgcccccttgcagtttgatctcagactgctgtgctagcaatgagtgaggctccatgggtgtaggaccctctgaaccatgcgcaggatataatctcctggtgggccatttgttaagcctcagttagaaaggcagaaatctcccatcttctgtgtcgctcacgctgggagctgtagactggagctgttcctattcagccatcttggctctctcccacttgctattttatagagagagttggacagtccccttcgcggagcaaacagaccttataatggcattatctggcccactaggctgattgctttctcaggaataaccctctatgcatgtggattgcagatactcagtgattgttcagtaatgagctgtgggccctgcattaatccaaataagcccttaaattctgtagcatttaaaattaataatttggccttaaagtggttatttttacaatctactacttttaaagtaactgaatgataccagtctacaaaattgaacagttcctttgcattacaccatctggtttttagtggttacttggttgtacccttcccctatatcaactatttttcttgataaccacaggacttagagttagtttttgttgccctagcttatttttctatccatttcattttatctgtataatttccttcattataaagcaactcttaaatagttcttaaccaaaaaaaccttgcttttttgaaaattgacatccttgtgtttaataaaatttttaatagcatattttatgctcctactattttaacttttagtaccccaaatttccagtggagaaaaaaaactgaagttttaacataattttaagatattaaattactacagagagttttgagatttaattttcaaaatttattttaccaaagattaccaaggtcatgtgaactaaaagacatctcagctaggttgtacaaatttggtaagcattcacattttttaagttacttgattagagctttttcatgtagtttgatagtgaaatatcacttctacatgacacataaagatagagatataacaggcatgcacaataaaaaggcaggcccaaaagatattgtatttgcctattttcaaaaaacttcctcacttactttagataattaataaaagttacagtagtcaacaaaaggtgaaggagagagctattaaggcctttccaaaggagaaagaattgaacttctgagatatcagtctgaagaatgttacagagactgatcatagaatcttaaaatttaaaaattttgcattaaaagtaagttaaatatttataataatcttgttttttaactaatttttcagttttgtattagtgtatttttaatatcaaaacccatctccagaaaaactattataatttcttcttaatcacagccaattgaattatacaaacccctttaaaaattccttcttactaaccttattattacttacataattcattcacaatttgtttagactcttttgtcttaaatgtccctctttcttgagcaaccccatcattttattttaggataaatatttactacacaagattctttcttatataacattacttttttaaccttttttttttttaacaaaaatacctctttatatccttaactctttttacatctcttatttcctgattcctttaccttgtttcatacataacccttaaataagctttgaattagacaaagatattttacctttaaataagaacatttaaaaaatgttttcctttcaatgccatccccatcaaactaccaatgactttcttcacagaattggaaaagactactttaaagttcatatggaaccaaaaaggagcccgcattgccaagacaatcctaagccaaaagaacgaagctggaggcatcacgatacctgatttcaaactatactacagggctacagtaaccaaaacactgctaccaaaacagagatatacaacaatggaacagaacagagccctcagaaataataccacacatctacaaccatctgatctttgacaaacctggcaaaaacaagcaatggggaaaggattccctatttaataaatggtgctgggaaaaatggctagccatatgtagaaagctgaaactggaattcaagatggattaaagacttaaatgttagacctaaaaccataaaaaacctagaagaaaacctagtcaatgccactcaggacataggcatgggcaaggacttcatgtttaaaacaccaaaaccaacggcaacagaagccaaaattgacaaatgggatctaattaaactaaagagcttctgcacagcaaaagaaactaccatcagagtgaacaggcaacctacagaataggagaaaatttttgcaatctactcatctgacaaagggctaatatccagaatctacaaagaacttaaacaaatttacaagaaaaagtcaaacaaccccaacgaaaagcgggcaaaggatatgaacagacacttctcgaaagaagacatttatgcagccaaaagacacatgaaaaaatgctcatcatcactggccatcagagaattgcaaatcaaaaccacaatgagataccatctcacaccagttagaatgacgatcattaaaaagtcaggaaacaacaggtgctggagaggatatggagaaataggaacacttttacactgttggtgggactgtaaactagttcaaccattgtgcaagtcagtgtggtgattcctcagggatctagaactagaaatcccatttgacccagtcatcccgttactgggtatatacccaaaggattataaatcatgctactataaaaacacatgcacatgtatgtttattgcggcactattcacaatagcaaagacttggaaccaacccaaatgtccatcagtgatagactggattaagaaaatgtggcacatatacactgtggaatactatgcagccaaaaaaaggatgagttcatgtcctttgtagggacatggatgaagctggaaaccatcattctcagcaaactatcacaaggacagaaaaccaaacaccacgtgttctcactcataggtgggtattgaacaatgagaacacatggatacagggtggggaacatcacacaccagggcctgttgtgaggtggggggaggagaggagatagcattaggagaaatacctaatgtaaatgttgagttaatgggtgcagaacaccaacatggcacatgtatacatatgtaacaaacctccacgttgtgccctagaacttaaagtgtaataaaaaaaaagttttcctataatttttcaattggaatttatccagatatttaataccaaataataaccttagatcctaaattatgtcaagtttgtttacaagcatttattcaattacatttacctgattaatttaatagtttacctagattattttaaaaaactgtgataaacaatatttaaagttattttcctgtttaccatttttatagctctgaatttcaggtatttacttatgtaataaaacttatggttaaatttaaggatatttataccaataactcagggtttagctgttttcatttaagccaacaatatttcataagcatatacaagcaatgatcattctgtcttgggctgagttttatagtttataacctttatggcaaatcttatagtactctgtgggaataaacataaaactacaataaagcaaacaaaaaatgctaacattgatgatattattttaccaataattttaaagctggcttatttaaagattttacttaagtcacgtgaacttgaaaaagcatttgactagtcatttaagtatttgatttaagcgcttttatatattttaagcccattaatcagagctctttatttttttagtagtgaaaatactgtatacacaacatatacatatatagacgtgttaggcatgctgatagaaatacatcttatagattcataaagacctttttttccatgtttctatcttaacttagtcagttgtcatttaaatagcctcagatttgcatattacaggcaactcaggtgaaaatcagatgatagcaaaatttacattgtaaggtaagaagaaaaagtctggtgtgctagagagaaattttaaatggattcagttgccaattgaacataaaagtaaataagcctattataaaggccttcaaatatatacacacacatatacatacacacattcacacacacaaagttcccattgctattgcttcagtactttagttatgaaataaatataattttgccagcttgcaaaaaaaagaaaaaaagcaaaacaaacaaacaaacaaaaaacactattaggtcgggcacggtggctcacgcctgtaatcccaacacattgggaggccaaggcgggcggatcatctgaggtttggagttcgagactatcctgaccaacacggagaaactccgtctctactaaaaatacaaaacttagctgggtgtggtggcacatgcctgtaatcccagctactcaggggacggagactggagaatctcttgaacccgggaggcgggggttgcggtgagccgagatcacgtcattgcactccagcctgggcaacaagagcgaaactccatctcaaaaaaaaaaaaagaaaaagaaaaagaaagtcactgttagatccaaacagtggtttttatctctgcagaaaagtaacaatagacttcaggcagaaaagaaaatagaacctaggaactctatagcatgcaggtcgacctcaggcctatttttcctcaatgtcaatgtgcacaaagaccatattacttccattttatgtaaactctggcaagcagaggtgccataaaacctatggattgccaaaaagaggggtcattctccttgttttctcctcatttaaccccccaccctttttttttttctgaaaaggaggaactgagctgtagcctagggtgtttttgtgatggttcaatgcgtgctgcctgtgggcaggactccacagtgtgttaccactgactttccaccctcttatgtgtctcagtttctctctccagaggtctatgacctctgagagggctcaaaacatcaggtgttctgaaatattttcaaataaatatttgaagagatttattctaagccaaatatgagtgaccctggcctgtgacacagccctcaggaggtcctaagaacaggagccctaggtgggaggggtacagtttggttttatatattttagggaggcctgagacatcaatcaaatacatttaagaaatacattggttttgttcagaaaggcgggacaactcacacatgtcccgaaagcagagtacccaatacataaaactataattgaaggaattgaaggaagaagtagagaattcaacaataatagggactaaagcaatctagtaattgaacgatacagaaattcagccaagacagagaaactttaaacaacatttctaactaactttacctaacagacatctataaaacattccacacaacaacagcaaaatatacatttgtttctttgcaacagggaatattctgcaagacaaaccatattctagtccatggaacaagtattataaattttaaaggtttgaaatcataaaagatatgttcttccaccacagtaaagttagaaaacaaaaatatatctttaatcataaaataattaaaaattaaaaaatacatttataaattattggtgaaagaaaaaatatgcacaatattataaaagtatttttatctgaacaaatataaatacacaatatattgtggagtcctaatttggaaaaaggagtcaggctggcaggaccagcggaaagcaaagatatgaggcaaataaactatgccttttgcctttcttcatggttcaggacatataaacaaaaagaggaagctgataaattatagttttatggcccaggacatatagccctcctgaaccaataagatacataactcacaaacttcctgcttaccatcaaattcctcaatttatcaaatatcccagctgacagaagaatgcaagttcccaagttccattctatagaatcctgagcaagcctttttgctcctggctgtcagcttctcttctactgatactgtctgttgccttttcacaatgtattttcatactttctctaataaatctgccttttttctacctacaactgtcttggtaaattctttcagtcctgcaccaccagcccagatagtcattgctcaccggcaacattctggtggcccataaggggactctctcttcatggggaactctctcccctctcttttttcgaactttggacagtgtctaagcacagaggcaattgcactgtagctggagctactctctagtaggactggaaggtgtctttgcgaaagcgtctgaccaccatcgcccgttagggtgagggacctgagtctacttattcttttcagtcttttgtctgccagcttctattagctctctggcaattaaaagtaacaggcagggccagtctatggtgccgcctgaaggccaaagagtgaacaggactggctgccctgcccagaaaaaagaaaggctctttcttattttttctgatcaaaagcccctgatgccaaaatgtgaagcaattgacagcagaagcttgttcagggtgaattcgcacatgttttaggtgactcagaccctctgtcactctaaattctcctgtggagacagccaatcatccttttctggatgtgctaaatcaggtgatctcagacagcctcagaacagtgagtcttcccttaactacccactctcctgggtcaacaccagacagagatcttcctttaccctttttcttcaaacctgagctgatcacccagcataaatgagtacctcaactggccatccagcatgaggcctccgatcagccaagaggacttttctaatgactgagacactcctttagaaagtgcacccagagtccctcagtggacataaatggaaccttcttttcatttcggcgagatgtcttgacagaaagtgtcgttcatgccccaagtggaactgccccaaagtggcatgttttttcattccacaaaccccatctattcctgtagactcacctctagactgtattttgaagaatcgggacaaatttgaccctcaacccctcaaaaagaaacacctaatctttctttgcaacatagcatggcctccttaccacctcccacagaaattgaagtggacccagaatgggagcctagactccagtattcttttaaatcttgatctcttttgccataactcttccaaatggtctgaggtgccctatgttcaagtttatgtttctataaaaaaaaaaaacctagactttagagacaattgtagaatgagactggcaaaattcttaagtcccttagattcctcagacattttggatgacccttcttttacactctcatgttccagacctctcccactttggtctctccattcattttccctgactacacatctttcccttcaatacctccttcctcagctacaccttctgtctctccctctttacctcctccatacccagaaccacttctcctccacataccagatcaggagtcacctctgattctctcccatcatcagataaaggtttgcagctctgagaagtggccaaatgggggtgtaggaatcatcagggcccatgtctcattccctatgtctgatttgtctgaaatagaggcaaatcttggctcttttagttagtacccctcccattttatgaagaaattcaaggggcttgcagtttcctttgatctcaattggcaaaacatttaggttatttttaccacctgttgcactcataaggaaaagacccacatttggtctctagcccactgatgggcagaagaattccatgcctggaacatttggaaccctgaaccaggaagaacagttgtttatgatagtgatcctagatggggctgtcaagaaggagaccctgatagagtccaccacaattatatgatcacttgcctgattgaggggatgaaaaaggctgtcattaaacctgcaaattatgctacattaagagaagttacacaggggccaaatgaaaacccagccctattccactctagggtagctgaagctatgagaaaatgcactaatatggatctctagagccaagagggcctcactattgtggctgtgtattttattaggcctctccagacgttaggcataagcttgaaaaactagttcaaaggccacagacccctttccttactttgctataaatggcctttacattctttaataactgggaggaagcctcaagaactgacaggataggaaggaaagagaaagagacaggcagcaagctcattatatggctgctgcctttgctacctgcctgcccaaaccagggaccacagaccaagcatcaggatgtcacccactgaccaataaaaggcccattctctgttatagctataaccagccttggcatattaacagaaactgccaaaaccctccacgagtgtcacctgattttctactgccaccacctggcctttgccaatactgcaagcaactgggacactggaaactggaatgctcctcgctccctcatgataggtagtcatcctcaaacaagtcccaattatgggccaacttgggaggaaagcaaaggcaaatgcccttaactttgttcctcaattatgaaaaagctgaggagaccttaaaagagaagaaaaagccccaagaggggccatttcctcactgtcccagaggccatccaggctcctgtattttccatcactactgctgaatctcaggtaatcttgtgtgtagcagaatataaaattgagtttttttattgacacaggatctagttacactgccctaattaaattctctggacctaacttttggtcctcaatcctcacaagcaaggagggccaactgaaacagagctattttaccccatctttggtatgcattggtatgcaactagggaaaaaaatattttcactcacttatttctggtcttgcccacttgttccatccctttgcttgggaggcatataatggcaaaacttcaaactagctttcagttttccaaccaggcctgttcaatactggcattattaccttttaatactgactccaatacatacagcctttcattgtacaacaagttccccctgaagtatgaaactcatccactccaggatgttctttgcgtgcagaccccaaaaaggtcatccttaaggtcttcacctctttccctaggaaatctccatagcctctaaatcttgaaacccaattaggcttacagcccttaatttcactcttgtaattcaccatgtaacacacccaccttagctgtcaaaagccagaaggcacctatagaatgatacaagacccaagagccatcaatgatccagtagttcctacacaccccattgtttcgaacccttacatcctgttaggacaaattccttctggcagttttggttcacagtattagacttaaaggatgctttcttttgcattccagtacattcagattcacaatttttatttgcctttgaatggcgagatccttccactcatacctcccaacaattaacctggacaggcctcccctgaggatttagagatagctcacaaccatttggacaggctcttgccaaagatctgttcaccattcagctatcccttaatagcaccctgctccaatatgttgaccacctgcttatctgcagtccaactgaaggtattaaatactattaatcttagaatatctaaatgctattaaaactctttagaggttatcttcctgtggttatgaggtttctccttctaaaactcaaatttcctctctggaagtgcaatttctgagactcacactaaccccagggtttaaaagtctctctgatcactgtgaaagcctcatcttaaacatgggcacactagcaactaaacaacagttgcactccttcttgggaatgccaagtttctgtcatatttggactccccaatttggactcatagcaaaaccctctttatgagacactatggggaccagaggaagacccctttactggaactctgaaatgaacaaaaccctaaaacccattaaacaagttttacaactgccccacctttgaccttaccataccttagaaaaactttctatttatttgtacctgaaagaaggggtatcgcccttggagacttaatccagccattggggccctccaaatgaccagtagcttacttatcaaagaacctcaatttggtgacacagggctggcctccattcccccggcactagcctctgtggcccgattgattgaggaggcctccaagctgaggccaaggaataacagtgtataccccacaccaaatggtggatactttaaactcaaagggctctcactgagtctcaaatcaaataagaagatatcaaaccctctttctacaaacaccacaattaaacattaagcagtgtgaagttcttaatcatgccatcctgttaccagatccaaatgtggaaggatcacttaaacactcttgcttagaaactcttgatttaaggctggtcgcagtggctcacacctgtaatcccagcacttaggaaggcctaggcaggtggattacctgaggtcaagagttggaggccagcgtggccaacatggtgaaaccccatctctactaaaaatataaaaattagcttggcatggtgacacatctgtagtcccagctacttgggaggctgaggcattagaatagcttgaatccaggaagcagaggttgcggtgagctgaaattgcaccactgcactccagcttgggcgacagagcaagaccctgtctcagaaaaaaaaaaaaaaaaaagaaagaaagaaagaaaatattgaattaatttgtagctcctgatttgacctccaagatattccccttaccaattgggaggccacttggttcatagacagcaatagtttcatgttagaaggtacccagttaccacggtatgctattgttagccttactgaagttacagaatttgggcccctaccctgtgacaccacctcagcccagaaggcagaacttattgcccttacctgagccttgcaattaggagcatgcatgaaacttaatacttacacagactgacctacgtctttcatgtagtacatacccatgcagccatttggcaagaaaagggactcttaacagcccaaaatattccagttagacatgctcctgaaatcatggccccgttagaggtaattttgcttcctgcacaggtagctatcattcactgcaaagcccatcagagaagcaatgataaaatctctattgtgaacaatcaggctgataaacaagcaagagtgactactaagctacctctttaggcagttttagttgctaacctaactcaactgtctccactgtatatgcaggaataaacccaaagggctctagagaaaggcttctcccatacttcggagggctggctaaaaagccctaatggcaaacttttgctccaaggagcctcacaatgaaaatttttaaacagtttacaccaatcaactcatttaggggctaaagccctccaagacttaatatggtcactgtttatcggtaaaggaatagcataaactttaagatccatctcacagccttgccccacctgctgccaaaccagtcctgaaggggcccacaaacttccccctctcctccaactcattcaaagattagggatcctaccaggagaagtctggcagctagattttacacacatgcctccatgcaagggacttaaatatttgataatctttgtagataccttcgccaggtggatagaagcctttcgcatcaaaactgaacaggcatggcatcagaagtcaccacggcccttttgaaccacattcttccccattgttggctccctcactcactgcagtcagacaatagcgctgctttcatttctcaaataacccaagaagttgctaagacccttcaaatcaaatactagtttcaagcagcctgacatccacaatcctctggaaaggtaaaagagccaatcaaagcataaaaaggcatcttacaaaactgataaacccaacagtcatggccagctctgctccctattgccctcttaaggtcccttatacccccaaaatcagaaacccatctcagcccatttgaagttctttatggaagacccttcttacaaacagacctcttgttagagccagaaaatcattatcccacacaatatgttataattcttggacagaccattaaagccattggccattaccaaaatctccacagccccaaacccgatccctccttttcaggaaagatacactctaaattcacacctggagactgggtatgtctttaaactctcctgcaggtcaaaaggctgttagaacctgtctgaactgggtgatatcaagttattcttactatcccaacatctgtaaagctccaaggtccccatggatccaccactccaggggtcaaagctgctcaggcaccaaatgaagagccctccactacacacagctgtgagccaatcagagccctccatctgtttagacaaaactcagaggctaagttggactcaggttatattaaccctaattctcaactccaccttaaaggagtttctttctttctcttttttacttgagacggagagtcttgctcttgtcgcccaggctggagtgcaatggcacgatctcagttcactgcaacctctgcctccctggttcaagtgattctcctgcctcagcctcctgagtagctgggattacaggtgcacgccaccatgcccagctaatgtttgtatttttagtagagacgaggtttcaccatgttggccaggctggtcttgaactcctgacctcagatgacccgcccgcctcagcctcccaaagtgctaggattacaggcatgaaccaccgtggaagaccaggagtttcttttccttactccctttattttccttaaaatcaatgaacctaatttttcctggcttcttaattgaatctgtgggctgcatcatggtcatcgttttcattgttctgcgcgttatctgtcttcttccgtctggatggaatagcattctcctttgccattaaacttcatttttaagaataagtattctaataaccccaccatcatacccttgcctggccactgcagcaacctcgagtttttgaccttcccttaaggttgatggaaattagcccaatgtctcttttaaatcttattgttagagattactctttttattcaattctactacaggctctaagcaattattcaactgcctaacttaggcagctttaccctcttaatattaatgctttcacaagggaggtagtatatgattgctatttgcaggaggacttctagattaccacccagatgaaatttctttatatttgttctagtaatctgatatacaccacaccacaatgatgatgtgctgtggtactaaagtggttttctaactatttttcttatacaatttatagcccttctcctttcctgtgtccctgacttcactatattttgtcgcttttaacttgtcaggcttcatcctcattacttggatatctctacacttagtgttaacacttacaatgaactttactttgccaatcttcctggattacaccctacttacaggggcccataagctattaaagaaacaacattctctgtgtacaaaagattgttggctttgcttacccttagccctcaaatggtatgcttcttcacttttttatactcagtattagatccattttaataccatcctgctctccaaattcctgttcccccaacttccatggaaccccaaaaacacatgtggaatggtagctgcattctctgcctatttaagccaatacacgaccaagctaaaaataacaaccccctcaaaggactggtcctctaacccaagagacaaccgtagactcaaacaccctgttgtagcccccctttttaaataagtacaacttaaacatcaagctatttgccttaaagcaacagacaacaaacattactccaaccccatgggtgatgtttctaagcccctttgcaactacaccatatgtataaatcacaccaacagaaaatacataccaagggaaaaacataatatggtaccagttagaatatcaggcccagccgatcccaatgtcccaaatctccaaaatataaactctcacttctgtacagatcactcctctccagacacttgttctcacctaactccgtggcaaaatttaaaggttgaaaattcccctaataattacctacaaattctcacacttagcaaccccaaatctcagatgtctccaggcatacaacacatccatttgtttagggaaaacaaaacccacccaaatgcaaattgtaacatctacacctcacaacctcttacaattactatgctagctactcaatacttcttcaggtcagaaggccgaaacacactccatttcttcactgtaactctattctcttgccttatatctgagagagcattcttcctttgccgaaccaatgcctatgtttgtcttccagccaactgggctggaacacatacgctagtttacttggccccagacacccaaattgctccttccaattagtccttcccaatcatgctttacagtcctagcagggcaaaatggccaatctatctaattcccttactgcctggcacaggcattgtcactggattgggtatgagaataaaaggtatgagcctcgcagtgcatacttatcatatcctctcaatcgaacttgccactgagctcaaatgcgtctctgagaccttggaagtcctccaaaatcaggtcgactccttagcaacaattgttctccaaaactgctgtggcctaaatccgcttatggcagcccaagaggacatatgtttagcgtttgaaaaagaatgttgcatttatgttaatcagtcagaaatactgtgggctcatgtcaaacacctcagggagctagaggctgaaattgagaaaaaagtgtcacaaggatggtattaatgggcatctacttggagatcgttgtcctggttgctcttattcctggggccaaaaacaggcattttattattccttcttttcatcccttgcatcctaaatttactactcaaatttgtgtcttatagaatacaacaaattcaaaccaacatattactgtagtgaggatattggccactaaaagaactccataactctcctttggatgcagcaggttaaaattttaggctgcaaatgctgttccccattggtctcacaacaactctgccaaatttaactcccaacccaaggatttaggcccatgtaatgtcctaactgagttacaatacttgatagagacaactctacacccctggtcagcaggaagcagttggaagataagacctatatccacatgccaaaggtttgtcattgttactctgtgaggaaggaaatgtggcgtcctaattaggaaaaacgagtcaggctggcaggagcaggtgaaagcaaagagataaagcaaataagctataactatgcctttcttcctgcttccagatatataaacaaaaagaggaagcagatgaattgtaggtctgtttttctttatgacccaggacatatagcccccctgagcaaataacatacataactcacaaacttcctgattaccatcaaataactcaatttattaaacatcccagctgacagaagaatgcaagtttccaagttccattctacaaaatcctcagcaagcctctgtctcctggcagtcagctccctcctactgatacggcccattgccttcttgcaacatattttcatactttctctaataaatctgcctttcactgcctacaactgtcttggtaaattctgtttccctcatgccactggcctagatagtcatcgcgcacatataaaaattaatggaatacaactaaagcaatttaaatgcctatattagaagagaaaaaacagaagcaccaaggtgactgattagaagcagctaatgtgcactgctctcagggagatgagacaaagttgcaagtaaacactagctgttcaagtagattgtccagaaggccaaggtgggattcatgatagaagcactggttgccctcagagagcagagaagagcaaggcaagacagctgcccacccaagtttggcacagagccaggggaggctacttaccatggggaaagggtgagtgactaagagcccctgaagacccacacttctgccatggacctttgcaatcctgggcacaggagaactctcaaaccttgcccatccccctacaccccatgccctcatgcccacctccagaatggcacagtcaactgtctgaagtctgggcagagccaccactcaagaacacattgagcttcacagtctttggatccctgagaagcctggtaccagctgtcatagccagccaaaaagggaggccagagtctctcacacgccccagaataagggctgcaaccatagtgctgaggagcagacaggcttagggccctacctctgctgcaccaggaggcaaagcccagtggcctgtggtaccagtgaagccatcccatccccacttcactactttagccagttgtagttctgcatttctctgagagggaactccaagaggtaacagacaagccctcggccattgcagttgctgcggtaaccacccttgcttcccccaggctacagaaggaacaaacatcttaattgctttcatgtgcttactgcatgctacagttaccctatgcagaggaggccagactatcttctgtggaaactcctgactctcctgctcttctcccggcagggatctctggcttgcgtttgcagcacagccaccccaccttcagctgatcatcccagatccagcagcaggttctgtagttctctgaggtggagttcccagagtcaactgacagctcctctgccatgacaccttgcccttgctgcccttgggctggggacataacgaagagtctgattgttttggttgcaccatcagtacacggctctaaggagaggaggtgagactgtctttcccaggagcccctttccccctctgctctttgacaggcagggccccccagtttgggaccagaacacagctttcccctccctgggtaattactccaatcagctgtggctctggatttctctgggatggagccacacccactcaagtcaacctgacaggccctctgccactgccaccaccatagaccccaccagagttgccccaagctggggagggaacaaaaacacctgagctcaccccagggctgtggttcccagcttgggagtgtggagctgaaatatgtcgttggtactcaagtgaaaagaggagcctacaatgtcagatcatggataggagtgagtttcatggactcatgggctgccataggagtggggcctgccttcttccacaagggcagcccagaagaggtggggcctataaccatgctgtggactctgcttgagggaaccccacatcctggaatacctaacaaaataaatatggtctcagtgccagtgattggagggtgcaccctcaaagcccagtagtgtacccagagaggaggttacctctctcaccactgcaccaaataccagagctgaaaacactatgaactacaaaggagccatgcactaagagcctatctgttaccaaaaagggatctcaatccagaccccaagagagggatcttggatctcaggcaagaaagaattcaaggtgaatagataaagtgaaagcaaatttattaagaaagtgaaggaataaagaatggctattccataggcagagcagcagcatgggctgatcaactaagtatacttaaagttatttcttgattatatgctaaacagggggtggattactcatgagttttctgggaaagaggtggacaattcctggaactgagtgtttctcctctttttagagaatatagggtaactccctaacattgtcatggcatttgtaaattgtcacggcactggtgggagtgtcttttaggatgctactgcattataatcagcatataatgagcagtgaggatgatcagagtcgctgaaggagtgttaaacatggaatcaaaggaatgacatctgctaccacaaaaacacacttaagcacataaagcaagcactataaagcaaccacacaatcaagtctacataacaaccagctaacacaatgataggatcaaaatctcacatatcagtactaacccagaataataaatgggctaaacacccctcttaaaagatgtagagtggcgagctggataaaagacaggatgcaaccatttcttagtttcaagagcccaatctcacatataatgacacaaccagactcagagaaaaagggtgaagaaagatggactgtgaaaaaaaaaagagttactattattgtatcagataaaacatattttaaaccaataaaaaacaaagacaaagaaggaaatgcataacattaaggggtacaatccaacaagaaaacttacctgtcttaaatgtatattcacccaacatttgagaaccgagatttaaaaagcaagttctttttggtctacagaaagacttagacaaccatatagcaacagtggaagaaatcaacaccccactgacagcataagacagaggtcatcaaggtataaaactaacaaagaactctagatttaatcttgacacatgactcattggacctaacagacatctgcagaacactccacccaacaaccacagaatatacatccttttcatctgcacacagtacatattctaagatcaatcacatgcttggtcataaagcaagtctcaatgaattcaaaaaagctgaaatcataccaagcacaatctcaaacaaggtgcaataaaaatagaaatcagtatcaagaaggtctctcaaaactacacaaacacatagaaattaagcaacttctacatagctcctgggtaaatatcaaaattaaggcagaaattaaaaaattctttgaaactaatgaaaatatggaaacaatttacaaaaatctctgagacacagctaaagcagcattaagaggaatgtttatagtgctaagcacattcatcaagaagttagaaatatgcaaattaacagtctaactttgcacctataggaatttttttttattatactttaagttttagggcacacgtgcacaacatgcaggtttgttacacatgtatacatgcgccatgttggtgtgctgcacccattcactcatcatttaacattaggtatatcccctaatgctatccctcccccctccccccaccccacaacagtccccggtgtgtgatgttccccttcctgtgtccatgtgttctcattgttcaattcccacctatgagtgagaacatgcggtgtttgtttttttgtccttgcgatagtttgctgagaatgatggtttccagcttcatccatgtccctacaaaggacatgaacacatcattttttatggctgcatagtattccatggtgtatatgtgccacattttcttaatccaccctatcattgatggatatttgggtttgttccaagtctttgctattgtgaatagtgccgcaataaacatacgtgtgcgtgtgtctttataccagcatgatttataatccttttggaatacacccagtaatgggatggctgggtcaaaggatatttctagttctagatccctgaggaatcgccacactgacttccacaatggttgaacgagtttacagtcccaccaacagtgtaaaagtgttcctatttctccacctcctctccagcacctgttgtttcctgacttttcaatgatcgccattctaactggagtgagatggtatcccatggtggttttgatttgcgtttctctgatggccagtgatgatgagcattttttcatgtgtcttttggctaaataaatatcttcttttgagaagtgtctgttcatatcctttgcccacttattgatggggttgtttgacgttttcttgtaaatttgtttgagttcattgtagattctggatattagccctttgtcagatgagtacattgcaaaaattttctcccattccgtaggttgcctgttcactctgatggtagtttcttttgctgtgcagaagctcttgagtttaattagatcccatttgtcaattttggcttttgtcgccattgcttttggtgttttagacttgaagtccttccccatgcctatgtcctgaatggtattgcctaggttttcttccagggtttttatggttttaggtctaacacttaagtctttaatccatcttgaattaatttttgtataaggtgtaaggaagggatccagtttcagctttctacatatggctagccagttttcccagcaccacttatgaaatagggaatcctttccccatttcttgtttttttcagatttgtcaaagattagatagttgtagatatgtggaattatttctgagggctctgttctgttccattggtctatcactctgttttggtaccagtactgtgctattttggttactgtacccttgtagtatagtttgaagtcaggtagcgtgatgcctccagctttgttcttttggcttaagattgacatggcaatgcaggctcttgtttgattccatatgaactttaaagtagttttttccaattctgtgaagaaagtcattggtagcttgatggggatggcattgaatatataaattatcttgggcagtatggccattttcatgatattgattcttcctacccatgagcatggaatgttcttccatttgtttgtatcctcttttatttcattgagcagtggtttgtagttgtccttgaagaagtgcttcacgtcccttgtaagttggattcctaggtattttattctctttgaagcaattgtgaatgggagttcactcatgatttggctctctgtctgttattggtgtataagaatgcttgtgatttttgcacattgattttatatcctgagactttgctgaagttgcctatcagcttaaggagattttgggctgagatgatggggttttctagatacacaatcatgtcgtctgcaaacggacaatttgacttcttcttttcctaactgaatacgctttatttccttctcctgcctgattgccctggccagaacttccaacactacgctgaataggagtggtgagagagggcatccctgtcttgtgccagtattcaaagggaatgcttccagtttttgcccattcagtatgatattggctgtgcgtttggcatagatagctcttattattttcagatatgtcccatcaatacctaatttatcgagagtttttagcatgaagcgttgttgaattttgtcaaaggccttttctgcatctactgagataatcatgtggtttttgtcattggttctgtttatatgctggattacgtttattgatttgtgtatgttgaaccagccttgcatcccagggatgaagcccacttgatcatggtggataagctttttgatgtgctgctggattcagtttgctagtattttattgaggacttttgtatcaatgttcatcagggacattgatctaaaattctctttttttgttgtgtctctgccaggcttttgtatcaggatgatgctggcctcataaaacgagttagggaggattccctctttttctattgattggaatagtttcagaaggaatggtaccagttcctccttgtacctctggtagaatttggctgtgaatccatctggtcctggactttttttggttggtaagctattaattattgccttaatttcagagcctgttattggcctattcagggattcaactaattcctggtttagtcttgggagggtgtatgtgtcgaggaatttatccatttcttctagattttctagtttatttgcgtagaggtgtttatagtattctctgatgattctgattcttctctcttttcttctttattagtcttgctagcggtctatcaattttgttgatcttttcaaaaacccagctcctggattcattgatttctagaagggttttttgtgtctttatttccttcagttatgctctgatcttagttatttctttccttctgctggcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctccttggtttcaaagaacatctttatttctgccttcatttcgttatgtacccagtagtcattcaggagcaggttgttcagtttccatgtagttgagcggttttgagtgagtttctttatcctgcgttctagtttgattgcactgtggtctgagagatagtttgttataatttctgttcttttacatttgctgaggagtgctttactcccaactatgtggtcaattttggaataagtgtggtgtggtgctgaaaagaatgcatattctgttgatttggggtggagagttctgtagatgtctactaggtctgcttggtgcagagctgagttcaattcctggatatccttgttaactttctgtctcgttgacctgtctaatgttgacagtggggtgttaaagtctcccattattattttgtgggagtctgtctctttgtaggtccctgaggacttgctttatgaatctgggtgctcctgtattgggtgcatatatatttaggagagtcagcccttcttgttgaattgatccctttaccattatgtaatggccttctttgtctcttttgatctttgttggtttaaagtctgttttatctgagactaggattgcaacccctgcctttttttgttttccatttcttggtagatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaggttaatattgctatgtgtgaatctgatcctgtcattatgatgttagctggttattttgctcaatagttgatgcagtttcttcctagtcttgatgatctttacaatttgggatgtttttgtaggggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaaaaatgttgaatattggccccaactctcttctggcttgtagagtttctgccaagagatcagctgttagtctgatgggcttccctttgtgggtaaccttacctttctctctggctgcccttaacattttttccttcatttcaactttggtgaatctgacaattttttgtcttggaattgctcttctcaaggagtatctttgtagcattgtctgtatttcctgaatttgaatgttggcctgccttgctagattggggaagttatcctggataatatcctgcagagtgttttccaacttggttccattctccctgtcactttcaggtacaccaatcagacatagatttggtcttttcacgtaatcccagatttcatggaggctttcttcatttctttttttcttttttctctaaacttctcacttcatttcattcattccatcttccatcactgataccctttcttccagttgattgaatcaacactcaggcttgtgcattcatcatgtagttctcatgctgtggttttcagctccatcaggtcctttaacgacttctctgcattggttattctaattagctgttcgtctaatcttttttcaagttttttaacttctttgccatgggtttgaacttcctcctttagcttggagtagtttgatcatctgaagcattcttctctccacttgccaaagtcattctccatctagctttgttccgttgctggtgaggagctgcattcctttggagtaggagaggggctctgatttttagaatttccagtttttctgctctgttttttccccatctttgtggttttatctacctttggtctttgatgatggtgacatacagatggggttttggtgtggatttcctttctgtttgttagttttccttctaacagtcaggaccctcagctgcaggtctgttggagtttgctggaggtccactccagaccctgtttgcctggatatcagcagcggaggctgcagaacagcagatattggtgaacagcaaatgttgctgcttgatcgttcctctggaagttttgtctcagaggaatacccagccatgtgagttgtcagtctgccccttactgggaggtgcctcccagttaggctactcaggggtcagggacccacttgaggaggcagtctgtctgttctcagatctcaagctgcatgctgggagaaccactactctcttcaatgctgtcagacagggacatttaagtctgcagaggtttctgctgccttttgtttggctatgccctgtccccagaggtggaatctacggaggcagtcaggcctccttgagctgcggtgacctccacccagtttgagcttcctggctgctttgtttacctactcaagcctcagcaatggtgggcacccctcaccctgctttgctgctgccttgcagtttgatctcagactgctgtgctagcaatgagtgaggctccatgggcatagggccctctgagccatgcacgggatataatctcctggtgtgccatttggtacgaacatttgaaaagtgcagtattagggtgggagtgacccaattttccagatgccatctgtcacccctttctttgactaggaaagggaattccctgacctcttgggcttcctggttgaggcaatgcctcttcctgcttcagtaatgcttcgtgcgctgcacgcactgtcctgcacccactgtctgacactccccagtgagatgaacctggcacttcagttggaaatgcagaaactactcgtcttctgtgtcactcatgttgggagctgtagactggagttgttcctatttggccatcttggctccagcacctataggaatttttaaaaaccaaaagctaaaagtaaaaaataaccaaaattagagaactgaatgcaactgagatgcaaaaacaaatacaaaaatcaaagaaatcaagagttggttcttataaaaagaaaaaaaagatcatataccactgcctagagcaacagagaaaaagaagattcacataagtacaatcagaaatgacaaagatgacattacaacctgtcacagagaagtacaaaagattttcagagaatattatgaagaactctgtgcacacaaattaagcaatgtggaggaaatgcacaaatttctgacagcacacaatcttccaatattgaatcaggaagttgtagagagtcttaatagaccaatatagagctctgaaatagaatcaggaccaaaaaaacctaccaatcaaataaaaccctggaccagatggattcacagctgaattctaagagaagtacaaacaaatgatgctaattgtactgaaactattccaaaatcttgaggaggagggactcctccttaactcattctatgaagccagcatcaacttaatatcaagatcaggggaaaacacagtggaaaaagaaatcttcaggttaacatcattgataaatatagacatgaaatttctaaaaaaaaaaaaaaaaagagtgacaaactgaatttaggagcacattaaagttaattcaccataatcaagtaggccttattttgggatggaaggctggttcaacacatgcaaaccaataaattcagttcactacataaatggaattaaaacaaaaaccaaatgattgtctcagaagatggaggagaagcttttgataaagtctaacttcacccaataataaaaagcctcagtagactaggcattgaaagaagatacctcaaaataataagattcacctatgaaaaacccacagcgaaaatcatacttaatggtcaaaagctggaaccattcatttcccttgaaaactggaacaagacacggatggccccactcatgatttctattcaacacagtactgaaatcctagccaaagcaatcaggcaagaggagagaaaagacatccaagtagtaaaagaagaagtcaaagtatctctcttgcttgacaatataattctgtatctgaaaaagccccaaggctctgtcaaaaggctagtagaactgataagtgattttagtgaggttttgggatttaaaaaatcagtgtagaaaaatcagtagcacttctatacaccaataatgtctaggctgagagctaaataaaaaacaccattttatttacaatagctacaaagaataattaaatacttacgtatatagctaaccaagaaggtgaaagttctctacgaagagaactacaaaacactgctgaaacaaatcagagatgacacaaatacattgaaaaaaattccatgtcaatggattggaagaataaatattaataaaatggcaatactgaccaaagcaatttacagattctgtgctattcttatcaaactatcaacatcattctttatagaagtaggaaaaaaaagattctaaaagttacaagggacaaaaaagggcttgaacagccaaagccatcccaagtaaaaagaacaaagttggaggaaccaaactacccaacttcaaactacactgcaaagctattataacccaaacagcatggtattagtacaaaatcagacacatagaccaatggaaggcaatagaaacctcagaaataaaaccacacactagcaaccatctgttcattgacaacctcataacaactagcagtgaggaaaaaaaattgtcagtaaatagttctgggataactggttagccacaggtgggagatagaaattgggccctactttttatcatatacaaaaaattaattcaaaatggttcaaaaatctaaatgtaagacctcaaactacaaaattgctagaaaacaacctaggaaatacccttcttaacactggctttaaaaaagcacaaagctgagggtatcacactacctgacttcaaactatactacaaggctacagtaaccaaaacagcatggtactggtactagaacagacacatagaccaatggaacgaaacagagaactcagaaataagactgcacacctacaaccatctgatcttgtacaaacctgacaaaaacaaccaatgaggaaaccattctctatttaataaattgtgcttgaagaactagtcattggcagaaaattgaaactggaccccttttttacaccatatacaaaaattaactcaagatagattaaagccttaattgtaaaaccaaaaacaataaaaattccagaataaaatctaggtaataccattcaagttttcatgaaaaaaacaccaaaagcaattgcaacaaaagaaaaatttgacaaatgggatctaaataaatgaaagagcttctgcacagcaaaagaaactatcatcagcatgaacagacaacctacaaaatggagagaatttttgcaatctatgcatctgacaaaggtctaatatccagagtctaagaggaacataaacaaatttacaagaaaaaaacaaccccgttaaatagtgggctaaggatatgagcagacgcttctcaaaggaagatgttcatgtggccaacaaacatgaaaaaaaagttcaacatcacagatcattagagaaatgccattcaaaaccacaatgagatactacctcctgccagtcagaatggtagttattaaaaagtcaagaaaccacagatgctggtgaggctgcagggaaaaagtaatgcttttacactgctggtgacagtatgaattatttcaaccattattgaagacagataaggaagcagaaataccatttgacccagcaatccattactgagtatatacctaaaggaatataaatcattctattataaagatacatgcacgtgtatgttcattgcagcactattcccaatagcaaagacatggactcaacccaaatgtccatcaatgatagactggataaagaacatgtggtacatatacaccatggaatactatgtagccataaaaagtaatgaaatcatgtcctttgcagggacatggatggagctggaagttgttatcctcagcaaactaatccaggaacagaaaaccacacaccacatgttctcacttttaagtgggagctgaatgatgagaacacatgaacatatggggggaacaacacacactggggcctgttgggtgttggggagatgaattgcatcatgaagaatagctagtgggtgctgggcttaatacctaggtgatgagttgatctgtgcagcagaccaccatggtcatgtatcctggaacttaaaataaaagttgatgaaaaaaactagaaaaatttgcagattctataaaactgactaaaaaatagatgctattacacaatatacccatgtaacaacctgcacctgtactccctatatttaaaataaaagttaaaattaaaaaataaaattggctttgacaaaaaatttttgcccaagcccccaaaagcaattgcatcagaaacagaaaatagacaagtgagaactaattaaaataaagagctacacagcaaaggaaactatccacagagtaaatagacaacatagagaatgaaagaaaatattcacaaactatgcattcctacaaagtcctattgtccagaatctatagatgacaaatcaacaagaaaaaacaaacaaccccattaaaaattgaaattgacatgaacagacacttctcaaaagaagacatacaagcagccaaaaacttatcaaaaaattctcaatatcactaatcatcagagaaatgcaaatgaaaaccaaaatgagacaccgtctcacaccagtcaaaatggccattagaaaaagttaaaaagcaacaagatgttcatgaagctggatatgaaatgaaatgcttatacactgtttgtgataatgtaaattagttcagccactttggatagcagtttggagattcctcaagaaaattaaaacagaattaccatttgatccagaaattccattactaagtacatacccaaagaaaaatagatcattataccaaaaggacacgtgtacttgtaccttcattgctacactattcacaatagcagagacatgggatgaacctaggtgtccatcagtggtcaattgaataaagcaaatgtggtacatatgcaccatggaatattatgcatcagtaacaacaaatgaaatcatgtcattagcagcaacatggatggaggtggaaggcataagcaaactaacacaggtgcaggaaactaaacactacatgttctcatttataagtgaaagttacagataaagcacacatgtacataaacatgggaaaaatagacattgtattctactagaagtgggatagaggaaaggggatgtgggttgaaaaactacctattgtgtactatgctcactacctgagtacaatataccctatgtcacaaacctttatgtgtagcccctgtatcctacataaaagttaaaattattttttaaaatgaaataaaaaaatctaagcattaacataaaaattatggaaaaaagaggaaaccaacaaaaaacaagcaaaaaaaaagaaaattacataaattactccaaaaaaatattaaatagagatcatagaaacattgaaattgattgaacttaaagtaggctctttgaaaatatctacaaaattgacaatactttagctagactaagaagaaaaataaagaaattataaaagttagaaatcaaaggagatattaccatgggccctttggaaattaaaagtgtgagggaataaatactatgggcaactttatgccaataaactaaacaactttgaaaataggctaacttctacaaaattactactgtaccccaaatgactcaggaattaatataaaataatattataaataataataatattattattattataaataacagagataaaaaagacattttcctagatattaaaaatctcagcccaaagaaaagtcaaagactatatgttttcactggtgacttttatgaaatatgtaaagaaacaattccattactcaacaaacttttttcaaaaatacatgagtacagaatatttctcaactctttttatgaggccaatatcatcctgacaccaaagccagactaaggcatgtcaaaggagaactacacttcaatatccttcattaatagagatgacaatctttaacaaaatacaacagtgtgtaaagaaaataacacatcagtatataaagggatttaaatagtatatacagaaaataatacatcattgtcaagttatattaattatagtaatgcatggttgcattaattgcctcaaatttaattaataaaacatgacaccttaatactacacagcaaaaatattaaatgagcatcttaatagatgcagagaagacataagacaaaatacagtacccattcattataaaatctcttagcaagcttggaatatcaggaaagactctctacttgataaaagacattagtaaacaacacatgaagtattatattaaatggttgtcttagtccattttctttttttttcagggattataaatctatagttttattaagacaaaaactgacagtgtagtatgaagtttacatttaaacaaagtttacacagaaatctaacacatgcctaaaagaattttacaatgtagctctagatgcaagtctagacaatatcaagaactgatggatctcacgactcaagacagagcattttgggtatgttacttcttaggatttcttaaaaaattgttttgtgtgtgtctgtgtgtgtgtgtgtgtgtgtgtgtgtgtgtgtgtgttttaaagggaaccactgcccaatatgaaagtttaatcttctgagaccaaggcttttgaaatcactaaactcttggatcaattcggtgaaacttgtgctgtcagtgactgaaccctgccaacaatggtttcagtgttcaaagctcaaaaaagagaatggctccaagagttctccccactaaaaatggctccaagagttttccccactaaaagcatgggcccttgtctttccctactgtcttatctcctctaccaccctcttcctcttccctaacacctcagccagtgtcttggatgaacaagctgatatttataacttcgttactggaaaagaaagggtcttctaatttcaggaattagcacctctaagacagaatgatctgcttgtactgtatactctccaataaaagaccttccctccttgtcaatttccatctccaaaatggcaactttggtaacttatgaacaggcttagtcctttgtgggaacagcaataagtttaggcagggaacaccttggcttataggtttcagacattcacagcttttaaacagtctctcacagtccttatttatggtgccaatgacattttttttaaaggtaaaatattctggacatagaagcaaatcattagttgtctgttcttttccattgcttcaccatttcccctatcaggccccaaatgttaatctaaatgatactacccatctccctttctcccctccccatccctccctcccccaaataatacaccagtaatagccaaaaactacacacatgctacactgtaaaaatgcagagttaacgctattgggaagaaggctgtgtgttgtggagatgctctttgaagatctacagtatttttttgctctcccacacacccaattctgcaagttttgtccttcatagaaggccctttgctttttacagcaaagtgcaggaaaggttgccttgaaacatcccctttcccctccactgggatgggtgtgcaaactatacagcttgaaacggctttaaagcacttgggctgctccagggcacagaaactatactggctcttcaaaggacatcttctcaagccacctctatggtgtcaagacaagtcgaactccttcccttcccacttgaaacccacagtcagatgtgacaggggctggtactcaagagcgttaattcttgtcattttttttgtcatcatcctccgagggttaggaatgccatgtcagcctttcctcatagaaggatatgacaacctgtgggcacttgacactggcttccttggcagggaccaggtcagcctcatgagtttttccatttcatcaggaacatgacctctccactggagtctgtagctccaataatccgctctggctccaaacctcgagcaaagcctcgtggcttttctgactcttctttcttcccctttggtttgctctcctctcccttatcttcagaatcagaatcagctttgtgcttgcctccctctgatttatctgtctcatgtgctgttttctgtgactgcagaaactcagcaatgaggtcgaggcaatccaggttctcttctggctcccatgtgttatcctcatctgagaatcccttccactttaggaggtactccactttgtcctttaccactccacggtcgagaaatttttccaccacatattccttttcctcctcttctagcacttcctccactttcttcttgtttagtttttttccccatagtgcccgccaggtttctggtgtaaagggtgacgctgctcagagcagcgcccaagagcccgagaggaatcagtgctgtgctactggcgtgtcacgtcgagtcacctgggggagtggcgccccggaaggcagcaagccgggtggccacagtggagtccctcactgaagcggcataccgcaggccccagccaatggccctcccctcagccgaacctgtcttagtccattttctatgctataactgaatacctatgacttggtaatttataaagaaaataagttcatttagcttatggttctggaggctgggaactccaagagccatggtgttgatatctggtgagggccttccagctgtgttgtgatatggtgaaaggcaccacatggaaagagagcaagaatgtccatgtcagttcagtttctctttctgttctcacaaaggcaccagttccatcatgaaggcctcaccctgacaactgtatttaatactaattacttcccaaaggatctacctccaatcaatatatgaatttgagggttaagtttccatcacaggatatttgtgacatatttcagccattgcgttctaacccacccctcaatatttatgtccttctcacatgcaaaatacactcattctacatcaatagccccaaagtcttaactctttctagcaccaactcaaaagtcctaagctcagagtctcatctgaatcagatatgaatgagactcaattcacaattcatcttgaggcaaatttcttccagctgttagcctgtgaaattaaacaagttatctatttcaaaaataaaatggttggacagacatatgacagatattcctattccaaaaaggaaaatgggcaaagtgaaaataattacgagtctcaagtaagtccaaaccccaacaggaaaaaacacattcagtcttaaagccaaagaataatctcctttgactgcacacatacatcctgtgcacactggtgtgggtgttgtgacctcaaggccttaaggaagccccacacacaccacattgctggactcaccccacaattaagccttcctgagttggctttgcacattaatagctccgtaattctgggatctttgtggtggtgctgctcccaagactccattaggcattatgctagtggggactccctgcaatggccttgctcccatggatcccctaggcattgccttggtgaaggctctctttggtgtcttttcttttgtgacatctcttccttgctcctcaggctgtctgtgacatcctttgaaatcaaaatgaagaaatccatcctccgacagtttttgcattctgcatatcttcagtattagcaccacatagatgctgccaaagtttatgacttgcacctttcagagtagcaggccaaaccacctgaggccatttgagccatagctggggtggctgaacactgctgcatttctgaaatgctgggagcagacacctgagacaattaaagcagggacccatcccctaaataaattctgccctcctagagctctgggcctgtgatgggaggggccacatcaaatatctctgaaatatcttagggttttctcccactattctgatgaatagcccctggcttttttctatccatactaatcttatcaatagttcacttggtcacactcttggtttcctctactaaaaatgctctttcattctccaccatatgactaggctgcaaattttctaattctttctactatgctttcttttaaaattataaattctgtttttatattatctttttcctctcttattttatataagcagttaaaagtagccatacagcagactgaatgctttgctacttagatatttctttcaccagatatgctagcttcactcttttttctgccttctataaagaaatcagagatgacacaagcaaatggaaaaatttcatgctcatggataggaagaatcaatattaaaatggccaaactgcccaatgctatttacagattcaatgctatccctaacaaactataagtgacattcttcacagaactagaaaaaaactattttaaaattcatatggaacccaaaatgctcaagtagccaaggcaatcttaagcaaatagaacaaagctggaagtatcacattacctaacttcaaactatactagggggctacactagccaaaacagcatggtactggaacagaaacagacacatagaccaatgaaacagaacagagagccaaaaaataagaccacacctgcaaccacctgatctttgacaaaggtgacaaaaagaagcaatggggaaatgactctctattcaataaatggtgctgggatgactggttagccatatgcagaaaattgaaacttggccccttccttacaccatatacaaaattaaactcaagatggataaaagacttacatgtaaaatccaaaaggataaaaactttgggatgcaacctaggcaatactattctggacataggcgctagcaaatatttcatgactaagacaccaattgcaccaaaagcagaaaaatgggatctattttaagtaaagggcttcttcagagaagagtatcagtagagtaaagagacaacatacagaatcagataaaacatttgcaaactatgcatctgacaaagttctaatattcagcatccataagaaacaaatatgtttacaagaaaaaaaacacagaaccccattaaaaaatggtcaaaagccatgaacagttttcaaaaaggacatacatgtgaccaacaagcatgtgaaaaaaaagttcaatatcactaatcattaaagaaacaaatatcaaaaccacaatgagatgccatctcacactagtcagaatggctattttttgtgtgtaccactggaaggccagttaatgtaattttacttatttatttttaatctcaatagttttggggaaacaggtggtgtttggatacaagaataacttatttactggcgatttctgagattttggtgcacccatcacccgagtagtgaacattgtacccaatgtgtagtcttttatccttcaccccctcccacccttttccctgagtccccaaagaccattgtatcattcttatggctttgtgtcctcatagcttaactcccacttatgaatgagaacaatgtttggttctccattcctgagctacttcactgagaataatggtctccaaattgctgctaatgccattatttcattctttttatggctgagtagtattccacggcatatatatatatgcacacacacacacatatatacatatatatacacacacatatatacatatatataccacattttctttatttactcattgattgatgggcatttggattggttccatatttttacaatttagaaatgtgctgcaataaacatgcatgtgaaaatatcttttttgaaaagtgacttcttttcctctggatagatacccaggagtgggattgctggatcaaatggtacatctacttttaattctttaaggaaacttcacactgttttccacagcggttttactagtttacattcccaccagcagtgtaaaagtgttccctttacatgacatccatgtcaacatctaatttttttttaatatgcccattcttgtaggaattaggtggtatggcattatggttttgatttgcatttccctgataatcagtgatgttgagcattttttgaatatgtttgttggccatttgtatatcctcttttgagaattgtctatttatgtccttagcacactttttgatgaaataattttttttcttgctgatttgtttgaattccttatagattctggatgttcatcctttgtcagatgcatagtttgcaaagattttctccactctgggggttgtctgtgtactttactgattatttctttagctgtgcagaagatttttagtttaattaagtcccatatatttatgtttgcgttgcaattgctttggtgtacttggtcatgaagtctttgcctaacccaatgtctagaagagttttttcaatgttatcttctagaatttttatggttttaggtcttacatttaagtctttgatccatcttgagttgattttttttataaggtgacagaggaggatccagttttatttttctacatgagggttgccaattataccgcaccatttgtcgaatagggtgtcctttctcactttatgtttttgtttttgtttgctttgtcaaagatctgttggctgtatatatttgtatatatttggctatatttctgggttttctattttagtccattggtgcatctgccttttttttttttttttttttgagacggagtcttgctctgtcgcccaggttggagtgcagtggcgtgatctcagctcactgcaagctccgcctcccgggttcacgccattctcctgcctcagcctccggggtagcttgggactacaggcgcctgccacgacgccccgctaattttttgtatttttcagtagagacgggatttcaccgtgttagccaggatggtcttgatctcctgaccttgtgatcctcccgcctcagcctcccaaagtgctgggattacaggcacgagccaccacgcccggccgcatctgcctatttttctagcagtaccatgctgttttggtgactacagacttgtactataatttgaatcataatgtgatgcctccagatttttttttctttgtcttgctttggctagttttggttccatatgaattttaggactgagttttctagttctgtgaagaatgatggtcgtattttgatgggagttgaattgaaattgtagactgcttttggaagtatggttattttcacaatattgattcctcccatccatgagcatgggatgtgttttcatttgtttgcattctctatgatttctttcagcagggttttagagttttccttgtagagatctttcacttcctgggttaggtatatttctaagtattttcttttcttttcttttctttttttttttgcagctattgtaaaatggattgagttcttgattttattctcagcttggtagctgttgctgtatagcagtactactgatttgtgtacattaattttgcatccagaaattttgctaaattcatttatcagttcttggagttttttggatgagtcttcgggttttctaggtatatgatcatatcatcagcaaacagtgacaggttgacttcctctttactgatttggatgccctttatttctttctcttgtctgactgctctggctaggatttccagtactctgttgaatagaagtggtgaaagtgggtatccttgtcttgatccaattctcagggggaatgctttcaacttttccttgttcagtataatgttggctgtgggtttgtcatagatgggttatattacctttaagtatgtcccttctatgctgattttgccgagcgttttaattataaacagatgctgaattttgtcaaattttttttaatctattgagatgatcatgtgatttttgtttgtaattctgtttatatggtttatcacatttattgacttgtgtatgttaaaccatccctgcatccctgttatgaaaccaacttgatcatggtggattatctttttgatatgctgttggatttggttagctatattttgttgagaatgtttgcatctatgttcatcatggatattgatctgtagttttctttttctgttatgtcttttcctggttttggtattagggtgacactggcttcatagaatgatttaggaagaaattcctctttatcttttggaatagtgtcaatagaattggtaccaattcttctttgaatgtctgatagaattcagctgtgaatctgtctggtcctggacttttttgttggcatttttttttattaccatttcaatcccactgcttgttgttggtctgttcagagattctatttcttcctggtttaatctaggagggttgtgtattaccaggatttatccatatcttctatattttctagtttgtatgcataaaggtgttcatgtggtatcagttgtaatatttccattttcacttctaattgagcttatttgggtcttttctcttcttttcttggttaatctcactaatgatctatcaatttcatttatctttccaaggaaccagcttttttaaatttattttttgtattttttaaattccagtttcatttagttctgctctgatctttgttatttctttccttctgctgggtttgggtttgatttgttcctgtttatctagttccttgagtggtatcttagattgcctatgtgtgctctttcataatttttaatgtaggcatttaaggctatgaactttcctctttgcataacctttgctgtatcccagagcttttgattggttgtgtcactattatcattcagttctaagaattttttaaatttccatcttgatttcattattaacccaatgatcattcaggagcaggttatttaattttcatgtttttgcatggttttgagtgttcctttggagttgatttccagttttattccactgatgtctgaaagagtacttggtatagttttaattttaattttcttaaatgtattgagacttattttgtggcccacaatatggtctatcttagagaatgttccatgtgctgctgaatagaatgtatattctacagttgttgagtgtaatgttctgtaaatatctgttaagtctatttgttctagggtatagtttaaatccattgtttctttgttgattttctgtcttgatgagctatctagtgctgtcagtggccataccaccctgaacacactcgatctcatcagaatggctattaataaaaagtcaaaaaaaaaaaaaacagattctagtgagtttgcagagaaacagaaatgtgtatacactcttagtgggagtgtaaattagttcagccattgtagaagcagcatggcacgtatacaccatggaatactatgcagccataaaaaaggatgagttcatgtcctttgtagggacatggatgaagctggaaaccatcattctcagcaaactatcacagggacagaaaaccaaacactgcatgctctcactcataggtgggaattgaacaatgagaacacttggacacaggaaggggaacatcacacacttgggcctgtcatggggtggtgggaggggggagggatagcattaggagatatacctaatgtaaatgacgagttaatgggtgcagtacaccaacatggcacatgtatacatatgtaacaaacctgcacgttgtgcacatgtaccctagaacttaaagtataatttaaaaatgcataagataaaaaaattgaaaaagaaataaaataaaataaaaagaaagtagcatggcaatttctcaaagagctaaaaccagaactattatttgtcattgcagcactattcacaatagtaaagacatggaatcaacttaaatgcccatctattgtagaccagataaagaaaacgcgttacatatacaccatgaaatactatgcagccataaaaagaatgaaataatttcctttgcaggaagaggaatggaactggaggccatgatttttagcaaagtaatccagaaacagaaaagcaaataccatgtgatcccaattataagtgggaggcaaataatgagaatgcaataacccaaagaggggagcaacagatactagggtctccttgaaggaggagggagagaattaggaaaaataaacattgagtactagacttggtacttgggtgataatccttataagaaacacccatgacatgaacttacctatataggaaaccagttcatgtacttctaaacctaaaattaaaaattaaaaaataagaaagtaaactccacaacacataaaaagatcatcactataatcaagtaagatttattccaggaatgcaagtatgtccaacatgtgtgaatcaataaatgatacatcatattaaaataataaaggacaaaaattatatgatcatgtcaatagatgcagaaaaagcatttgacaacattcatccttcttcatgataaaaaattactcaacatattatgtgtagaagaaatgtacatgaacataatgtgaaggccatatactacaaattgacagttaatttcatattgaatggggaaaagttgaaatcctttcctctaagaactggaacaaggcaaggatttccactttcaatacttctatttaatataataatagaagtcctaagcagagtaattaggcaagcataaaaaggcattcaaattgcaaagaagaattaaattatcattgtttgcttatgatatgcccttacgcatacaaaatcctaaacacttcactgaaaagctgttagaccaacaaataaattcagtaaatttgcagattataaaatcaacatacaaaaattagtagaatttctatatgctgatagcaaattatctgaaaagaaatcaataaattcttccaatttacaaatacaataaagcaaaatgcctaggaataaatttaaccaagtaggttaaatattgatgcagttaaaactctacaacactaatgaaaaaattgaaaaatgtacaaataaatgtctaccttatgttcatgcattggaagaactaatattgttaaaatgttcacactacctaaaaagatttacagatttaatgaatccctatctaaacaccaatgccattcttcatagaaatagaaaacaatcttctgaaattaatatgaaaccacaaaagtccttaaatagccaaatcaattttaataacaaccaaaaaagttaatggccttatactacagcctgacttcatagtatactgcaaaaatacagcaaagcaaagagcattgcattgacataaaataaggcatatggacaagtggaaaagaatagaaagaccagaaataaattcacacagtttacaccaactgatgtttgacaaaggtgccaagaacatgttatggggaaaggacagtctcttcaacaaatggtgttgagaaaactagatatctacatagagaagaataaaattaaaccattatatttcagaatctacaaaaattaactcagaatgtattaaagacttaaatgtaagatctaaaactatgaaacttccagaagaaaacataggggaaatgttttatgacttttgtatgggcaaattttttttgataaaacctcaaaagcactggtaacaaatgcaaaaatagacaaatggaaccatatcaaaataaaatcttcactgtaacaaaagaaccaatcaggagagtgaagagacaacctaccaaataagaaaaaatgtttgcaaacaatttatccagcaatatactaatatccagaatatacaaggaactcaaataactcaataggaaaaaacaaacaagtaaataacctgatgtaaaaatgaaaaaaaaatctgaataaaaatttctcaataaaagacatacaaatgaagaacaggtatgtcaaaaaaatgttcaacatcactgatcatctgagaaattcaaataaaaacctcagttaaatatcacctcatcccagttataatgatcattatcaaatagacaatataaacctactaatgagaatgtggagcaaagaggactcatacagtatgaacatctctcaaataattaaaaataaaactaccatattgtccagcaatcccactactaggtatatattgaaaggaattaaaatcagtgggtcaagtaaatagctgccatctcatgtttatcccagcactatcacaatagtcaaaatataaaatcattcattaatcgaatatattttgtcattctacaatttacatttacttaaaaactatgttgtacacggtaaaagcatacaacattatctgtaaatttgtaaaataaaagtaagtacactaagtaatattaccaatgttactaaaaattctctttggttttacaaattttaatttacattatcatgacacatgagttaagccagtttgagtttgttgtaacgacagaaaaaagtgataaatatgatttgccttatttctttaaaaggctggaaacacatgtattactcagggttctctagagggacagaactaattatatatatatatatatatgtacacacacacacagttttatatatatatagttttatatatatatatatacacatatatatatatatatagtttattaagccttaactcacatgatcacaaggtcccacaataggccatctggaagctaagaagcaaggagagccagtcggagtcccaaaactgaagaacttggagtccgatgtttgagggcaggaagcatccagcatgggaaaaaaatgtaggctgtgaggttaggctagtctagtcttttcacatgtttctgcctgttttaacttctagccacactggcagctgattagatggtacccacgaagattatgggtgggtctgcctttcccagcccactgattcaaattttaatctcctttggcaataccctcacagatacacccagggtcaatattttgtatccttcaatcaaataaagttgaaactcagtataatcatcacaaatccaccccttgtcaacttgaacccatacacatctcctgagaccctcaaataaagacaataatgtcataattatgcctaacataatacaactatcctttgtacaactggaaactcaccaatccccaacacaactactatcacataaagttaataaaacttaaatgcttatatgaagtcaataaatcttatgtcacatgataaagaaaaaggaagtaaaatgatttttttagtacaagtgtatacatgcacaaacatgtttttaacaaaagaaggagaaaatactcatgacaattacagtctcgtttctgcagctgggttacgttgtcgtagctggtattgatgactaccttcttctactacccattctgtattcccttttccttcagcaagcatctcagcaggtcatgtttttttcccctggtggagtgacccaagcctttattcctgaaggatatgggccatttgtagttctgttggattgggcttgttgtagtttcccattgaccttagtcacacggaatggtaacactaaaagacaccctaatgaatctcctgcattccatgcgtactcttttttacctctgttgtggaatagtagactggtttcatcttgataatctcggtcaatcaccccagtcaacactttaactcccttcttggcctgttgacttaaaggcaggaggagcccaaagtgtccatgtggcaatcttggcttccagtttaatggaatcattgtgtctcctggtggcagccttcctccctctggaactaagacctctaggccagcagaaagtaatgtcacaggaataggaagcaaaaattttgctagtagatcactaggaatgatggtgagtggtgccacttccacttccatcccttgattcttggacccgtgaatcctggctatgggagaaacagtaccatatattggacgcttattcagagcatacatagccttctggagaactttgccccagccctggaaagtattgtcatctagttggcattgtaattgtgacttcaaaaggccattccaccattccaccaatccattctcatgatggggaacatggtaaggccagtgaatttcatgaggaggagcccactgctgcacttctttagccataaagtgagtgtcttggtcagaggcaatgctgtgtggagtaccaggacgatggataaggcattccgtgagtccacagatggtagtcttggcagaagcatttcatgcaggataggcaaacccataactggagtaagtgtctattccagtgaggacaaacctctgccctttccacaatggaagagtccaatataatcaacctgccaccaggtagctggctaatcactctgagaggtgctgccatatagaagtttcagtgttggtctctgctgctggcaaattgggtactcagtggtggctgtagccaggtcagccttggtgagtggaagtgcatgttgctgagcccatgtgtaacctccatccctgccaccatggccactttttccatgggcccattgggctatggcaggggtggctggggaaagagactgagtcgtgtccacagaacgggtcatcctatccactttattactaaaatcctccgctgctgaggtcacccgttagtgagtagccacatgggatacaaatatcttcaacgtttttgaccattcagagtggtccatttacatgcctcttcctcaaatttctttgtcacccattttccaatcattctccttccaagtccctgaccatccagccaaaccactggctacggcccatgaatcagtctataatcgcacatctggccatcgctccttccatgcaaagtgcacaaccaggtgcactactcgaagttctgcccactgggaagatttcccttcaccactgtccttcagggatgtcctagaaaggggctgtagtgctgcagttgtccactttagggtagtgcctgcatatcatgcagaacaatgtgtgaaacaggccctagtcttttgtcttcctctgtcaactgatcatagggatctccccatgaggccatcggtgcaggctgggggagagaaggcagggttacaggagtgcagaccatgggtatttgagccacttcctcatgtaacttacttgtgccttcaggacctgctcgaacccgatcacgtgtataccactttcatttgatgatggaatgctgctgtgcatggcgcactttatatgtagatgggccagaaagcacccagttcatgacagacagttcaggtcccatggtgacttgacgacccatagtcaaacattcagtttccaccaaagcccagtaacaggccaagagctgtctctcaaaaggagagtagttatctgaagaagttgacagggccttgctttaaaatcccagaggcctccgctgtgattcacttattggagcctgccaaaggatccaaatagcatccctgtccgccactgacacctcaagcaccatttgatctgctgggtcatatggcccaagtggcagaccagcttgcacagcagcctggacctgttgcagagccttctcctgttctggaccccactcaaaactgcagcctgttgggtcactcagtaaatgggccagagtaacacacccaaatgaggaatatgttgccttcaaaatccaaatagatccactaggcactatgactttttcttggttgtaggagggacaaaatgcagtaatttattcttcaccttagaaggaatatcttgacaggccccacaccactggacccctagaaatttcactgaggtacaatgtcccttaattttagtcggatttatttcccatcctctggcacgcaaatatctcaccaataagtccagtgtgtttgctacttcttgctcactggatccaatcagcataatgtcataatgtaatgaaccagtgtgatatcttgtggaagcaaaaagcaatcaagttgtctccaaataagattatgacacaaagccagatagttgatatacccctgaggtaagacagtaaaggtatactgctggccttgccagttgaaggtaaattgcttctagtgggctttgtgaacaggaatggagaaaaaggcatttgccaagtcaatggctgcataccaggtaccaggagatgtgttaatatgctcaagaaatgaaaccacctgctgcatctggtacagcagctgcaattggagtcactacttggttaagcttacgataatccactgtcattctccaagattcatctgtcttctgcacaggtgttctgtgcaggaaacgcacaaggggagaaaatcacacacacagtacctttaagagtaaacaagctgtatctcacgtaaatggcaatgcagatataatacgcaaataatataataagcaaatgatataataagcaaattaatataggcaaattgatatgataagcaaattgcaatggtcggggagaagggaaaagatacatatatatatacatttacactcaccaaactatggaggattcaccaccagattgggaagcaacagcctgggctccagggtcagacaccgcactcaccagactatggaggattcaccaccagactgagaagcaacagcctgggctccagagttggacactcccatatgcacagacgaggtctcatgaagcttcagcatagtctaggaccctagctctttttgtgacaagttgtttggtatgaggcccagtcacaagggcccttgatgactgggctcaaggaacacaaaaaggtcaacttttttttttattattgtctactgttttgcaataactaatataggtttctttgaaacagtgccgaatgaacacctcaaggggctcacaccacctgttccggaagttggtgaccattgtttgtgtccatgttcaattgagttcaaatttaatatttaacttttcttccacaataggccaaatcggagagctgaacggggatgtggtgggaatcacatcccctgcatctttcaagtccttgatggtggcactaatttccacaatccctccagggatgaaatatagtttttgatttaccattttgctagatagaggcagctctaatggcttccatttggcctttcccaccataacaaccctcatcttaccagtcatggagctaatgtgggggttctatcagctgctaagtatgtctatgccaattatgcattctggcactggggaaatgaccacagatgagcctggggactcactggacccactgtaagtcggacctgagctaaaaccccattaattgactgacctccataagcccctactttaactggaggaccacaatgacattatgggtcccctggaatcaacatcagctcagagccagtgtccagtagtccctgaaatgtctgatccctttccccaatgcacagttactctggtaaatcggtagtgtagtggagcctttcctcaaggggtcctggccttcccttcattcaaggggttctgggcgtgtaaactggttcaagttgggaaattgattgaggggccgtgattctgtttttacaattcaaattagtcttttgtccattctacctagaagttttctgcttacataaattaagtaggaatgcagtaggcttcctatcagtttcacttctaggaacaccatgattaattagccaatcccagagctctacatgagtcagactattctgattactgttttttctctagtgtccattatgatagctatgcttaccttgcctttgatggttgagtgctgccacttttcccctgccacctcaggatccaattattcccattgtatttaaattttgtagttgagtgactgtagttccctctgttagatctgaaatatagagaggagcaattacaggtctcttcaaagatacaggtgctgtcctcacaaatctattttgcaaggcattggttgagggtatattctccggaccctcccaactgggatgagtaggtcaaaagtaactaatccaccctagcattccaatctccctaagccttttgatcccttcctctacatttaaccaagggagatcaggcatttccagctcactcacagtgggccatattttaatacatatttcaaccaaccaagcaaataaactgttagaaccttttctaactcctcgagctgcaacattaaatgcagagtccctacttagtgggcccatcaataaattcagcctgatccaactctatgtttcttccaccattatccctcacccttaatatccaaccccatgactgttatccagatttctgtcttatttaaacagaaaaataaagcagttcttttctagtgtattgcactacctcatgggtcacactctcaaactcacctctacaggcctgctggaactttagtctagttataggtctagaatcaaacagtggtgttggaggtggctcctgaggagaatcagcattatcttgcctggcaactgccttagggaggccatcactgttgcctcaggcagcacaggtttcatcttcgcagacaacagtggaaaggctgatggcagcatttgggtcaaggaggggatgttcccactactggggatgggaaagctgttccttctggcaaaaaaggttcatcagagtttacaaatttagtgtccacagcttcatcagggttctcccacatgttcccattccaagttgcagagtctcgttcttttctgatcaatgccctcactttaacagtagacacctggcaaggctgtgcatgcatttttcattgcaggttagccatttgcatgataagagtttgtgtctattttctacaatttcagctcattctctacaggagataagactctcacttggcaatcttagcagatttgaggctcaatatttgcttctgaagctgggagttagaatccctgagtttatcattttctttcatccctttgtccactgaacttaggagcaatgaaccagcttcattatattccttggttcttcacatatggtcaaagttattatgtacagaatcactgaactccttgcctctcacaagcagtaaatcaagaatgttaaatgcatttattttgcataaatctctaaaaagtatgccaaggactatcagtgttttccatactattagaagcacagtccttagcatttttgggtctaacaatattaagcagccaaatccagaaaccccaaaaccaatgaaagaactccacccttaatattctgttcctgtagaaccactcctggtaccaaaatttgtattagtcagggttctctagagggacagaactaataggatatatatatatatatatataaactggatcctgatatatatatatatatatatatctcctattagttatgggtatataatagaatatatctatataatagaatatatatgggagtttcttaggtgttaagtcacatgatcacaaggtcccacaataggctatctgcaagctgaggagcaaggagagccagtctgagccccaaaactaaagaatttggagtccaatgtttgaggccaggaagcatccagcatggaagaaaagtgtaggctgtgaggctaagccagtctagtcttttcacatgttcctgcctgctctatcttctagctgtgctggcagctgattagatggttcccactgagattaagggtgcatctgtttttccaagcccactgactcaaatgttaatctcctttggcaacaccctcacagacacacacaggatcaatactttgcatccttcaatccaatcaagttgacgctcagtattaaccatcacagctcattagcatctcaagatatttcctagaaagtatcaatccctgtagtgactggtaatctagatccctttatattaacattatcaagctaaggtaagggctgaaagtgtttctaatgtagagaaagcatttaaaaattaatatcctctgtggaattatattaaacatgcattttaaattggataaaaattgcaaaacaacattgcaagttttaacagttttcatcattcatatctatgataattaattttaagtgttgacttggctgcattgataaatacttagaaacctggtaaagcattatttcacggtatgtctgtgagggtgttttcagaggagattaacctatgagttgagtagactaggtaaggaacgtccacactcaatgtgagagggcaccatccaatctgctggggatcctgaaataacacaagctgagaagtggtaaatatgtctatccatcttcatcttctatccttgggacaactacatgctttctggccttaggactccaggattcacaccagtggcctcatgggttcccaggctattagcatcagattgagagtgacaccaccagctttcatggttctgaggccttcagacttgaactaagccacactacagcatttcaggaactccaacttgcagatggcctgtcatggaatttctctggctccataatcatatgagctaatttccctaataaaacctcgcatgtatctgtctatctaatatatctatttatttatatctatctgtctatatcccattggctctgcctttctggaaagccctaacacagatttaggtactagaagtgactctagagaaacagaattttaaagattcattttctttaattggttttgggtatctggaactggctctaatctgattaaatttaaaaatactaaggcctcatttataatagtacagaatgcaatgatagcccatggtataaactgtttatagagatacacaaaataaatccatttcgtactactaattcaccatttataagaggcacaaaattagtgactctatacatgatactttttaacatttgcagaaaagaaagaaatataatgatagttggttgctcctagtatcactggacaaagtgataaagaaaatcatgagctcctacaaaaagaactacaaaccacttcttaaaaaaatcagagatgacacgaacaaatggaaaaacatgccatgctcatggttaggaagaatcaatattgttaaaatggccgtattgcccaaagcaattcataaattcaatttttttttattatactttaagttttagggtacatgtgcacattgtgcaggttagttacatatgtatacatgtgccatgctggtgcgctgcacccactaactcgtcatctagcattaggtatatctcccaatgctatccctcccccctgcccccaccccacaacagtccccagactgtgatagtccccttcctgtgtccatgtgatctcattgttcaattcccacctatgagtgagaatatgcggtgtttggttttttgttcttgcgatagtttactgagaatgatgatttccaatttcatccatgtcccgaaactctaaaaagcagagcacctctcctcctccaaaggaacgcagttcctcaccagcaacggaacaaagctggatggagaatgactctgacgagctgagagaagaaggcttcagacgatcaaattactctgagctatgggaggacattcaaaccaaaggcaaagaagttgaaaactttgaaaaaaatttagaagactgtataactagaataaccaatacacagaagtgcttaaaggagctgatggagctgaaaaccaaggctcgagaactacgtgaagaatgcagaagcctcaggagccaatgcgatcaactggaagaaagggtatcagtgatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatagtatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagaggatctcttggcagaaaccctacaagccagaagagagtgggggccaatattcaacattcttaaagaaaaaaattttcaaccgagaatttcatatccagccaaactaagcttcataagcgaaagagaaataaaatcctttacagacaagcaaatgctgagagattttgtcaccaccaggcctgccctaaaagagctcctgaaggaagcactaaatatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaagggttgcaatcctagtctctgataaaacagactttaatccaacaaagatcaaaagagacaaagaaggccattacataatggtaaagggatcaattcaacaagaagagctaactatcctaaatatatacacccaatacaggagcacccagattcataaagcaagtcctgagtgacctataaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacattttttcagcaccataccacacctattccaaaattgaccacatacttggaagtaaagctctcctcagcaaatgtaaaagaacagaaattataacaaactatctctcagaccacagtgcaatcaaactagaagtcaggattaagaatctcactcaaaaccactcaactacatggaattcaatgttattcccattaaattaccactgacattcttcacagaactagagaaaactattttaaaattcatatggaaccaaaaaaaaaaaaaaaaaaagcccaaatagccaaggcaatcctaggagccaccaaccaacatcgtagtatgcctttgttttctgcaaaaagaacaaagctgaaggtgtcacactacccaacttcaaactatgctacagggctacaatgaacaaaacagcatagtacttgaacaagaacagacacatagaccaatggaacagaacagaggacccagaaataagactgcagacctacaactatctgatctttcacaaacccaacaaaaacaagcaatggggaattttttttctatttaataaatggtgctggaataactggctagccatataaagaaaattgaaactggaccccttctttacaccatgtacaataattaactcaagaaggattaaagacttaaatgtaaaactcagaactataaaaaccctggaagacaacctaggcaatatcatttaggacacaggcatgggcaaaaatttcatgattaaagatgccaaaagcaattgcaacagaagcaaaaattgacaaattggatctagtgaaactaaagagcttctgcacagcaaaagaaactaccatcagagtaaacagacaacctacagaatgggaaaaaattttgcacactatgcatctgactaaggtctaataaggaacttaaacaaatgtacaagctaaaaacaaacaaccccattaaaaggtgggcaataatatgaaaagacagttttcaaaagaagacatatatgtggccaataagcatatgaaaaaaagctcaacatcactgatgattagagaaatgcaaatcagaaccgcaatgagataccatcagaatggctattactaaaagtcaaaaataacagatgttgtcaaagttatggagaaaaaggaatgcttatacaccattgtggaagacaatgtggtgattcctcagggacctaaaatcagaaataccaatagacccggcagtcccattactggatatatacccaaaggagtatataaatcgttctattataaagacacttgcatgcgtttgttcattgcagcactattcacaaaagcaaagacatgaaatcaatccaaatgcccaacaatgacagactggataaagaaaacatgatacatataaaccatggaataatatgcagccataaaggaacaaaatcatgtcctttgcatggatggagctagaggtcattatccttagcaaactaacactggaacagaaaactagataccgcatgttctcacttataagtgggagctaaatgatgagaatacatggatgcatagaggggaaaaacacaaactggggcctattagagggtggacggcgggaggagggagaggatcagaaaaaataactaatggatactaggcttaatacctgtgtgataaaaaaattggtacggcaaatccccatgatatacatttatctatgtaacaaacctgcacatccttcacatgtaccctgaacttaaaagtaaaaaagaaaagaataagctcaaaaaatctatgtaaatgatctaagagtctctaagtgtgctctggtaagaatcttctctcctatagccacaggctaaaattgctgaaaactgaacaccagccctcattatcccattgggtgaattacaagaaaagttgaaccctcacccttgtagaatatctactgttaaagtgaggatatgaattggggaaaaaaaattcctgaaagttaagataggaatgtgtggaaacacttgataaagctagggacattgaccatgtatattgtgatgagtcttgtttgccagaagtaacctcctcattcccacccgcttgagcattcccacccacagttgtgtatgcctctctacttttgtctcaggggattaattctgcattgcctaagaaaatggtaatgacctccggggcatttgctaagcaagatgatgattcttcttgggaccaattcccaccaccccgctttgcttttagacctataaactagtctcaagtcataactggctcctaaagatgataaaaaagtgtaacgcatgagggggtatactacatcccaaagaactacttgatttttttaattttatacaagcagaaatccagataacgtgggggaatgcatattaggagtgtggaattattgtggaagaaacataaagttagatcaggcttatatggattcactaagcagatattctccatttaatgttacagctcagggagttagaaaaagcactaaaagtttctctagttcattggctgaaacaggtatcaaaatatggcccatggtaagcatgttggagatgccccatctcccttgacttaccatagaggaaggaattcaaagccgtagggatattggaatactagagtaaatttgtcatgtaaaatctactcacctatgccaggaaagttcagaagatatacctttcaccaataccttgtgaaatagatttgtgaggggatctccagtacccctgaagtgctccatggttgcacttccttgtaaactggaccttaccatgggatcctcagtcaattatttaaaaaacttaaatgtaataggaataattagatcttggggtggtagaggccatgttgtggtactcagctctcaaaggtaaggtgtgcatagttaccataatagacagcaaaggcaaagcaacaaacagaatcgtctgattttcatggatctatggcatcggctagttaaacatggtgttcctagaagtggacagatagaaaactgctgaatttttactttatataagtagaaaactttcaagtcaagtaaataaaagtttaacccaagtaatagaaacagagaacaatgggtcctaaatcaattcccagacttgagccagtttacagacctagaaaaccttgaatgaaagggagaccagatctcctccaggaggaacaccagtacactactaaaaatctgtaccacttatttttatcccattttttcttcaaagggacctatggtgttttacctgggtaactgcagtggagaaagagaaataataatacttttcagggactagtgaacactggctctgaagtgacactgattacatgagatccaaacatcactgtgaccctccagttagagtagggcttcacggaggttaggtgattaatgcagttttagctcagattccactcacagtgggtccggtgggtttctgaattcattctgtgatcatttcctcagttccagaatgcataactggaatatacatatttagcagctggcagaatctccacgctgattttttaacctgtgtagtgaggactattaagtggaaatggccaaatgtaaaccactagaactggttctatctaggaaaatagcacagcaaaaacaatactgcagtcctggaggtaatgcagagattgatgccaccatcaaggacttcaatgatgcaggggtggtgattcccaccacatctccattcaactctcctttttggcctgtgtagaagaaagatgaatcctggagaaggacagtgtgttactgtaagcttaaccaagtggggtgactccaattgcagctgctgtaccagatgtggtttcatttcttgagcaaattaacacatcttctggtacttggtatgtagctagtgatctggcaaaaacctttttattgatccctgcccataagatccaccagaagtagtttgctttcagctgtcaaggccagcaatatgccttaattgtcctaccttatctccagccctgtgtcacagtttagtttgtagatatcttgattgcctttttcccctgacaatatatcacactggtgtgttatattgatgacattttgctgactggacctagtgaacatgaagtagaagccactctgaatttattgctaaaacatttgcatgtgaatggaaaataaatctaactaaaattcagggggcttctaccttagtgaaacttctaagggtccaatggtgtggtaatatcctttctaaagagaaggataagttgttacatctggcccctcctacaaccaagaaagaggcacaacatctagtgggcctatctagattttggacaaatcatattcctcatgtgagtatattactctgtgccatctactgagacacctgaaaagctgctagttttgagtgggacttagaacatagtgctctgcaacaggtccaggctgctgtgcaagctgtgctgccactcgggccttaggattcaacagatccaatggtacttgaggtgtctatggcagatataaatgctgtttggagtctttggcaagcctttacaggtgaatcacagtaaaggcccctgagatttttgagcaagaccctgtcattatctgaagataaatactatcattttgagagacagcttttggcctgttacttggccttagtagacactgaatgtttggctatggaccaccaagttaccatgagacctgagtttcccatcctgaactgtgtgttactttacccaccaaatcatagagttggttgggcacagcagtattccatcatcaaatggaagtcgtatatacgtgatcaggccccagcagatcatgaagacacaattaaggtatatgaagaattggccccaaaaacccatggttccttctcctgctataccaccttctctctctcagcctgcaccgatggcctcatgggaagtaccctataatcaactgacacaggaagaaaggactagggcctggttagagatggttctacatgatatgtaggcaccacccaaaagtggagagctgtagcagcatagtcactttctgcgacaacctggaatggcaatggtaaagggaaatcttctcagtgggcagtaatttaggtaatgcacctgaatgtgcactttgcttgaaagtagaaatgccaaatgtgtggttatatactaattcacgggctgtagccaatgatttggccaaatggtcaaagacttggaaagaacatgattgaaaaactggtgacaaagaatttggaaaagagatatgtgaataaaactctgagcaggcaaagtatatgaagatatttttgtcccatgtgaatgcacaccaaagaatgacctcagcagaggaggactttgataatcaggtggatagaatgacctactctgtagatactagtcaacccctttcctcagccaccccatcattgctcagtgggttcatgaacaaagtggcaatggtgtgatggtagagattatgcagggactcagcaacatggacttccactcacaaaagccagcctggctatggccactgctgggtgcccaatctgacggcagcagagatcaacatcttagatgatcatttcctgggataatcagcaagctacctggtggcaggctgattatattggaccacttcaataatataaggaactgtgtttggtctttaaaggaatagacactagatatggatttgctttccctgcacacaatgcttctgccaaaactaccatatgtggactcataggatgtcttatttaccatcatggtgttccacacagcattgcttctgacaaaggaactcactccatagccaaaggagtatggcagtggagtcatgctcatggaattcactggtatttccatactcctcatcatcctgaaaaagctggtttaattgaatggtggaagagtcctttgaattcaaaattacagcaccagctaagtgacaataccttgcagagctggggaaaggttctccagaaggctgtatatgctctaaatcagtgcccaatatatgctactattcctcccatggccaggattcatggatccagaaattaagaggtgaaaatgggagtggcatcactcactatttattatccctagtgacctgctagcaaaacttttgcttcctgttcctgtgactttatactcttctggctctagacatcttaattccaaagggaagaatgcttcctctatgagacacaacagtaattcaattgaactgctcgttaaagctgctgctcagcctctttgggcttctcatgcttctgagataataggataagaagggagttacacagtttgctggggtgattgatccagactaccaagggcaaattgaactactacttcacaatggagttaaggagatgtctggaatatggaagatcccttagggcatctcttagtactactatggcctgtaataaaggtcaatagaaaatcacaacaacccaatttaggcaagattactaatggccagacttcaggaataaagatttgggtcacttcactagataaaggaccaccaccagctaaggtacttcctgaaggcaaagcgggtactaaatatatagtagaagaaagtagttacaaacaccagctagggccatgtaaccagttacagaaatgaagactaattgttataagaatttatttcctaatgtgttaagaatatgtctgtgtatatatatatacacatattatgtattatctttgttttcactcttatctatcatgtaatataagattgactgaatttatatcagtatataagtattgttaattgtacataatagtattcaagtcatagtgtataaggagaagaataaacatcaccaaaaaaactttaccttttcttctgggaaaaggactaatgcattttacttgcatgtagaataggtgtatcatgttaagtggaattattaccttgttattgtgttacttggagattaagtatggtttaaggagatgtatatgggtgccaagttgacggtgagtgggcttgtgatagttaattttagatgtcaacttgactggactgaggaatacctaataacctgataaaacattatatttaggcgtgtctttgagggtgtttccagagataagcctgtgagtctgagaggactaggtggggaagatccaccatcaatgtgggaaggcatcatccaatgtgttggtgggccagagataactacaacagagaaaaggtgaatatgtcaatctatttgctgaagctgggatactgttcctttccaggctcccaggcctttggactccaggacttattccagtgcccctctgtgatctcaggctttcggccttggactgagaattgcaccgtcagttttcctggttctgagatcttcagacttggactgagttacactaccagcaccccagggtctccagcttgcaaatggcctttcatgaaacttagtatccataaccatgtgagccaattttcctaataaattatctctcaatttttatatatatatatatatttgtgtgtgtatacatatatatgtacacatacacacatacacgtatcatggatgacatggcccataaataaggtcaatggaaaattacaacaacccaataaagacaagactatgaatggtccagactcttcaggaaggaataatacaagagacagaatgaatattcgattagttctgtgtctctggagaaccttgaataatataagaatatttttcttctagagatgagtaagggctgctggcattctcttagtaatgactggttattcacagaggacatgattgtgtacagagaaaattcaaagagatctataaaaactactagatctaacaggcaaatttagcaaggtcccagaatacagttaacatacaaaaaatcatttatgtttctataaactaaaaaacaaattggagaaagaaatgataaaagacaataccatacagtttggcagtaactaataaattttaaaatacatttaccatataagccagcagtctcattttaggtcattacccaagtgaattgaaagcatacattcacataaaaacctgtacatgaatgattatagtagttttatttataattgccaaaaactcgacaaattccagatgtttttcaagagatgaatagataagcaaaatttagtatatatgtatgatgggctaatatttagattgactcatacaacgtgataaatcttaaatgcttttgctataaagctaaataaaaaggctaaacactgtatgatttcattcaaatgacattctgaaaaagacaaacctatagtgaaaaaggaaacagaccattggtagacaaggattgggcaggggtgtctgaatgtcgaggagacaaatgtcaaggagaattattaggatgatggaactctactatatcatattgtggtagaagatatataaatctattcatcaaaacccctagaactgaacacagcagaaagcaaaaattgtaggttaaaaacaaataaacaaaagcaatcaggattttgaaggatcttagaatgacacacagactgtaataagtgaatctaaatgtactacaaatgtataactttaccacatttaagggagaataaggaagctggcctaaatactttttaaagacttgttttaccgatactgtaaagctgaagataaaagaattatacacaaatgctgtactctctcactggttaaatttatttttcagaagggtaagttttaccaattttgaaaaagttaacatacatacaaatatgcaagtaaatatgttatagttaatgataaccagatttcttaatgtcagaaaaagaagttacacattgatgcgatttggctgtgtccccacccaaatctcattttgaattgtagttgccacaatcccctcatgtcatgggaggcaccaggtggagataattgaatcatggatgcagtttccccaatcctgttctcatgaaaatgagttagttctcatgagatctgatggttttataatgggcattccctttcactaggcagtcattcttctccttcttgccgccatgtgaagaaggacatctttgcttccccttccatcatgactgtaagtttcctgaccctgcctcagccctgtggaacttgagtcaattaaacctctttcctttataaattaccagtatcgaatttgtctttatagcagtgtgagaactgactaatacacacataggcaagagagaaatgttagaatacaacaggtagtgttgaattagagttggaaacattagtttgaactcatgactattttagtataccaaaataaacacaaaactaaatataaagatgggcgttattgaaggctcaataaagctccctcctcaaaaagatgtccatgtcctaatccagctccctcctcaaaaagatgtccatgtcctaatccagctccctcctcaaaaagatgtccatgtcctaatccaaggaccttgtgaaaaggttatcttagatggctaaaagaatgtgattaaggatgttgagatggagaaatcatcctggattaaccacttgagtccaacgtaatctcaagggcccttataagagggaggcatgtgggtcataattccaggaggcgatgtgaagagagaagcaaagatcagagagatgcagggcatactatgagctcagaaatgtgtgcagactctagctgctggaaaaggcaaggaaaaggatgctttcatagcgtctccaaaaggaactcacactattttgcatttctgacctccaaacatgtaagataacaaattttcattgatttaaggcacaaagtttgtgctgatacagcaacaataggaaactaatatagatgtatacatggattagaatgcatgcatgtatggctgggcatggtggctcatgcctgtaatcccagcactttgggaggccgaggcaggtggattgcctgagctcaggagttcaagaacagcctgggcaacacagtgaaacccatctctactaaaatacaaaaaattagccaggaatggtggtgtgcgcctgcagttccagctacttggggggctgaggcaggagaactgcttgaacacaggaggcagaggttgcagtgagccgatatcatgccactgcactccagcctgggcaacagagcaagactctgtctcaaaaaaaaaaaaaaaaaaaagaatgcatgcatgtattccatagctctttcctgttggagagcaaaaagtaatcacatccagtagaaacaggcacatctaacaaccagatcaggcttctagataccactttataataaaatgacccaggatgacttgacaaaattgttgattctagggatagggcaaggaaattacaagatggtcctgaagcctctgtcatgccacataataaggaagtactagaaaagaaagattacagaaagagtaaagaaaagaattaaagactataaagatgcagttaccaaggcagctggcaagatggccgaataagaacatctccagtctgcaggtctcagccagatcagtgcagaaggcaggtgatttctgcatttccaactgagtacatgactcatctcattgggactggttagacagtgggtgcagcccacggagggcgagccgaggcagggtggtgcaatgcctcacccaggaagtgcaaggggtcagggaactccctcccctggccaaaggaaatcatgaggcaccgtgccatgaggagtggtgcattctggtccagatactacacttttcccacggccttcgcaacctgaagaccaggagattccctcggatgcctacaccaccagggccctgggtttcaagcacaaaactgggcagctgtttgggcagataccaagctagctgcaggagttatttttcataccccagtggtgcctggaacgccagtgagacagaaccgttcactctcctggaaaggggactgaagacagggaaccaagtggtctagctcagtggatccaaacctccacgaagcccagcaagctaggacgcactggtttgaaattctcgctgccagcacagcagtctgaagtcaacctgggactctagaacttggtggggggaggggcgtccaccattactgaggcttgcgtaggcagtttttccctctcactgtaaacaaagcctccaggaagtttgaactgggcagagcccaccatagctcagcaaagccactgcggccagactgcctctctagattcctcctctctgggcagggcatctctgaaaaaaaggcaggagccacagtcaggggcttctagacaaaactcccatctccctgggacagagcacctgggggaaggggcggctgtgtgtgcagcttcagcagaaataaacattcctgcctgctggctctgaagagagcagatctcccaccacagcgctcgagctctgctaagggacacactgcctctgcaagtgggtccctgacccctgtgcctccagactgggagacaccttgcagcaggggtcgacagacacctcaaacaagagagctccaactggcatctggcgggtgccccactggaaggaagcttccagaggaaggaacaggcagcaatctttgctgttatgcagcctccactggtgatacccaggcacacaggatctgcagcggacccggagaatactccatcagacctgcagaagaggggtctgactgttagaagaaaaactaacaaacagaaaggaatagcaataacatcaagaaaaagaacgtccacatacaaaaaaaaaaaaaaaaaaacaactgaaggtcaccaaaatcaaagaccacaggtagataaattcacaaagatgaggaaaaccagcgaaaaaaaggctgaaactaccaaacaccagaatgcctcttctcctccaaaggatcacaactccttgctagcaagacaacaaaactgaacagggaatgagtttgacaaattgacagaatttaggcttcagaaggtgggtaataacaaactcctccaagctaaagaagcatgttttaacccaatgcaaggaagctaagaaccttgaaaaaaggttagaggagttgctaactagaataaccagtttaaagaagaacataaatgacctgatggagctgaaaaacacagcacaataacttctttcatacacaagtatcaatagccaaatcaatcaagtggaagaaaggacatcagagattgaagatcagcttaatacaataaagcatgaagacaagattagagaaaaacgaatgaaaaggaacgaacagagcctccaagaaatatgggactatatgaacagaccaaacctacattcgataggtgtacatgaaagtgatagggagattggaaccaaattggaaaacactcttcagaatattatccaggagaacttccccaaactagcaagacaggccaacattcaaattcagaaaatacagagaccaccacaaagatataccatgagaagagtaaccccaagccacataattgtcagattcaccaaggttgaagtgaaggaaaaaatgttaagggcagccaaagagaaaagtcagattacccacaaagagaagcccatcagactaacagcggatatctctgcagaaatcctacaagtcagaagagagtgggggccaatattcaacattcttaaagaaaataatgttcaacccagaatttcatatccagcctaactaagcttcataagcgaaaaagaaataaaatcctttccagacaagcaaatgctgagagattttgtcatcaccaggcctgccttacaagagctcctgaaggaagcactagatatgaaaggataaaccagtaccagccactgcaaaaacacaccaaattgtaaagaccatctacactatgaagaaactgcaacaactaacgggcaaaattaccagctagcatcataatgacaggatcaaattcacacataacaatattaacttaaatgtaaactggccaattaaaagacacaggctggcaaattggataaagggtcaagacccattggtgtgctgtattcagtagacccatctcacatgcaaagacgcacataggctcaacataaaggaatggaggaatatttcccaagaaaatggaaagcaaaaaaaagcaggggttgcaatgatagtctctgataaaacagactttaaaccaataaaattcaaaaagacaaagaatggcaacacataatggtaaagggatcaatgcaacaagaagagcaaactatcctaaatatatatgcacccaatacgggagcacccagattcataaagcaaccttgaaaaaggttagaggaattgctaactagaataaccagtttaaagaagaacataaatgacctgatggagctgaaaaacacagcacgagaacttcgttcatacacaaatatcaatagccagaataataaagaagaaaagagagaagaatcaaatagacacaataaaaaaataataaaggggatatcatcactgatcccacagaaatacaaactaccatcagagaatactataaacttagagactgagactcccacacagtaatagtgggaggctttaacaccccactgtcaacattagatcaaagagacaaaaggttaataaggatattcaggacttgaactcagctctggaccaggtggacctaatagacatctacagaactctatgccccaaatcaagagaatacacattcttctcagaaacgtatcacacttattctaaaattgaccacaccattggaactaaaacattcctcaccacacacaaaagaacagaaatcataacagtctctcagaccacagtacaatcaaattagaactcaggattaagaaactcacacaaaaccacacaactacatggaaactgaacaatctgctcctgaatgattactgggtaaaatacaaaattaaagcacaaataaataatttctttgaaaccaatgagaacaagacacaacataccagaatctctgggacacagctaaagcagtgtttacagggaaatttacagcactaaatgcccacaggtgaaagtcggaaagattgaaaatcgacactataacatcacaattaaaaaggctagagaagtaagagcaaacaaattcaaaagctagcagaaaacaagaaataactaatatcagaccggaactgaaagagatagagatacgaaaaccccttcaaaaaatcaatgaatccaagagctggtgttttgaaaagattatcaaaaaagatagactgctagccagactaataaagaagaaaagagagaagaatcaaatagacaccataaaaaataataaaggggatatcatcactgatcccacagaaatacaagctaccatcagagaatactataaacacctctatgcaaataaactagaaaatctagaataaatggataaatacctgtacatatacaccctgccaagaacaaaccaggaagaagtcgaatccctgaacagaagagtaacaatttctgaaactgaggcagtaatcaatagcctacaaaaaaaaaaaaaaaaaaaaacccaggaccagatggattcacagccaaattctaccaaagaggagctggtacctttacttctgaaactattccaaacaatagagaaagagggactcctccttaactcattttatgaggctagcatcatcctgataccgaaacctggaagagacacagcaaaaaaagacaatttcaggccaatatctctgatgaacatcaacgcgaaaatcctcaatgaaatactggcaaaccgaatccagcagcacatcaaaaaacttatccaccatgatcaagtcggcttcatccctgggatgcaaggctggttcaacatatgcaaatcaataaacgtaatccatcacataaacagaaccaatgacaaaaaaacacacaattatctcaatagatgcagaaaaaaccttcgataaaattcaacactccttcatgctaaaaactctcaataaactaggtattgatggaacgtatctcaaaataataagagctatttatgacaaacccatagccaatatcatactgaatgagcaaaagctagaagcattccctttgaaaactggcacaagacaaggatgccctctctcaccactcctattcaacatagtattggaagttctggtcagagcaatcaggcaagagaaagaaataaaggtcattcaattaggaaaagaggaagtcaaattgtccctgtttgcagatgacaggactgtatattcagagaacaccaaatacacaacttcagcaaagtctcaggatacacaataaatgtgcattcctatacaccaaaaatagacaaacagagacccaaatcatgagtgaactcccattcacaattgctacaaagagaataaaatacctaggattacaactttcaagggatttgaaggaccttttcaaggagaactacaaaccactgctcaagaaaataaaagagaacacaaacaaatggaaaaactttccatgatcatggatacgaagaattaatatcatgaaaatggccatactacccaaagtaatttatacattcaatgctattcccatcaagctaccattgactttcttcacaaaattagaaaaaaaactactttaaatttcatatggaatcaaaaaggagcccatacagccaagacaatactaagcaaaaagaacaaagctggaggcatcatgttacctgacttcaaactatactacaagactacagtaaccaaaacagcatggtactggtaccgaaacagatatatagaccaatagaacagaacagaacagaacagaggtctcagaaataacaccacacatctacaacaatctgatctttgacaaacctgacaaaaacaagcagtggggaaaggattccctattcaataaatggtgtttggaaaactggctagccatatgcagaaaactgaagctgggccccttccttataccttatacaaaaattaacaaaagatggattaaaggctaaacgtaaaaccttaaaccataaaaaccctagaagaaaacctaggcaataccattcaggacataggcatggtcaaaggcttcattactaaaacaccaaaagcaatggcaacaaaagccaaaattgacaaatgggatctgactgaactaatgagcttctgcacagcaaaagaaactatcatcaagagtgaaccagcaacctacagaatgggagaaaagttttgaaatctatccatctgacaaatggcttatatccagaatctacaaggaacttaaacaaatttacaagaaaaaaacaaataaccccatcaaaaagtgggcaaaggatatgaacagtcacttctcaaaagaagacatttatgcagccaacaaatgtatgaagaaaagttcatcatcactggtcattagagaaatgcaaatcaaaaccacaatgagagaccatctcatgccagttagaatggcgatcattaaaaagtcaggaaacaacagatgctggagaggatgtggagaaataggtacgcttttacacggtaggtgggagtgtaaactagttcaaacattgcggaagacagtgtggcgattcctcaaggatccagaaccagcaataccacttgacccagtaatgccattactgtttatatacccaaaggattataaatcattctattataaagacacatgcacacgttatgtttattgcagcacgattcacaacagcaaaggcttggaaccaacccaaatgcccatcaatgatagcctggataaaggaaatgtggcaaatatacaccatggaatactatgcagccatacaaaaatgatgagttcacgtcctttgcagggacatggatgaagctggaaaccatcgtactcagcaaactaacacaggaacagaaaaccaaacaccgcatgttctcactcataagtggcagctgaacaatgagaatacatggacacagggaggagatgatcacacaccagggcctgttggggggtgtggggctagggcatggatagcattaggagaaatacctaatgtagatgatgggttgatgggtgcagcaaaccaccatggcacgtatatacctgtgtaacagacctgcactttctgcacatgtatcccagaacgtaaagtacgaaaaaaaaaaaaaagatgcaataacctatttaggagcatgagagaggctgctaatatgaaaatctctattttcttagtgctaatgtccgaaaatgccaaattgtacaaacagttatagtttacttcaccacacatatttgcacattaatatttttctaacattgacttccataaaaattgaaactgttttttttttgaggagttgcactcttgttgcccagactggaatgcaatgatgcgatctcagctcactgcaatctctgcctcctgggttcaagcgaatttcctgtctcagcttcctgagtagctgggattacaggcatacaccaccatgcccagttaattttgtattattagtacagatggggtctcaccatgttggtctggctggtctcgaactcctgtcctcaggtgatccacccacctcagcctcccaaagttctgggattacagacatgggatgagccaccacgcccagctaaaacatttttaattattaaaaaccatatgtattttttaaagtacattttacttcatgtcatttgtatttatattcaccccaaactgtaagcacagaacatctacagttcttcatgaaatatcttttaactctgttaaagaatgatgtttgagtaagtgggatgacgtaaaaggcaaagatcttgttttcacttcactgaaaagctaatgcagataacagaaaccctatcctaaagctagtggattaaatttctactgttattcagcacttactattcagacaataatgacatttgggggcatcttaatctaaacaagtacttagcattacatctcacctgggtcaacagtcaagggtatcagagttaaactgtgttactgtaaattaatggaaaatgtaactgcactttgctgaaagataaatgtccaataaaggctgcataataaaaaaaaaaaaaagacttaaaaatgttatagaagccggtcgggcacggtggctcatgcctgtaatcccagcactttgggaggccaaggcaggtggatcacgaggtcaggagatcgagaccatcctaacacaatgaaaccccatctctactaaacaaaatacaaaaaattagccgggcgtggtggcgggtgcctgtagtcccagcactttgggaggccaaggcaggtggatcacgaggtcaggaaatcgagacaatcctaacacgatgaaaccccgtctctactaaacaaaatacaaaaaattagccaggcgtggtggcaggcgcctgtagtcccaactactcgggaggctgaggcaggagagtggcgtgaacccaggaggcagagcttgcagtgagccgagatcaggccactgcactccagcctgggcgacagaccgagactccgtctcaaaaaaaaaaaaaaaaaaaaaagttacagaagccaagaaactaccaatggtcaaacctaaaataatctaggaatcaaaaactaccaatggtcaaacctaaaatcatctaggaatcaaaaactaccaatggtcaaacctaaaataatctaggaataaaataaatacaaataatattgtggttttaatttacatttctctagtggatggaactggaggccattatctttagcaaaccaacgcaggaaaagaaacaaaatactccatgttctcacttataagtggaagctaaataatgagaacacatggacagaaagagaggaacaacagacactggagcctacttgagggaggaggctgagatgaggaagaggttcagaagaaaaaaatgttgaggctatgcttagtacctgagtgacaaaataatgtgtacatcaaacctccaaattatgagtttccctatataaaaaacctgcacatgtactcctgaatctaaaataaaacttaaaatatgtaaaatactgctactaatggattacttcttaaataataagtatccataagtctatactgatataaacacataattgaatgaataaacgaatgaatgagagaagagattagctattccttacagaagagcttcagttaataaagaaataggaaaattttttttttttttttgagacacagtctcactctgtcacccaggctgggtgcagtggcgcaatctcggctcactgcaagctccgcctccgggttcacgccattctcctgcctcaacctcccgagtagctgggactataggcacccgccaccacaccccgctaattttttttttacttttagtagagacagggtttcaccgcgttagccaggatggtcgtgatctcctgacctcgtgatccacccaccttggcctcccagagtgctgggattacaggcctgagccaccgcatccagctgccaggaaattcttttatagaaaattaatcattacaacaccaaagtagtgattgttgtaggcaagatctttagatgaatactaaatttagcaagtgactttaaatcagctattataaatctgtccaaagaactagagaaaatcccatctaaagaattaaagaaatgtatgagaataacgtctcatcaagtagtatatcagtaaacagatataaaaagaaaccaaatagaaattctaaagttgaaaaatataagaactgaaattaaaaataaactgaagaagttcaacagcagatataagcaggcagaagaaagaattcgtgaactggaaggtaggacaattgtgattacccagtctaaggaacagaaagataacagagtgaagaaaaatgtacaaaactccagagacctctgaacaccatcaagcataccaaaatatacataatggaagtctgagaaaaagtagagagtgaaagaagcataaagaatatttgaaaaaatcatggctgaaaacttccaaaaatcgatcaacattaatatatacatccaagaatctcaatgaattccaagtaagataaactcaaagaaaagcacaccaagacatcataattaaactgtcaaaagacaaacataaagagagaatcttgaatgcagaaaaagaaaaatgactgattgtatatgaaagattctcagtaagattaacaaccgatttctcacccaatactgtggatgacaatgggatacctaccatattcaaaatactgaaagaaaaaacatgtgaaccaaacattttatatccagcaaaacttacaaatgaaagagaaataaaaacatgtccagataaacaagaactgataaaaattttttactatatctgcctgacaagaaatactaaaaagagacttttaggctgaaatgaaacaatactaactgtaatttgaagaccatgataaaataaagaacactggtaaaggtaactgcatgaggaaatataaaagatgaaagaagtataatttttgtttgtagctctgtgtttcatcctacctgatttaaaagacaaatgcataaaataattataaatctgcattgatgagaaaataatgcataaataaaatattggtatgataaaatcatagaagatggggaagagaatggaaatatatagaatcaacaattttgtatactattgaaattaaatagaaatgaaactgaactagactataataatttaattgtaaacaccagagtgacccagaagaaaataactcagaataaataataaataaaatgacaaaggcattaaaaagttatactaggggccaggcgtggtggctaatgcttgtaatcccaacactttgggaggctgaggtggacagatcacttgaggtcaggagttagagaacagcctggccaacatggcaaaaccgcatctctactaaaaaatacaaaaattagccgggcatggtggcatgcctgcaatcccagctactcagaaggctgaggcaggagaattgcttgaaccaaggaggcagaggtagcagtgagccaagattgtgccactgtactccagcctgggcgaagtatactagaaaacatctatttaacacaaaaaaagcagtgttggaagaatagataaaatgaaaaataagacatatagaaatccaaagaaaaatagcagtaaatacccacttgtaaattaccaaattaattgtacctggattaaacaccctaattagaaggcaatattggtggaatggaatttttaaaaagatacaactatatgtgatctacagaagacacaatttagattaaaagatataaataggttggaagtaataggatgggaaatgatactaggcatacagtactcaaaagagagctgttttattttgtctgatatttataacagacaaaatagacttaagacaaaaattgttagtacagataatgaagggcattgtataatgataaaacggtcaatcaggaaaatgtagcaattatgaaaatatatcacagttaactttaaagcccccaaatataatacgtaaaacaaaaaatgattaaattgaagggagaaacagacaagtccacaataatagttggaaatttaaatttagtcactggttaacttaagaaatttgcagagcctcaaaatattgcctccaaattatttactaattgctagaagttttaaaaattatttaatactcctcacaagaagtggagcttaattctagtctcattgagtgtcagccaaagttagtcactgaatttcaaataacagactatgaaaagggagaaaaaaaaacctaccaaactttaaagtggagaaaccacctcaacaaaagtgatcaacattaatatcaccaataagttatgctgacatcgtacaataccggatattatgcaatgagaaagacacatcacttctgtgatactcttataaaaaatctgtaactcccctctagtcatgagaaaaccaccaaacgacttgaaatcaagagacattataaaaaacaactaatgaatactccttaatagtgccaaggtcataaaagactttcaagcttaaaaagctgtcactgattggaggagactaaggcaacatgaagaataaatgaaatgtagtactgactcaagtcttgaatccaaaacataaaaggacattagtgcaaaaactgggaaaaggtgaataagaacaatgttgaagtacttacattatcagattctaaaatatagtatgaagctacattagtcaagacagaatgccattatcataagcatagaaagatagagcattaaaacagaaaagagtacagaaataaaaacacatatatggttcattgatttttgtaaaaagcactaatataattcagtgattaaatgaaagatttttcaaatggtcctggaataactaaatatctctattgaaaaacaaactatgttgttatccatgtatctattgactgatctacctatttatctggacacatacctgacaccataaacaaaaattaactgaaagtggatcaaaacataaacgtgaaagttaaagccataatgttcctataacacaaatagaagattatctttgcacctttggattatgaaacaaatcttaaaatgccaaaaaaaaccacactggacttgatcacatttaaaacatttgctcattgaattacatgattacaaaaataaataggcaacacacagacaaggagaaaacatttactgtctctttctctctatatatataatctttatgtatgtatgtacatatacatatacatatatctgacaaagaatgtgatgtcaacaaaatgaaagagtaggcagctctaggctctcatccctcatagaaacatagaataagtggatacttttggaaccagttttttcagaattctgaaaatctgtcaaaatttacaataaccaaatgaactctgaagaaagaaaaaaaacctcttcaaaacagtaggaagtaatgtgatgattttacttactcttttcccaccctcttcctggcacaatagtagtcttggttcagaagcaaggacagcttgcattcccagtgtggcaccctttccctggttccaaagtaagaagagtagaattatttcatatggtttttctaacttgtctgggcactacgtggatgactgacacaaggctttcatctttgttttacctaagtcaaactcaggccagaaaaagaacaagcattgcttaaaaacactgaaagtcatacaatcctcacatgtctgaagcaaatgactgtaatagaaacaaacagtagattgctaaggcaaaaatctgggaagagcttttttacttcctacagtattaagctgacaaatttatgaagaataattatgattctctattattggatgcacattgtataagttataatttgtgacaacataaagggtggaaaatggagctgtataggagcagagattttgtatgttattgaagttatgtgggcatcaaatcaactaaattattataaatttaggatgtcacatatagtccccatattaaacaaaatgtctaaaaatctatatacaaaaatataagaagaaaatcagttcataacaaaaaagcaactatcaacattaaagaaagcattaagggaggaaaagagggacaaaaaatttctaagatatacttaaacagcaaaatggcaaaggtaaatctttccttatcagtcattactttaaatataaatggaattaactcttcaatcaaaagacattgcttggcagaatgcattaaaatgtgatccaactatgtgctgtctacaagggattcactttagatataaaagacacaaataggttgaagcaaaaaaaaaggaaaaagattttccttgcaaatctacagccactgtaacaatatcagacaaagtaggcattaaatcaaaaaaagcaaaaaaaaagacaagaaatgtcaatacttattagtaaatggataattcatcaaggagatatcaaaattataaaaataaatatactaacaacagatacccaagatatatgaagcacggtttcacagaattgaagtgagcaatagacagtcacacaataacagttggagatttcaattgaaaacattcaaaaatggatagagcatgtaggaataaggtcaatagaaaatagaggatttgaacaacactacaaacaaactagacttgacagacttataacacctcacccaacaacaggagaatacataatcttttcaagtgcacatagaacattctctaggatagtacacgttaggctactaaacaattctcaacaaattttgaaagattaaaataatacaaagtgttttttctaattacaatggaatgatgccgtaaataaatgacagaagaaaaactgaaaagtcagtgtgttatatattcaagatactgtgtcttttgctctatgtaattatatctcaataaaattatatatatatatatataatttgctatgttggtactatgaaatcatcaacttagaaaccctcttgcttgtgtaacataatgaagattaatatcaacttctatgaaatgagctctctctctgtcacctgaattaacagtatatatgtacccctgtgaccctttaaataacatttatcacattctttttacgttgttatacagggttttatacccatcttttgcctctgctattgctttaaaggcaactttttgtctctgctattgatttgaaggccataaaagaacatataaaagaccatgtgttattcatcttggtttcccagcatggcacccagaaaaacatcttgcacattttgtcagaggatcctgggttattatttcataaataaatgaatgattaaataaacaagtactaatcaaagtaatcataccagaaaccctgatttatgagaagcgctaatgtcacttccttttgcagttatctagatgtctttaaaaatgaacctaaatcttttatggtatgaacagtcaacaagagaatgaaggatgcatgtggaaaatttgtgaaggagagaaaacatggattctttacattttcaaaagtcctgaatataggtcatacagttaaaagtaaaaccagggctaagcatagttgctcacacctgtaataccaacactttgggaggctgaggcaggtggattgccttgagctcgagttcgagaccagccagggcaacatggcgaaacctcatctttataaaatatcaaaaattagctgggcatggtagcttgtgcctgtactcccagctactcaagaggctgaggtgggaggattgcttgatcttgggaggtcgaggctgccgtgagccatgatcgcccactgcacttcaacctggatgacagagcaggacactgtttaaaaaaaaaaaaagaaatccatacttagaattaattagttcagtgaaatagccaatttacagatagcaaacttttttctatctttaaagaaaatattttgtccaaacaatagacaatgtagacatttcacacttcattcacttttttgagcctatttagatacagactaaaatggagaaaaagtatgatcactgtacacctatacttacttatctagcccttattcttgtgttttgttttaaactgactcttaaaatcttgtccgttcccgtacattaactctctgatttttgcagataactcataatcctggaggcctttgattactacatagtcagtttccttacaaaattaatcagctacaatgttaactctccctcacaatgcaccttaatatgcatttctaaaattattaactaaaaatttctgtctgacttactcctgtaatcttctagccagcattctttgctctagtctctgacatttttgccatatcatttcagaatatacagtggaattctgaagctatgtaggcttgaatgttcattttgacttcatctatctcactttcatatcctcaatctataggagtcagaactagggtcaaatcttgctctgagtggcacattgtgggatatccccaaattcctatgagacaatataaagcctaagggccagggatgtaagaatggtgatggctgtcttccttactcctttaggatgtatgctctaaagcagtagtgattttgtctagatagttcactgttctatctcccagccccaaccatcatcaatgggaacaatataatgcatggttcaggacttagggcctagtgggagaacaggaactaggaagcaataatatttatgtatgttgttgttatcattgtctaagaaaggaagatttttgtttgatctgctatgtcccaaacacttgaaacaatggcaggattagagctagcctccctctgagtgtcagaatgtggaataacaccaaaatcatcgtaagacaacatagggcctatgtctggcctaaacatcaggggtgggtggcgggtatatgcctcccattaacaagaaagcaagctctgtgagaactgagatttttgtcattttaattgaaacctcagggcctcagttagggccacgcctctctgcgtatcaggagtggtaaaagtgcctgaaacagtaactagcattctaaggtcagtcctattggttgtgttgttgcaatctgtttttccactggagaaacacagatccttacaacaaaacataaaataaactccacatggtttaaagttcatcattcatggggaaatttaaaaaaaaaaaaaacataaaaatcaatactattatcagttatggtgataatatgtagtaaaaacataaaacatgggcaagaatcataccaaattaattacagtgtctgcctattcaaagaatggaagtgggatggtactgggaaagatatttattatctgtaattttctgactgtttaataatatatatctctatctatatcaaataggccaaaatgttgacacttattaattttgggtggaggtgagaaaatgtttgtcatatctttcatactttcctatattttgatttaattttgataaataaaatacaaagataattgaaaataccattatagctaattattttattacaatgttttcagaattagatctaggtgacataaaatacacaaaagcataaagccatctgaatagtacagtcaacaagcaacaaccagtacaatcagcaataatagagaacttttaactttgtatgtcacagagaatgtatatacctttttaataaaaagcctgaataaaccaataactattaaagaaatcacaaagctgattaaaaatctactattaaaagtgtcatcaggattagattgttttacactttgtcctagctaacttttaacaaacaaataattctaatgctatttaaattattccagaccacaggaaaaaaattgaaaactcacatattcatatttttttaaagctagcacaacttcaataacaaaacttgataaagatagcatcagaaggacaaaatacaattttactttggaatgaaaatgcaataattctaaattaaatactggtaaataaaatccactcatgtagcaaatcattatttcacaatgaccaagtagtatttgttccagaaatacaagtttggttccacatcaaatgcctaccattctaattcattacatcaacaaattaaagagaaaaaaaatcatacaattttatcaatagatgctgaaaaggcattttataaaattcaggaaccacttctagcaataacactataaaacaggaatagcggaaactcttaaacatgttaatgactacctactaataaccaaaagtaaatgtcatactaatagggaatactattccctattaatattttgcattcttacttccatgaaaattaagaacaagacagtcacgtctgtcatcactcttcaacattgttttgaaaaatccagctaatgtaacagtaatcagtataaacattaagaggaaataaaatgatctatatgttcaggtgaaataatttcatatctagaaaacccaaaatattatattcttaaaaatctactgtaatttcaatgattaaataagctcattagacagaagataaaaatacaaaaatctataggttgtctatattgtcaaaaatagctaattacaaatgagaagaaaaaaaccaattcacaatgtcaaaatatgaaataaaactgtaaaaatacttagaaataaattcagttagctatgatatacttacgtgaagaatattccaataacaagaccaaaagatttcaatgatgtacgaagactcttgagtgctaagatttaatattattaaagagccctctaaacaaaaatgcaggattttaattgtgatgtcagccatcataattagaattttattaaaattctgcatttcattttttcacatgaaaaaatgaatgtctaggacatattatataaagaaaaaaaaaactaatgaagtgggacttgctttatcggattctaaaacttacgatgaagccactataattaaatcatgatattggctcagaaatttgaaaatgggtaacattttaaataaatgtcacaatcaggtatccaatgtgaacaaaatgttatagctggatccccatcttacaccatatacaaaaataaatttcagatggatcaaacatttaaacattaaaaataataaagttattagaagaaaatgtaggtgaatatttgtatgactttgggtgggggcatccatgtgataaaaaaaggaaaccaaaatctataaaagagataagggtctacctaaaaagtttaaaaattttaaaggaaaatatatcatcaataaagtcaagatgaaaacgtcataacacattagagctacaaatgattaatatgcactatgtagtaagaatttctacaaatttataatgaaaaacatcaatagatacatgagcaaagggtaagaacaggcaaatcagagaaaaatccaaacagaaacaaggacagcaacaacaacaaacctctttgaactcagacaaaaggcaattaaactaacaagcaatacaatgcaatttttagcctttcatattttcaagcattaaagagtgctggagaggacgctggaacgggcgctttcattttggatagtaatcttgtaatatttctgaaacatatgcctacatagtatttctgggaatccaacctatataaataaaagcaccagtatgtattacagcagtgttattttgaaaaaaaataaaaaaaggaaataaaagacgatcaataacgaaatggttgaatgcctttttggtacatcaacaagtactgtgtattcagctgttagagtaagggagggagggggagagcaagagtgcaagagagtaagagtgagggccagagagagccagagagagcaagaaagactgaagctactgataagaagagatatcatctacatgtcaagtgagaaaagcatgtggcttgccatttttacagaaactactagaacatactttctgcatgaagatggggaaaataggtggaaggatgtacttcgcatcctcaacacttgttttctgggaagaaacaaggtaaggaaaggaaggggtaaggacggggtgtgggtttacaccattaatttttcttaatctatttttgcattgttccaatggttgcaaacactttttaattttctattagcacccaatttaactgttaagttacagaacaaggcaatatcaaaagtagcaaagtacacttgaggcaaaattgtgaaactagtcaaggtaagatttgttggcacaataaaatttatccactttcctgaatttctgacacctaaactcttctctgcgttcacaactacgagaacacaaaataattcacatctaacagatccacaacttctctaaagagcacaaagaatttaaggagttttcaccaaaccatagacataaatgtgaatatcatcatcaaacttaatgaagtaaacagatggcttcgccaccacttgatgtataaaaatgccagttctcttggacccgtcatctttggcatgctccacctgcttgcccacgagactgtcgaccacctctccaggctcctgttctgctgtagggaaatagtagttggaatctggaataatgcgtaagtcaccatctttgtagtcatcaagcagcgtgtacatatagagaacaggatctttctcgtaggtgatgtaaaaccaagtatccatcacaggagctcgcgccaggaccatacccttccattcatccttggtaccatgttcaccttcaaacacatgctccactgccttgccaatcagggaatctgccagtcgtgaatcgatacgaggagttggcactctctcaggaaggatctctagcgctaaaactctcttatcgcggtgcagttctagtccatacacactatctttgccatcatatttaatgatgtaaagagtgggcttcacggaaacctgctcgagcacagtacccttccactgctccactggctcgttgccttccttccagccgtgttgaatgcggcagcccacgatgttcctacgagtgaggaaagtgggcttgcgccgttgcttcctgtgggtgtgccttttcttcatcaggtatgcggacacgccatctacccccatcggaggcacggttggaggagacatagctcagggattaagagggcttggggaaagctgctgccctggtcgattaaactgacaaaaagtcaacactatgcaatatgatatatatattttttgcgatctcaaagacctggtctgtgctcccttctccaagtgcaaggctctcaccaaggttttggcagaaacgctcgaactctaaccgtgagcactgggacagcgtgtgcctctccacagtgctttcctctctcgccctagaagggttactgcagcagtggcggctgacgtagagatggcgggctcgcgagtgctgttcgtgccttgcgtccgccccaaccccgaccccaagtccccgaatcggccacttagctgttgtcgatgctggtgcggctgcggcacggcggcagaggagacgacggggacgaaaggcaaggagtaagagggatggctgcagcggcaaaggcgcaggcggcggcaagtctctggggagtccgcgcggcctgggcttcgcagcgctagctggcttggcttcactctggcgaccgggtctttgcggcgcagggaacccgccccctctgagcccgcctgagccttggccccgcccccagccatcccgccttccgctctgcgggcggcagccgggctggtcagcgcgcgtgcccgtgttcagtttgtattgacacacgcgccctctctttcatttcctcctccgcccctcgaccgtttccctcaaacgccagccagacaggccgactcccctcctcctcctttctggcggtctgctgcccgccagcctcctacacagtggctccatctgctttctgtcttccaggaattcctcacttaaaaaaaaaaaaaatgtaaaacacacgcacacccagaaagagtttgtgcatacaaattattttctttcagtttaagatatttaagatgagaataaaaaccctgtgtacaatttacagaccaccatcttaatccaaaatctgttttatattttctacctgatcatttctagtaattatttttattttttttttttttgtcagaatgtaaaggtcatgtactgacattgtggagatcttctaaaattcagtgaaataaaagacgaaactaccattaattttaccatccagactgcaccaaaatgttaacaatactgttttctctcctattaataaacctgtacttatattttataaaattgggagcatatttcatacttttataacttgtgtttttcatgtatatcatgaacattttccaagattgttaaatactctgaaaacatgatttttaatagtaatattaaatatttgtaatattccttttgatagtccactatttatcctacatgatctataacataagtataaataaaaacattttaccttcataaatggatttattgtctaaaccattttttaaaagaagatttaatgacatggagagctgcacatgagatgagtacaatgaaaaagcaaaatattgaaacaatattgtggtcttaattttgtagagagagaaagaagggattttttgtgtatatatttgctgtttttctgattataaaagtgctgcatgcttatatcgaaaacctgcaagaaaagaaagtgtccataatttcacttaccttaagtcacagagctgctatgaggattaaatgagaatgtctgtaaagcttttaacactatatcccacttacaagatgacattaaaatccagaagagtctagggttctcattttcattcctctactcttcactggtgaaaagagaaagcgtcatataatcatgagtaaaaaaggcaattaattcacctggaaacaaaaccggggcaaaagctgcaaggtgtcaatactggttgcctgaacatttcattaccttccaagtcagtgacagagagacctagtcctcattctgtttaatagctggtcacacagaatgtgtaaggatcctccagttcaccatgtttcccaggcaaaggacttcagagatgggataattctttaatgccatattacaagatagtaattccaaggaagaaggtaaactacatgtatgaacagttatttccaaacacttagaatgacatcgtggtgtatatatattcacacatatacacaacctacacattcatactcaaagtcagaaggtgaacgtatgtaaatgttatgccattatgttccacaaataatgtcttccaaataattccccagaccaagatacaccaagcactttttgctcagaagagcagttgacacatgaaagaagaagatgacccacagggcacacaaatgcagggaaaacagtttcctcaggcctttggttacatccttcaagggaattcttgcttacaaccccacaaagtggcctgaagagacaaaaaaaaattcgaataccctttcttctccaaaattatgattctaatattcagaccattcactaacatatagatttaaaaggccttatcatgctgatataatgttcactttgtatgactcccactggacaataaacttattcaagaagggatttttatcttgcatcccaaataccctacacagaatagagactcaataaacatttgttaaatgaataaataattgctttcagctgccctgccccaatgcaaagacatcttccacagtgaaacaagtagccttacacaagcttttgacgactacagttctggcaactcaggctctccctcagcaattttatccttttaaaacacctaaatcactgaccctgtgaatacatgtgcccataagtctgaaaatgcttaggagaaaacattaaagcaagtggggcgggggcaagctttcatcaacctacatgtgtggataacaataaaacttacctcaaagtgtaagtgtgaggattaaattagataaatacacacaaatctctcagcacatgaactggtacatagtaagtactcagttgtctcctaactagtcatctcctgaaagaagttattttgtcttattacatctttttacaaaccacccagctcataccccacctctaaacctttcctctgttttacactcaagacctcttggccagggcttgtgaatcaaggagggctatggcatgatttgttccttatatccaatttcagagcaatatttcaaatactggaagcttctggaagattgacttcttaataaataaacattagtgaaaattaatttggaatactcagtgttaatttataattggaggggtggtggagggaggtataactattgttaattccagtgtgcacaaaagattataatgcatgctataaaagaggtacaactgaagcactaggggacccaaaggaggtagtgattttttatggctggggagatcagcaaagactacttgaatgtctaaaataacaacaaaagaagatattcagagggtggcagtgtagtgaggtattttcaaagagctcaaggaacgacatagagggtgaatggttacaggatatgtgacaaactagtcaggagtttgtgacaagagcacagagttcgttgtgataaggaaaagggggtatagtttgtggtgtggaacaaagttagtcaaaaacctcaaagttgagaactgatatttcatccactgttggtggaagtagctgacattccagttcccctaacaatgtagtgttggtgttaccaagcagagagctgatcttccatgcttcatctgacagaaaacaggcagtgtttttattcccctggaagacaaatactggtgatgctgaacaaagagctgatctactacctctctggcagaagcaaatggtactctgattcccctgccaggatagtgtcagcaaggtcaaatggtaagttgctccaccacattcatctggtagtgtgaggtagtgctagtaattgttatgatacactcacaccccatataaacctgacagcaatgagattgaatacagtagagcaagtcagggctagtcagcactctggttccctatacccctaatgtcagtgaaaaccagtgagtagctgaccttccatcctcatccacagtcagtgagacagaacaaagggaaacatgatgggactagatggtactcaactttccctaaaccttttgtgtcaatgggtcccagagttcagataagcccccactcccactttgaggtcataagatggtatgaacctgtaacccattatcaccacgaaggtgtcagcaaatttgggatgggagctgaacttctgtactgcccatgttcaatgaggcagtgtgagttagtgctgcattttttcaaaggttgtgtcaggggaacctaacagaagaagctgaacatatatacaaaagcagcccttcagccacaaaacaataggggggctctccaataaaaagtttacagagaacacagagtctcatgatataaaattaaaaagtgactaagatgcaattaaaaaaaaatcatacaaggaacaagggaaatcacaacttaaaagagacaagacaattaacaggtgcccaaaacagataaaaaatcgatgttggaaatatttgaaatagattttaaagcagccatcattaaaaaaagtgattcaataagcccaggcattgatgaatgtctttaagtatcaagagcattcagggaaatatgacctcactgaactaactaaagaaggtgccagtaaccaaccctagaaagatggatttgtgtgacctctcagagaattcaaaatagctgtttcaaagaagctcagtgaacttcactgagaagcaattaagaaatttataagagaaatataacaaagagattgaaataataaaaaatcaaacaaatcatagaggtgaaaaatataatggatggaattacaaatgcattatggtattacaacagtagatttgatcaagcagaagaaataatcagtgagctcaaatacaaactatttaaaaatatacaatcaggccgggtgcggtggctcacacctgtaatcccagcactttgggaggccgaggcaggtggatcgtgaggtcaggagattgagaccatcctggctaacacagtgaaaccccatctctactaaaaatacaaaaaattagccgggcgtggtggcgggtacctgtagtcccagctacttgggaggctgaggcaggagaatggcatgaacctgggaggcagagcttgcagtgagctgagatcacaccactgcactccagtctgggtgacagaccgagactctgtctcaaaaaaaaaaaaaaaaaaaaaaaaaaaaaaatatatatatatatatatatatatatttatttatatatacaatcagaagtgacaaaagaaaagaagaattaaaagcaatgaaaaatacttattaaacctatgggatagcctcataagaccaaatgtaagagccattggctttaaagagggcatagaaaaagagaaaggggtagaaagactattcaagaaaataataataataaacattccaaatgtaggaaaagacacaaatatccaggtataggaagatcaaaggtcaccaagcagattcaacctactactgctactgtaaggcatattataatcagatacttaaaagacaggacaaagataagattatagaaatggggaaaaaaagcaaataacctataaaggacctctgatacatctagctgcaggtttctcaacagaaacctttcaggccaggagggagtgggatgacatccaaagtgctaaaggaaaaaaacctgccagctaagaatactgtacttagcaaagaatcccttaaaaaggacggagagataaagactttctcacactaacaaaagctgaagaaattcatcgccacctgacctgtcctacaagatgtgctgtagttctttaatctttaaaaaggacattgatacacaacaacaacaataaaaaacatttgaaggttaaaaaaaatcatttgtaaatgtaagtacacagacaaattcagcatactctaatgctgtaattgtagtgtataaaccactcatacctgtagaatgaagaaaaaagacaaatctattaaaaataataacaactacaacaatttggttaaaaaataggcaaaattagaagatgtaaggtgagatgacaaaaagtaaaaatgaggggtggatggatttaaagtttagagttttttagtttatttttccttattttctttgtgatcaaaattaagttgtcatcagtttaaaataatttgtgataagattttttgtaagcctaatggtaaccacaaagcaaaaacctgtagtagatacacaaaaaatagaaagccaggaattaaaacgtgctaccaaagcaagtcaaccacaaaggaggacaacaagaaaggaagcgaggaattacaaaacaaccagaaaacaagtaacaaaatggaagtagtgagtccactagtagcatggaatataaatggactaaattatctaattaaaagacacagagtggttgaataaatatttaaaaacttaactatatgctgcctacaagaaactcccttcacctataatgacacacatagactgaaagggaaggtacggaaaaagatatttcatgcagatggaaaccaaaaatgatagatgttaaatcaaaacagtaagaaaagatagagaaggccattatataatgataaaggggtcaatagagcaggaggatatgaaaactgtaaacatacatggcccaacaatggaactcctggatacataaagcaagcattaatggtcctaggagagatagaatgtgatgtgataatattagggtgcctcaatatacactttcagcaatcaacagattatccagatagagaatcaacaaagagatattgaagtcaaagtgcactctagaccaaatggtcctaacagattttttttttaaatttcacccaacagctgcagaatacacattcttctcaacagcacaatagaacattctccgtgagaaactatatgttaggccaaaaaacaagtgtaatttttttattgaaatcatttcaagtatttttttctgaccataatagaataaaactataaataaataacaggagaaacactgaaaaccttataaatatatagaattaaacaaaatgtttataaacaaccaatgagtcaatgaagaaatgtaaacggaaatttgaaaattcattgcaaatgaaaatagaagcacaacacagtgaatcatatgggatacaacaaaagtggctctaaaatggaagtatatactgtggggtccaacctgcagaccctgactcagcaacagatgagagatgtacactgacacagatattttgcctgtcagtgtggctaaggggcttctgctcctaaagctgcagcatcagcccaataagcctcaaagttcgcatttctttaatacaggttaaatgacaaaggtctcaagtaaacaccactagagggtaattaacattgccaaccccctgagtagagagcaatcatgcacccgtgggtaatcgaaggttggtcttaggaccacatgagtaaacatgctatttagataaactcccccacattcccttgttatttgctcttttgctatcaactcaaggtaaagaggattaggctgctttcagccacatattttactgaagctacgcaaatctccagccttccaagaaagtttgcttctcttttctataatttcctcttacaatttttcccaccaccctgactgaactcctacatctcccccttttctgttttttgcattaggctttattaattgaagagtgcagatgtgtgcagcaacaggtgtgtcaggcatggtggttactgctcttattctggctttgcatcctagaattagcaaataacataagacaaacatgagtataatcagcaacattcttttccaatcaaggagtgacccccaggacaggggtctatccaggagagcttatcttgcacacccttccatatggctgtttgttggatgtgtagatctatggtgtgaagggattctaaaattttagttttaagttgctttacatctgctgttaaattgtcatgaaagtttccccagaggtgttgtttcacctcatctcaactatttgttgattgattccatggaagagaagtgacacagatatgtttatgcctctagttgcagtttaattgctgtaggaatgctagcgcatcttttcgctccctgacatattccaaggcagccttgagggcttacagacatgctgcaagagaagttcattcgacacatttttggccaaattatctacaaaagcagctggttgtactgattcagtaataagtgctacagccacactagcagttgctaggatggctatggctgagactataaaggctataagtatgcctatgaatcttttgggtctgacctgggacagggcttgttctaaggtggcaagggcagaggaaccttgccaatcgcgtgtcaaattgactggtaggaatgcctcagattgtctcctcaatatcatgacactggtaatatttcaattagatatattgtaattagtgatacatgaggcaaaccaagcctgtctctgcacccgggtcacaaacatggaacttggaggtgtaatagaaatattggttcccataaggaaatcatatggatgggtagtgcaaatcaggcacagatcagtgttattatgaataaaggctatagtatagttgttactggaattatgatatattccatgccaggtgtcaagggaggtgctaagatgtcccaagtgccataaagtgtcttggggtggcatggactttacttgaggtctaggatataccatgccctgatcagcccaaatcataggggaatgggacaaggctatgatactcttattgatgccatgatggatgaggatatcagtaaggctgccctgcaaatggccgtaggggttccagtctaagatgttataattgcctaacttgaggctacgggcctcttccccatgacagacctcccagctaaagtggaatccattactttcccagctttgttcttgagcacaggaaggaatgtttgggaaagtggcattgattgcattgcccggtttgaggctacctgcagctaaggctgttaatgcatttcttttgccacgatgtagccataattgtgtttgggcaggtacacagttaagagttagaacttttataacttacacacagtgggaggatagcagagtgatatgtagtgttacctggcaccttagtccaatgtgtgtcattaatgaggaaccccactgggggcaaatctatccttcctggccaagcagttacattattaaaggctgggaaggggtgtctgcccaggtgacaaggtgaaagaaaggcggatctaagatatcatcccaatagtgtgtagcaggtacaggttgcagacaaagagcataaaaaggatcaatgccctatgcgagttgcaatgtacaacagagagcatagcaaggaacaaattatctgcagtaaatgttgtcttcatccagagcaggattcattaagcctcctgagttgtcttcttcagcatcccccaggtaacatccggggcttgtgtggtccgaggaagccacatcatccagggctgtgggtcctgtagggttaaatccttcatttctggtatcaggttgggtcctagccaagcaatgatatggcttgatgtgtcatgctggaatccaaagaggacctgagggggtgtgaacatgagcatatcctcttccccatgttaacaattcattcggaacacaccatacattactgtttacatatttccataaaagtgcaggttttatgtcttgagaggttttagcaaagtgcttgtctacagctggttgaaatttgtcatctaaactttaaaaattaagggtaataaggcttgtggtattagtgttgcagggtccttactcatactcccccttttttgttttttgagcatatttttaagagtggaatgggcacattttactatggcctgtccttggggttatatgggttgcctgtggagtgttggatgttccatgtgtgacaaaattgttgaaactgtgagctggcataagctggaccattatcagttttaatttttgtgggccaccccataaatgcaaaagttaaaagaagatgtttaatgacatatcgagtggactctctaggaacagcatgtgcactatcaacagatacatgtacatatcttagttttccaaatcagggatgtgtgtaacatctgtttgccataactgattaggttccagtcctctagcattaacacctgttgaaggaggggacatgcctgtgagctagcaatctcagattgtagaataatttgcattgtagaataatttgtttagctagactctgggtaagttgaaattgtttagataagtttctccaattttggtggaaaagttgatgcatttgagtggcttggtcaagcaatgatgtcataacctgaagttctgcttgatcattgctgtaagccaatgggccaggcagtgagctgtgggctcgaatgtgtgtaataaaaataggatgtgtacattgatctagcaattgctgaagttggagaaaaagagcacacagggtgggatccagtgtggacttaattagggctgcttcaaggttctgcagtaaataaacagggtaagccgagtcactaacaatattgaagggctgagcgaaaaaagtttccaaagccaatattaaggccccaacctcagctctctgagtgctagtaaacccagatcaagtgagggaattacatggtctccaccaaacggctgcttttccatgtttacccaaaccatcagtaaacagtgtttaagcattaggtatgggggaatgaactatttttgtaggcaacaccattgaagtacgagataagaactgaagcagtttgtcagcagggagggtatgctctaaatggcctgtgtaatcagagagtgctatctgaagatctaaagagaggggcaatactgcttcaaattgctttttactcaaaggaatcctgatgatatcagggtcacaatcttgcaactgattccattgtttgtggcctgaatatatgactttactaagtagctggatatagggagattgtgttttagtcccagtatgtgagcaataaacccattctagaaagtgtagccctggggtcatctgtcctattaatcctgtaggggagtgtttagtgggaaagataaacaactggatcgaatagcctgggtttatgtgatgtagctgcctctgagagatggcttgttctatttcttcaatctctcttttggctataggagttaaacacctgggagaatccagggctgaattgccctttaagatggaaaacagattttgcaatttatccgtagtaatgcgcaaggcacagcaaagccagttaatattgcctagtaatttctgataatcatttaagctatgtaagttgctagtatttaatttaaccttttgaggttttactgactgagaagtcagcatgtacccaagatatttccaaggagaggacatttgtacttttttagatgctatgattaaacctcttaactgtgtattctttatgacagagatatatacatttaaaagcattggctccattggggctgctagtaaaatattatccataaaaggaataaccttgcagtcaggaaactttgtcctactagggagcaaagcttgatttacatgatactgacacatggtaggtgtgtttagcattccttgaggaagcactttccaatgaaatcagcaatttcaaaagctggccttttattattgatagttgctattgtaaacacaaatttttctctgtccttctctgctagatgaatggtataaaaacaatctttaagtcaacaacgattataggccaatcttcaggaattgccacaggggaggggaggacctgttgaagagaccccataggttgcaaattagcattaatagcagttaagtagtgcaaaagtctccatttaccagactttttgggaatgacgaaaatgggcgaattccaaaggctgtttgatggttctatatggccagctttcaattgctcctcaactaattcatgggctctctgtaatttctctcccttcagaggttactgttttacttaaattggatttggaaagagtcacgttaggggtaagtttggagtaacaacagtggtcattatcagaaaaaggtctttcaaattcttaatttttactttaatcttagcagagaattataatctgggatgtcgcttgtatacaaggaacacatgaaattttgccatgggctgcgactggagccagagggcaacgatcccggggtggcaccacattgcactcacctaggcaccacttttggtctgcaccactttttgtttgtgccactcccttcccccgtcccctgtggctgctaacggccaggtagtctgtccctcacactcctcctgcctgtccttagcaggctagctccctctctctagcgtgcgcctcctctcctcccttagcaggctagctgggcctggctccccagtacactgcaggccaagttctcaggagctcttgccagctccaggtctgcgagcttccctgctgccgagcctttctatctaccgcctgcttggccatacagctccagcctctaatgccttttcttatctttttataagcattaaaagaaatgtgtttatatacctgattgccttgttgatcttgcattaccaggcaggctaagagctccccttctaatacagcttgcttaagacaggttcccacagctgtaatgtatcccttgtttttttcctattcattggaggagggggctcaggaaaaacctccgttttctctttgttgtttttaccccagtgatagcggggctgagggacagggaggtaggtggtaaggtaggtgatggttcttcctccttccccttttttggctcttctgtgcataatgggaccaaagtcacccttactggagctcacaatgttagagatgatactgggatccattgcccttgcacatgatgttgtttaagatttctccccactttttctcaaagctctacatctagtggaccttcttctgggaatcatgggttatgggataccacagtttgcatgggtcccttaattgagcctgtgaaaccaaggctccactagctttaagcagctgtgtcaatacttttatatactgtttctattgagctgataactgttgactcatgatgaaaccttagcctgaacaattccccccggaacttggaaatcccaagtgtgcaccaatgacttactgactcactaactactcagtccttttcaccttcattttcgaggggtctgtcacaatccttcacagcattcctcatgcagggtaccacctgtgggggccggcctgcagaccctgacccagcggatggatgagagacatacagtgatacagatattttccctgtcaatgcagctaaggggcttctgttcctgaatctgcagcatcagccagataacccagcaaagtttgcacttatttagtacagattaaatgacaaaggtctctaggaaacaccactagaagttaattaacattgcagaccccccaagtagacagcaatcatgcacctgtggataatcaaaggttggtcttaggaccgcaagagtaaacaagctatttaagataaaaactcccccacattcccttattatttgatcttttgctattaactcaaggtaaagacgattaggctgctttcagccaaatattttactgaagctatgcaacctcccagccttccaggaaggtttgcttctcttttctataattttctcttacaatttttcccaccactctgactgaactcctacaatattcaaacaaatgcctacagaaaatgagcaaaaagatgtcaaacaatccaatgttatacctcaaggaaatagaaaaacaagaaaaatctaaaccaaaaacaagtagaacaaaataaacaacaaatatcaccacagaaataaataaaatagagacaaaaatatacaaaagatgaacaaaacaaagagctgactttttaagacaaacagaatcaacaaacctttcaatagactaagaaaaaaagaaagaaatcccagtcagaaatgtaaaggaagacattataactgatagcacagaaataggataagtcacaactatgaactatgacaaaaaattgaaaaacatagaagaaatagatacattccaggacacaggcaccttaccaagattgaatcttgaagaaataaaagttctgagaggaacaataatgaataagacaatagcagcagcaataaaaagtttcccatcaaggaaaagcccaggacatgatggcttcattgctgaattctaccaaacatttaaagaagaactaccagcaatcctactcaaagaattttcttttaatgaagagaagggaatacttctaaattaattctatgaggccagcattaccctgattcctaaaccatacaagtacaataaagaaaggaaactttaggccagtattcctgatgaagacagatgcaaaaatcttcaagaaaacactagcaaaccaaacacaactacacattaaaaaaatattcaacataatcaaatagaatttcatctaaggcatgcaaggatggttcaacatatgcaaatcaataaacataatatatattaacagaatagaggacaaaaccatatgctctttcaggaaatgctgaaaaagcatttggtaaaaaagcattttatctacttccatttatgataaaaactcaagaaattgtgtatagaaggaaggcacttcaacaaaataaagaacatatatgaaaaacctacaggtaacattacactgaatgagaacaagttgaatgggaacaagtctctctaagaactggaacaaggatgtctactttcactaattttattcaacatagtactagaagttctagctaaagcaattagacaagtgaaataaattaagggcactgaaatttgggaaaaggatgtgttttttttcagcttccagaagacatgttcatatgtgtgtgtatatgtatatatatatatatatatatatatatattatatatacagagagagagagagagagagagaataccttgtatatgccatcaaaaattgttagaataaatgatttagtaaacttgcaggatacaaggtcaacatttaaaaatcagtagtgtctctatatgtctatagcaaactgtctgaaaaaggaatcaaaaaagcaattctcttgacaaaagttacaaaaaatatacctaggaataaatttaaccaaggagataaaagttatctacaatgaaaaatataaaatattgatggaaaattttgaagagaatgtaaataaatggaaagatatttcctatttatgaattggaaaaattcatgttaaagtctttgtgttacccataagaatctacagatttgatggaatcccgatcaaaataccaatggcattttttatagaaatagacaaaacagacacagatacttcaaaatagatatagataaaataaaaatagatacttcagatactttggctatcgagggtctcttggaaatgcaaaaaaaaaaaaaaaaaaaaaaaaaccctagatagctgaagctatcttgataaaaaaataactaacctagaggcaacacactattagactttaaaatataccacaaagtgccaggcacggtggctcacacctgtaatcccagcactttggaaggctgaggcaggtggatcacgaggtcaggagttcaagaccagcccggcaagatggcaaaaccccgtctctactaaaaatacaaaaattagctgagtgcagtcacaggtgcctgtaatcccagctactcaggaggctgaggcaggagaattgcttgaacctgaggggtggaggttgcagtgagccgagatcatgccactgcactccagcctgggcaacagagtgagattctgtctcaaaataaataaatacataaattaaattaaattaaacaaaataaaataaaatataccacaaagctatagtaactataacaatatgtaactggcataaaaacacatagacaaattgaacagaatgtagaacccagaaataaattgatgcatttacaaacaatttataaccaagccaccaagaaagcacattgaggaaaataaactttttaataagtcatgctgtaacaattatacatccacatgcaaaaggacgagactatacactgtttctcacaacatcaaattatcaactctaaataaattaaagacttaaatataagtccttcagctatgaaactactggaagaaagcataggggaagtgcttcatgaaattgcactgggcaaagagtttttgaataagacctaaaaagtgtgggtaagaaaaacaaaaatagggaaatggtatttcagtaaaccagaaagcatctgaactgcaaaggaaatggggtaaagagacaacctacataatggtagcaggtatttgcaaactatgcatctgacaaggggttaatatccagaatatataagaaactaaaacaactcaatagcagtttaaaaaagaaaacacaaacacatacacacacacacacacacacatgcacacacacagagacacaacaaaacaatccaattaataaatgtgcaggttggagccaagatggccgaataggaacagctccagtctacagctcccagcatgagccacacagaagacgggtgatttctgcatttgcaactgaggtacagggttcatctcactggggagtgtcggaaagtgggtgcaggacagtgggaacagtgcaccgtgcatgagccgaagcagggcgaggcatcatctcaccgaggaagcacaaggagtcagggaattccctttcctagtcaaagaaaggggtgacagatggcacctggaaaatcgggtcactcccaccctaatactgtgcttttccaatggtcttagcaaatggcacaccaggagattacatcccgtgcctggctcagagggtcctatgtccacagagcctctctcattgctagcacagcagtctgagatcaaactgcaaggcagcagcgaggctgggggaggggcacccgccataaccaaggcttcagtaggtaaacaaagcgtccaggaagctcaaactgggtggagcccaccacagctcaaggaggcctgcctgcatctgtagactccacctctgggggcagggcattgccaaacaaaaggcagcagaaacctctgcagacttaaatgcccctgtctgacagttttgaagagagtagtggttctcccagaatgcagctggagatctgagaacagacagattgcctcctcaagtgggtttctgacccctgagtagcctaactgggaggcaccccccagtaggggcagactgacacctcacagagccgggtactcctctgagacaaaacttccagaagaacgatcaggaagcaacatttgctgttcaacaaaatctgctgttctgcagcctccgctgctgataaccaggcaaacaggttctggagtggaactccagcaaactccaacagacctgcagctgagggtactgactcttagaaggaaaactaacaaacagaaaggacatccacaccaaaaccccatgtttgtcaccatcatcaaagaccaaaggtagataaaaccacaaagatggggaaaaaacagagcagaaaaactggaaactaaaaatcagagcacctctcctcctccaaaggaacacaactcctcaccagcaatggaataaagctggatggagaatgactttgaagaggtggagaaggcttcagatgatcaaactactccaagctaaaggagaaagttcaaaaccatggcaaagaagttaaaaaacttgaaaaaaagttaggcgaatggctaatcagagtaaccaatgcagagaagtccttaaaggatatgacagagctgaaaaacatggcacgagaactacgtgacaaatgcacaagcctcagaagctgattcaatcaactggaagaaagggtatcagtgatggaagatcaaataaaggaaatgaagcaagaagagaagtttacagaaaaaagaatgaaaagaaatgaacaaagcctccaagaaatctaggactatgtgaaaagaccaaatctatgtctgcttggtgtacctgaaaatgacggggagaatggaacaaagttggaaaacactctgcaggatataatccaggagaaattccccaatctagcaaggcaggccaacattcaaattcaggaaacacagagaacaccacaaagatactcctcgagaagagcaactccaagacacataattgtcagattcaccaaagttgaaatgaggaaaaaatgttaagggcagccagagacaaaggtagggttacccacaaagggaagcgcatcagactagtggctgatctctcagcagaaattctataagcaagaagagagtggggaccaatacttaacattcttaaagaaaagaattttcaacccagaatttcatatccagccaaactaagcttcataagtgaaggagaaataaaatgcttcacagataagcaaatgctgagagattttgtcaccaccaggcctgccctaaaagacctcctgaaggaagcacgaaacatggaaaggaacaaccagtaccagccactgcaaaatcatgccaaattgtaaagaccatcaaggctagaaagaaactgcatcaactaacgagcaaaataaccagctaacatcataatgacaggatcaaattcacacataacaatactaaccttaaaagtaaatgggctaaaaactccaattaaaggacacagactggaaaattggataaagagtcaagacccatcagtgtgctgtattcaggaaacccatctcatgtgcagagacacacatagtctcaaaataaagggacggaggaagatctaccaagcaaatggaaaacaaaaaatggcagggattgcaatcctagtctctgataaaacagactttaaatcaacaaagatcaaaagagacaataaaggccattacacaatggtaaaaggatcaattcagcaagaagagctaaccatcctaaatatatacgcacccaatacaggagcacccagattcgtaaagcaagtccttagagacctacaaagaggcttagactcccacacaataataatgggagatttttacaccccactatcaacactggacagatcaacgagacagaaagtaaacaaggatatccaggaattgcactcagctctgcaccaagcagaccgaatagacatctacagaactctccaccccaaatcaacagaatatacattcttctcagcaccacaccacatctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacacaacaaaatgaaggcagaaataaagatgttctttgaaaccaatgagaacaaagacacaacataccagaatctctgggacacattcaaagcagtgtgtagagggaaatttagagcactaaatgcccacaagagaaagcaggaaagatcttaaattgacaccctaacatcacaattaaaagaactagagaagcaagagcaaacacattcaaaagctagcagaaggcaagaaataactaagatcagagcataactgaaggagacagaagcacaaaaaacccttcaaaatatcaatgaatccaggagctggttttttgaaaagatcaacaaaattgatagactcctagcaagactaataaagaagaaaagagagaagaatcaaatagatgcaataaaaaatgataaaggggatatcaccagtgatcccacagaaatacaaactaccatcagagaatactataagcacccctatgcacataaactagaaaatctagaagaaatggataaattccttgacacatacactctcccaagactaaacaaggaagaaggtgaatctcggaatagaccaataacaggctctgaaattgaggcaataattaatagcttaccaaccaaaaaaagtccaggactagacggattcacagccgaattccactagaggtacaaaattcaacagcccttcatgctaaaaactctcaataaattaggtattgatgggacgtatctcaaaataataagagctatctatgacaaacccacagccaatatcatactcaatgggcaaaaactggaagcattccctttgaaaactggcacaagacaggaatgccctctctcaccactcttattcaacatagtgttggaagttctggccagggcaatcaggcaggagaaggaaataaagtgtattcaattaggaaaataggaaatcaaattgtccctgtttgcagatgacatgtctagaaaaccccatcatctcagccgaaaatctccttaagctgataggcaacttcagcaaatctcaggatacaaaatcagtgtgcaaaaatcacaagcattcttatacaccaataacagacaaacagagagccaaatcatgagtgaactcccattcacaattgctttaaagagaataaaatacctaggaatccaacttacaagggatttgaaggacctcttcaaggagaactacaaaccactgctcaatgaaataaaagaggatacaaacaaatggaagaacattccatgctcatggggaggaagaatcaatatcctgaaaatggccatactgcccaagataatttatagattcaatgccatccccgtcaaactaccaatgactttcttcacggaattggaaaaaactattttaaagttcatatggagctgaaaaggagcccgcattgtcaagtcaatcctaagccaaaagaacaaagctggaggcatcacactacctgacttcaaactatactacgaggctacagtaaccaaaacagcatggtactggtaccaaaacagtgatatagaccaattgaacagaacagagccctcagaaataatgctgcatatctacaagtatctgatctttgactaacctgaccaaaaaaagaaatgagggaaggattccctatttaataaatggtgctgggaaaactagctaggcctatgtagaaagctgaaagtggatcccttccttacaccttgtacaaaaattaattcaagatggattaaagacttaaatgttagacctaaaaccataaaaaccctagaagaaaacctaggcaacaccattcaggacataggcatggagatggacttcatgtctaaaacaccgaaagcaatggcaacaaaagccaaaattgacaaatgggatctgattaaactatagagcatctgcacagcaaaagaaactactatcagaacgaacaggaaacctacagaatgggagaaaatttttgcaatctactcatctcacaaagggctaatatccagaatctacaatgaactcaaacaaattgacaagaaaaaaacaaacaaccccatcaaaaattgggcgaagtatatgaacagacacttctcaaaagaagacatttatgcagccaaaagacacatgaaaatatgctcatcatcaccggccatcagagaaatgcaaatcaaaaccacaatgagataccatctcacaccagttagaatggcgatcattaaaaagtcaggaaacaacaggtgctggagaggatgtggagaaacagcaacacttttatactgttggtgggactgtaaactagttcaaccattgtggaagtcagtgtggcgattcctcagggatctagaactagaaataccatttgtcccagccatcccattactgggtatatacccaaaggattataaaacatgctgctataaagacacatgcacacttatgtttattgcagcactattcacaatagcaaagacttggaaccaacccaaatatccaacaatgatagactggattaaaaaaatgtggcatatatacaccatggaatactatgcagccataaaaaaatgatgagttcatgtcctttgtagggacatggatgaaaccggaaaccatcactctcagcatactatcgcaaggaccaaaaaccaaacaccgcatgtactcactcataggtgggaattgaacaatgagaacacatggacacaggaagaggaacatcacacatcggggcctgttgtggggtggggggaggggggaaggatagcattaggagatatacctaatgttaaatgaagagttaatgggtgcagaacaccaacatggcacatgtatacatatgtaactaagctgcacgttgtgctcatgtaccctaaaacttaaagtataataaataaataaataaataaataaataaataaataaaacagcccaattttatgtggatcagtgctcctaatggcttagggtaaaatgacagctacagtgtatctagaatgttaaagtggcatgtcttagacaacgtggatgtacataaggtatttgagagaatactccataatagcaaaaaactttgtaaagactaaaatattaaataagacctttttttcctgagcaataatttgcccaggctggtctcaatctcttggcctcaaacgatcctcctgccttggcctcctaaagcattgggattataggcgtgagccactgctcctggccagaattcttgattaaacaatagggtctaaataaatttaaaacccttttattctttttattcttacagggtagactcaaatattctatttctttccaactttgtagtcttgtcataacaacccaatattctctggggcaagtggatgcttatgaccaactggcctgaaatgggggaatatagggttagtggtgagtcacgtctaagaaaatgcaagagaatagcaccgtatcacatttcaaaataaaatacaatctacatataaaactgaaataaataaataaataaatgtgcaaaagacctgaatagatatttctcaaaagaagacacacggctgggcacagtggctcagacctgtaatcccagcactttgggagaccaaggtgggtggttcacaaggtcaggagatcgagaccatcctggccaacatggtgaaaccctgtctcttctaaaaatacaaaaaaaaaaaaaaattagctgggcatggtgacatgcacctgtagtcccagctattcaggaggctgaggcagaagaatcacttgaacctgggaggtggaggttgcagtgagctgagatcacatcactgcacttcagcctgggggacagagcgagactatctcaaaaaaaaaagaaaaaaaaaaaaagaagacacacaaatggccaacagatatatggaaaaagcctcaacaccactaatcatcagggaaatgcaaatcaaaaccaaatgatatatcttcacaccctaattagaacagctattatcaaaaagacaaaaagatataataaatgctggtgaggatgtggagaaaggggaattcttatgcactgttggcaggaatgtgaattattacagccattatggaaaacagcatggagtttcctcaaataattaaaaatagagttactatattctccagcaattccactattggatatatatctacaaaaagtaaaattagtatgtcaattaggaatctaaaaacgttgatttcatagaagtagagaatagaataatggttactagaaactgggatgtggagagcaggcagtgtcactaggtgtgagacaagaggaatatctattacatggtagggtgagtatagcaaataagaatgtaatgtatatttcaggataactagaaatgaataatagttaaagtgatggatatggtagttatcaacatttgatcattatacaatgcatacctacattggaaaaccacactgtatcccataaatatatacaattattttgttccaattatacattttaaaattacttcacagaaaggaaaaaagcttcaatacatagttaattattttgcatcaaatggaaaaaatagaaaatacttgtaaagaaatagaacgcataaagaaaagaaccatatggaaagtcttagaactgaaaaatcaaataaaaataaaaatcacctgtggaaatggtcaatgtaagaatagacatgacagaagatagaatcagcaaacttgaggacagaaaaatagaatttacatcgtatgaacaacagagaaaatagactgaaaaataatgaaagtctcagaaacttgtgaaacaataataaaagagttaacatttataattgcttcaaataaagtaaaaatcttaagtaaaatctgtcaaaacatgtaaaggaactgtgtcctaaagatttcaaatattaatggcagaaattaaagaagagttaaataaaagtaaatacataccgtatgcatagattggaagacctaacatagtaaagatgtcaactctcctatttgatctataggtttaatgtaacatttatgaaagtttgagctaagctttatagacatacacaatgttcattttagttttctttttttttttttttttttttgagatggagtcttgcactgttgcccaggctggcgtgcggtggcatgatctcgactcactgcaacctccacctcccagattcaagctattctcctgcctcagcctcctgagtagctgggattacaggcgcccaccaccacgcctggctaattttttgtatttttagtagagacggggtttcactatgttggccaggctggtctcgaacgcctgacctcatgatccacccacctacgcctcccaaagtgctgcatcttagattacatgcaaatgcacaatatctagaatagctagaataattttaaaagggaagtatatggctgaaaaaagtattctactcaatgttaaggcttactgcatagctactgtaatcaagaaagtacattgtttggagaacgaaagagataacccagaaatacactcacagaaatatgtccatctgattttgacagaggtgcaaaagcaattcagtggagaaaagacagtaataaactgtcttttattcaacaaatctcaacaaatggaggaattgaacatacgtagaaaaaaatggaagtcccacaaactatcacagtgtaccccataaatatgtacaattattatgcttcaatttgaaaataaaacattaaaactattagacgtaaacctcatataaatattaactcaaaatggaaaactggctaaaatgtgtatatatatttatatatatgtatgtatatatgtatataagtatatatgtgtatatacatatacacatgtatagatgcatatacatatatacacatgtatatatgtgtatacatatatgtatatatgtatatatgttatatgtatatatatacacacacatatatataagtgtatatatatatatatatatatatatatattttttttttttttttttttccagacggagtttcactcttgttgctcagactggagtgcagtggtgcaatcttgtctcaccacaacctctgccttctgggttcaagcaattattctgcctcagcctcccaagtagctgggaatacaggcatgtgccacgaggaacttaaaaatttacaagaagaaaacaataacattaaaaagtgggcaaaggacagccaggtgcagtgtctcacgcctgtaatcccagcactttgggaggctgaggcggatggatcatgaggtcaggagatcgagaccatcctggctaacgcggtgaaaccacgtctctactaaaaatacaaaaaattagctgggcctggtggtgtgcgcctgtagtcccagctactcgggaggctgaggcaggagaattgcatgaactcgggaggcagagcttgcagtgagccaagattgcaccactgcactccagcctgggcgacagagcgagactctgcctcaaaaaaaaaaaaaaaaaaaaaaaaaaaagtgggcaaaggacatgaagaaagacttctcaaaagaagacattcaaaactctacaagccagaagagagtgggggccaatatttaacattcttaaaggaaagaattttcaacccataattatatatccagcctaactaagcttcataagcgaaggagaaataaaatcctttacagacaagcaaatgctgagcaattttgtcaccaccaggcctgccttacaggagctccagaaggaagtactaaacgtggaaaggaaaaacctgaccagccactgcaaacacatatcaaattgtgaagaccattgacactatgcagaaactgcatcaactaatgggcaaaataaccagctagcatcataatgacaggttcacattcacacataacaatattaaccgtaaatgtaaactggctaaatgcccctgttaaaagacacagagtggcaaattggataaagagtcaagacccatcggtgtcctgtattcaggagacccatctcatgtacaaagacacatatgggctcaaataaagggatgaaggaatatttcccaagcaaatggaaagcagaaaaaagcaggggttgcaatcctagtctctgacaaaacagactttaaaccaacaaagatcaaaaaagacaaagaaggggattacatgataataaagggatcaactttacttttgcagaagttcaccaatcctttcagcaaattggtcagcaatatagtaggcaaaagtcataagtgaatattgagcacttgaaatgttgccagtttgatagggaaattgaattcttatttttatttaggtttaattaacttaaatttaaatagccacatgtgactagggcctagctagaaaatgcagagctagaggcagagctctgcatttgcctagaaagagcaaagctagtaaatgaaaacattgttttattgtaaaataaggaagaaatgaattaaggggcatggaataaaactaaggaaatgtaggcatgatttgtaatctagaaaatcaacgggaaatgaaaacttactagtgatagcatactattttataaaaatgtatccttatctttatagtttgctttaatgtctttctgaattgagaaaataggttcctgaaacttatgaatggttttgtgtggctgatagctcttgctagtgagttttttgaaactcaaaaatgtgttaagcagatccctgtttaagatcatgctaattatagaaaacaatagaaagcttgaaaagttctcaagaactactaatgctgattgaatactttaaaagaggagagaggaagaccaagagcaggatcgctgggaggacaacacatctttaagctatacttaccttctggtcctctttaaaaagtggcaaagaagcccaaaaattaaagaaagaaaataaagaaaaatgaaagaccagccctagaaagttatttttatacaaccagagagacctcttaaatacattgttgcttacatccagtggtgtgctggtaaacctgctctttaggggggaaaaaaacttaatttgcagtgtttgccagtttccattgtgtaaatacttccaccttagccaatttcaagatacagacagtttaacatccaaatttcggaatatttaacaatcagctcttgtcatgctgccaatcattagactagttcagatctcgagatacaggtgtgcgtgcgtgtgtgtgtgtgtgtgtgtgtgtgtgtgacagagagagagagagaggaggtacttgccttccataactaaagtgcttcattgcttcatttctctaggtctctgtttatgctcatgcatgtatatttgaactcagaaagcaagaaaatataagaaacaaaattatagtaaggcatatttaacatgtagtgaattttctccccttttagcttcaaaaattaggatgaccttttgtctccttaaagtattggcagaattgaggcaaagactaaactttagacaggttcctcttagtcatattttttactaggcgtcatccttggtccttgtcttcagcctatttgtccagtttaacaataattctattaattttgtttacagagagttccccacccttgatatttgatcatcctcatttctgatcaaattcctcattcctcgccttgatatctgatcaccttggccatcagcaagaatcctgttacattggtttagcaagaattgcctccaatgtgaagtctcctcttagtaattccatctagtgaacctgccattctgctcattgactatatattccctgggttctttgctgtattcagagttgaacccaatctctcacctctattgtgacagtcctgatacctactttaataatcctgaatcaagttttccttacattttaacaagtgtcagaataattttccacagttatggggctacaacttagcatcaaatgtgtcattggacccccagacttctcacccaagaccctaagtgtacgccattgaagcctttgtcttcactccttagttattgatcagagatccattggtgagtccaactcttgagccagtgctctggatgacagtccactgaagcatgttaaggacagattttaattcctaggattctgagtacattctccgaagctcaattagatatcttgaaaggtacttcctaagctggaagttcctcctggaacttttgagtggatattcacttacccgtggctcggaatttttttttttcttggctgcttgtgaggcctctttgttctatttgatcctgcttttcccataggaaattttctgtcaactgaacctccctttgttgaacccttggtaactatatgttctaccactatggtgctaactgcccactttctaccttgttggcatgattttactgagaaaattggaactccattggcttcttcagaaaacttaaatctatccaaacttgctcatctatgacctctcccttccgataacttctgctcctccctccttcttttaccaccttccatcttcccttcagtttccttggattctttgaaatgtcttccttcacaacagtctacctcctccacacatccatccatccctgccagacttttcccttcccattccagctcctaaattccctacagtcacttgaactttaggcccctcctcccccattagggctctcaaggtatttggggaacttaaaaccaagtacatattggaacaaaagaaaatcttaaaagtctcctccatgaatattgttaaaaagaaatattgagaaggtaacatttttttatcaccagcaatacaattcagataaaaatatgaagcagagagaagatgagaaccagctattttaaataaactgttgagttttatattactgtatttatcagactcatgacaaatttcagaataaaagctatagtgtctatttgcatctgtctgtgtatgtttgggtatgtatgtatgttatgtatatgcaatattttttatttccaaataacattaccaaattaattcctaaaatcatatagtcttttctgataggcttagggataatcacatatgtaaataaaacattccttaaacttccagaaatatagaaactaatcaaaatgtttttcaagtatatgtaattacataaatttggtaaataagactagtttgatattattggtttaacaaatatgggtatgccttctgagttatcagcattaagtacataggggaagaaaaatactttccaccctttcaagttctcagatagggctctaacaagagaaatattgacagataaaagcatacaaatgcatttattattagttttttgtgacatgaaagccttcatgatgaaatgaagacctgaagaaataattaaacctgagtttttttatgataggtttgatgaagagtggaaagttttggaagaatgtcataagacaaagggtatgagctaagtgtagtaaactgaaaggatcttaacatagctcgttcattcaaattcctctcactgtccctccatcttcagagataaggatgctcctttcctctgggtattgggagggaacctgttatataaatctgttattatctacattagtggagaaggacagaggaatgtcagagtccttcctgacatttctcaagttcttttagcttaaaatagttaacatgccaaggtgccatattttgtgatagtgtcttctaaacctatcgagtataatatgaacatacgtttttactctacttggttttactagtgaaataaggtaatattgtaacagtgaaaaggaagtttagcacaactaaccgcatttcgctcctagcctctgcatggtgatatcttttaaattacttttgcttatctctgcatgcagggcaaactaactatggaaggaatttaatttatagttctactttaaatcaaggacaataatgatatcttttccaatgctaaccccccgaggaaataagaaagtatgtacatactaatgatgttatgctaaagattgacaggaacatttgtgacctgaatattacaccattcaaagtcaacggaaaaagaataaagaagtttcacagtcctcttagacccttgctgctgcccagatgtctgtggtcattggtcacctcttgacctcaccccccactttttcctccctcctcagaggaggagcctaaaatttatattaccttaagatagttctttaggatactaattctgctatcttttctgtttgctggctctgaataaagttgttttccttgtccaaataccttctaccaacttattggctgtcatgcagtgagtgctacaagcactggacttggttactagatgttcaagattataaaaattatagattcaacctaagaacagaagtccaagtaaacagcagtaaaaataaaacaaaaaaatagctgggcatgtggctcatgcctgtaattccagcactttgggaggccaaggcaggaagatcacctgaggtcaagagttcgagacctgcctgaccaacatggagaaaccccatctctactaaaaatacaaaattagctgggcgtggtggcacatgcctgtaatgccagctactcgggaggctgaggcaggagaatcacttgaacttgggaggagaaggttgcggtgagccaagactacatctcaaaaaaaaaaagaaaaaaataataagtttttttggttttaactttttgatacatttctaacatgcatgtgctgtaaaaataattaacaggaaaataatttgagatgatgactagctagtttaatgtaataatacatttgcttaaaaatacttttcaaaatctttttggtaacttgcaaatttaatgttatgctaagttaagtaacattaattaaatatttagatcaattctaagtaacataaaatacaaatgtatttataagtttaagtttgtatactcttggcctcttatttttatataatacaaaaaaattaaatatattcaagtctgctattaaaatgttcttattgttggccaggcgcagtggctcacgcctgtaatcccagcactttgggaggccaaggcgggcagatcacaatgtcaggagttagtttgagaccatcctggccaacatggtgaaaccttgtctctactaaaatacaagggaaaaaaaattagctgggcatggtggtgcgcgcctgtagtcccaactactcgggaggctgaggcaggggaattgcttgaatcagggagacagaggttgcagtgagccgagatcacaccactgcactccagcctggtgacagagtgagaccccatctaaagaaaaaaaaaaaggacagaaaggacttcgacaaagagggagtatctaagagactcatagaaaggactatgactagtattacagggtacaggcttctgaaggcattgcttaaataacttggaaatcatatcacttgactgcatgaggatttccagaattttagtagagaagatgatgggttcatcaaactgtgaacccaagatttagaagaataggaagtaattacacaggattggataaatttataaagaatgcttataatttattatgactttttgagtggaaactggctagttctttaatatcaatgttctggatgtaaggaaactgtttcccttttctcttaaattatttctaataattaacaattagtaaattatatatttgtaaacagaaatgcaacatttaattttctccctgtctgttctctccagaatctggaaattcttactgagtgatctcatttttattgtaatataattatttgcataaagtaaataagaatatgttccacttttgaagagacataattggaatcattcattgcataaccaagactttgactggaatgtcgtatttgataaagatgtgcatagtgtcagatatgaccagacagttttaataaactaaggttgattgagtggagccagttcttacaaagctttcttggggaaaccagcctggtatccggcttacagagtttccagccttacaatgagtgagaaaggtcttcttggcaggcctttgaaccttgaaatctttgagggatctcaaaaagagaggactccacctagatctaagggttaaatttggcaggtaaaatctggtggtgtgttctcggcttgtctttctagcctggagaggattttcaaagtctaatctgagatttcacgtgagaagttccagcaaagcagactcaaaaagacttacgtggtcaattatcattcttgccaccattatgtaaataatcaagccaaatctaataatttgagacttattaactaaagaagaataaaaaagactgggggaaacataaagagggaaactttatgattcaatggaaaactgtaacacacccttgtaggttattagatttgagtcttattaattgtctttgaggtttttttacttaacgtataactgtactggatctttcaaccttccatatttaatcagtccttatcaacttgtcaattcttctaattttctctaatatctggctacaacctccaaaactaatgttttcaatttttcttccactttcctgacttggagtcactaagaaccgaaatcttactgctcagattgagactatctgaaaaagccctgttagaaaaagctggatgtttctatactctgctcttgggaaataaccatgactgtgacactgatgtttataccatcaccagagacatccaaactgcagaccaggaaatccatcagatggttcctgctgtcctcactttatcatctaaaggtctaaagatgctttaatcccaatatctagaaatgtttaaccaacatcaagaaatcttctcaactggctgctctctggactcagaaactgggttaatagtctgctccaactattaatcattgttattttattttattttcatataaaattttctctttaaatgccaggggtgggcaattctcagaactgagggttcctcctccttttataccatatagggtaacttcctggcattgccccctacaactggggaacacacagcagtcatgaaagtcccagttgctccagccttgggaccaggggaccttgcagcctgtcactcagagagctgttatggagcatctgctctgtgccagctctgtaccaggcagtcagcagggcaggtgcagtggctgccctcatggattgccatggcatctgtaaactgttgtgggagcactgatgggagtgccttttagcatgctaatgcattataattagcatataatgaacagtgaggatgaccagaggtcacttttattgtcatcttgtttttggtgggtttgggcttgcttctttaccacaacctgttttatcagcaaggtctttgtgacctgtaccttgtgcccacctcctatcccatcctgtgacttagaatgcctaacccctgggaatgcagcccagtaggtctcagccttattatacccagctcctattcaagatggagttactctggttcaaatacctctaacataatattatgtgtgaatattcattaacaagaatggtttttgagaatatgtacctatatcaatacaattccctctatatattaaacaagtcattaaacacgattgctggcctagcctttgcctgtcatatgtgtcttagatatttttccactttattatttgttttttgactcttctatcttgcccttgcaaaaatattaaatttcccaatttaaaagaaaaaaaaaaacacttctctgagaaagagaaggggaacaacaaacctggtctcaaggccagcaactgtgatgtggaaggaaaagataacagagaaataaaatttacccaaaccttataaaatagaagattgtgggggtcagataaatactagtgaaaaaaagaaaggagaggggtaagggagtaaaactccaaagcaaacccatgataatactacctaattttcaaaacaatgtagcattcactatgttctactatttttctcatcactatgttctactatttttcgcatcataaaatctccattttataatggagaatagaagaaattttaaattgggtatatcaagttctctgattgtctaccaggttaaaacagttattttcttttggccttatctctttagatatatatgcagttctattcaaaacttcaaatcccactctgaatctttgcactgtatgatgtcagccacctaatctttcagactctgctctttctcttaagtgatgctgtaagttctataaatatttggtgcattgaaaccaaaaacgtgtccaaaatcagaccctactaacttgggaattttcattctcacaactccttctcttaactcaaatcaatccctttcatattccaatttcttattttttgtcaggaaggagctattgatattaactcctatctgtactttcctatacccagagggagaagagaaaaaaaaaaaaaaaagcaagtgaggcgataactccaataacaaacattcccgtgtcaacaacactttttttcacttttccactagttgtgcttctttggctacaaggtccgctctatgtattaattctggaagtatatctgataatattaagaacatttatattccccttgaaaaagcctccaaagaaaagaccctaataacttctgaacttaataacaaaaattatatttgaaaatgatacattacaacaacttttgaataaatatacttcctctacattttttgccaacctagtataacaaatataaaaatttagtcttacacatagactttttaaaaatgttctctagtaactaaaatagctgacatttgtctggggccaagattactttctgccagtttactctcaccctttgggatactagtataaaaggtcttcctatttatcatggtggctgatccaggctgtttcatctcaggaaacatcacagtggctgctctacttaacagtctgcagttgctgaggaattttgcattaattacttcaaaggagagtttctattgtttctacagagaagacactagaacaaggaagagaagaaaaagacctcaaagctttaccctgacatttatcaaatatcacctctcccctcacccttcattcctattcagaaataattcactttttagttgatctttgccagtatcctcaaaatatatgctatttagaaaaatttgaatgcaaggcttaactgatttattagctatcagctaaaacttcggttgttctaacaacagttaccaatttgcacccgtaacaactcaattagattgccaagaaagcccttttaaacaaatagtttgtttctctgaggaaacataaattagccaggcagaaattttagagatgaactttcattgagtcctaactctaaacttcatggaagatatatgatggtatttgaaatgttgacaaattttagtatttcacatatattaaaattaaaatataatttaaaaaaattattcaaactccaaatagattttacttttcaattattcgctcctttacttttgtttaatgtgaatcctcttctactaaagtgaaaagttgagagccacctagatatctcatgactggcttttctatcttatctatactgtggaatttttgtttttcacaagagattatttttctaaagatcttttcaaaaattattgtgtgtagagttatttgatatatatttaaaatatttcatatgtacagtttcaaagatttttacaatttgagaaatcatcactactatcagaagagtgaacatatacaccacctccaaaagtttcctcatagccctttgtaatccctctccagccttgcacacatacactccccaagcaacaatgaatgtactttatgttattttagattagtttgagttttctagatgtttatgttaatggaattaaataatatgtactccttattttcaggcttcattcattcaggatagttatttttatattcatccacattattggcaatttatttctctttatggctgagtattattccaacctatgaataaacaaattgaccacaatttgtttatctattcatcccttgagagacaattaaattatttctagtttttggcttttacatacaaaagtgctatgaatattcatgtacatgtatttgtatggacaatatttcatttttccttagataaatatctaggagtagaatagctggatcagatgttagctatgtgtttaaatttataagaaattgtgaaactgtcagaggtgtttgaaccagaatgactccatcttgaataggcgctgggtgaaataaggctgagacctactgggctgcattctcaagaggttaggcattctaatcacaggatgacacaggaggtcagcacaagatacaggtcacgaagtccctgttgataaaacaggttgccatgaagaagctggccaaaacccatgaatatcaagaaaggtacgaaagtctggtcatcctcactgctcattatatgctaattataatgcattagcatgccaaaagacttccactagcaccacgacagttcacagaagtcatgggaacaccaggaagttatcctatatggtctaaaagggggaggaaccctcagttctgggaattgttcacacctttcttggataactcatgaataatccatcctttatttagtatataatcaagaaataactataagtatactcagttgagcagcccatgctgctgctcagcctatgcagtaaccattcgttcattcctttgcttccttaataaactttttttttatttactctatagactcaccccaaattctttcttgagcaaggtccaagaggcttcttttggatcaggatcaggacctgtttctggtaacaaaactattttccaaaaaggttgtcccattttacattctgactagcagtattttagagttccagtttctgcacacatctttaacaatacttggtatggtcagtctttttcaatgttagctattctagtaagtttgcagtgttgtcattgcagttgaatttgtattttcactatgcctaatgatgttgaatacctttttaggtgcttgtttgccatttatgtatttttcttgtttcaaatattttctgacttttactaggttgtttgttttcttattgataagttttttacttttctctgtataatctggatacaagtccttcatcaattatataattttcaaagatcttttcttagtctgtggcttttgctttaattttcttgtgtctttcaaaaagcaacaattttaaattctgataaagtcaagcatattaatttttgttttatatattgtattttttctgttgaatcaaaaatatttttctaacacaatgttacaaagatttttttttcttctaaagttttctagttttggccaggtgcagtggctcacgcctgtaatcccagcactttgggaggctgagactagcggatcacgaggtcaggagatcgagaccatcctggctaacacggtgaaaccccgtctctaataaaaaaaaatacaaaaaaattagccgggcttagtggcaggctcctgtagtcccagctactcaggaggctgaggcgggagaatggcgtgaacacgggaggcagagcttgtagcgagccgagatcgcgccactgcactccagcctgggcgacagaccaagactccgtctcaaaaaaaaaaaaaaaaaagttttctagttttaggatttacatttaggtctgtaatctgttttagaagaatttttgtatatggtatgagggtggatcaaagtttataatatttgccaatgacaggatctcattcttttttatggctgaatagtactttataagacctaatatctataagacctactatatgatagcacaacagggtgactatagtcaatgaaaatttaattgtacatttttaaacaactaaaataatataattggattgtttgtaacacaaagaatgaatgcttgaggggattgatacctcattttccatgatgtgaataccatacattgcttgcatgtatcaaaatacctcatgtacaccataaatatatatacctactatgtacccacaaaaactaaatttttttaaaaagtttataatatttacatagatatatccaattactccatccttatttgtttacaaaactgtttcctccatttaatggttaattgccattaaatctttgtaaaaatcagttgtctctgtaggtgtgggttcatttctagacttttttttattccatggatctatttctctgtcattaggttaatcccatacacttttgctaactgtagctttataataattattgaaattaagtagatttagctctccaactttgttctttttcaaaatttatttaattattgtaggggctttacatttccatgtaaattgtataatcagtttgttgatttctataaaaacacttcagaaatttaacttggattgcattgaagttatacataaatttaaaaagaaatgacaccttaacagtattaaaacatctgattagttaacaaagtatatttctcaaattatttaggtcttatttcatttctttatcatggtttggtagttttttttgttttgttttgttttgagacggagtcttgctctgttgccccaggcggagtgcagtggcttgatctcagctcactgcaagctccgcctcccgggttcacgccattctcctgcctcagcctcccaagtagctgggactacaggtgcccaccaccatgcctggctaattttttttgaatttttagtagagatggggtttcaccatgttagccaggatggtctggatctcctgatctcatgatccacccaccttagcctcccaaagtgctgggattacaggcgtgagccaccacgcccggcccatagtttggtagttttaaaagtatatgtctctcacatatttcatcagatttacttttaagtatttttatttttgattccattatgaatagtaatttttaaaatttcaatatcccattttcattgttagtatactcaaatacaatttaatgtataccaaatttgcaccctgcaaccttgctaaacacacaaattagtatattcctttagatttgtaaaatatatgatcatgttgtctgagaaaaaaagagttttacttcttccttccaaatataggtgtcttttatttccgtgtcttgttatatgccactggccaaatctctaatttaatgctgaattgaagtgcaaagagcaaatctttctgtatttttttctaatcttaaggagaaccattgagtctttcatggtcaaatatgatattagttgcatgtttttcttagatgcccatcattaggttaaggaagtttcctttcttgaacattagttcaagtttccttgaacattagttcaagaagtttccttctgttcctagtttgctgagagaattttcatgaagaatggatgatgaattttgccacaatttattcagtaactattcagatggttatatgtttgtctttgtgttattaatatggagaattactctgatcgattttaaatgtggatataaacacagattactaagataaataccaactgattttctttatacttttaaaatattattgcattcaatttgctaattttttataattttatgtcagtaaaatgggatatttatctgtatttttttctttttattttcctttcttataatgcctttggctgattttggtatcagggttgaggaaagaaaataacttccatctgaggaatacaaattcttttagttaacaggtccagagagacattaatatgaaacagaaatcatgtttcactttccccttgaagctacgtatttatttcttgaaagtgcatgctattgttacaagtagctataaaattcacctaattcatgcaggacattgtaacccacaccctatagtttagtaatacataactaatcattaatcaatgttatttttgtaaaccactgagaattcctgaaaaacaatactgtattagcccattccctgtcacccattttttgtctttaaacagacaagtctaactgctgttaatcagagtgcacattcggcaactttaatatatgtgcctgggttgcaatgctcaagtttggcccaaatatactctctccttatattaattttgcttcagcttcttccctttaggttgacagggtggtgcttttctcataaaatggttggagaagtacttcttctgattcattatttggacaagttaaagtagaattggtattaaatatttggtaaaatccatcagtgagcaatttgactcagtgttttcttggtaagatttctcactagaattttaatttattaaatagctataagtttattcatattatgtattttttttagtgagtttaccagtttctgtatttcaagtaatttatccatttcatctaagttgtcaaattagttggcataaggttgtttatagtattcccttaatatccttaaaaagataccatagagtatacataacttgtactattttaactgtttctaaatgaacagtatagtggcattaagtacttgcacgtcattgtgcaaccatcacaaccattcatctcaagaagagttttatattcccaaactgcaaccctgaaccattaatcaaaaacttcccatgtatccctccttttagaccttggaaaccacctttacacatttttattctgtgaatttggctacactagaaaccatatatgtgtaaaataaaacacaaattattcttttgtgtctggcttttttcacttggcataatgttttcaagtttaatccatgttgtaacatgtatcaaaactcccttttcttttgaagcctgaataatattcattgtatgtatatagcacattttgtttatccattcacctgtccttgggtatttggattgtttccacttttgggcttttatgagtaatgctgctatgaacagtgctgtgcaaatatctgtttgagtctctgtttttaattctttgagatatgtatacacccagaagtggaatttctgggccatatggtaactctatgtttatttttttttaagaaccaccatatgactctccctctacctctccctctccctctccccacagtctccctctccctctccccacggtctccctctccctctctttccacggtctccctctgatgccgagccgaagctggactgtactgctgccatctctgctcactgcaacctccctgcctgattctcctgcctcagcctgccgagtgcctgcgattgcttgtgcgcgccgccacgcctgactggttttcgtaattttttggtggagatggggtttcgctgtgttggctgggctggtctccagctcctaaccgcgagtgatccgccagcctcggcctcccgaggtgccgggattgcagacggagtctggttcactcagtgttcaatggtgcccagcctggagtgcagcggcgtgatctcagctccctacaacctccacctcccagccgcctgccttggcctcccaaagtgccaagagtgcagcctctgcccggccgccaccccgtctgggaagtgaggagcgtctctgcctggccgcccatcgtctgggacatgaggagcccctctgcctggctgcccagtctggaaagtgaggagcgtctctacccggccgccatcccatctaggaagtgaggagcgcctcttcccggccgccatcccatctaggaagtgaggagcggggtctctgcccagccgcccatcgtctgagatgtggggagtgcctctgccccgccaccccgtctgggatgtgaggagcacctctgcccagccgcgaccgcatctgggaggtgaggagcgtctctgcccagccgccccgtctgggaagtgaggagaccctctgcctggcaactgccccatctgagaagtgaggagcccctccgcccggcagctgccctgtctgggaagtgaggagcatctccgcccggcagccaccccgtccgggagggaggtgggggtcagcccccaccaggccagccaccccgtccgggagggaggtgagggggtcagccccccgcctggccagccgccccctccaggagggaggttggggggtcagcccccggcccggccagccgccttgtccgggaggtgaggggcgcctctgcccggccgcccctactgggaagtgaagagcccctctgcccggccagccgccccgtccgggagggaggtgggggggtcagccccccgcccggccagccgccccgtccgggaggtgaggggcgcctctgcctggccacccctactgggaagtgaggagcccctctgcccggccaccaccccgtctgggaggtgtactcaacagctcattgagaaggggccatgatgacaatggcggttttgtggaatagaaagcggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctagaaaaaccagagacctttgttcacttgtttatctgctgaccttccctccactattgtcctatgaccctgccaaatccccctctgcgagaaacacccaagaatgatcaattaaaaaataaaaaaaaaaaaaaaaaaacaaaaaaaacagttgctgaatctagatagaaaaaaaaaaaaatgttttccaaaaaccaactgggaaatattcagggcacatatataacatgactgtgtttaaacaaattatttatgtgctaggaaaatgtaccataatgtgggtagcgagataattttgagctgttggttttgttttgttttggggggggcagggtgagggtgtgtctttgatacttctgtgtaacttcaaagtttcctgagaattgatacatagtatttcatcagttctaagaggtactttccccacatgtcaacaacttttaaaacaagatgtatcttacaaaaaaaaaaaaatctagtgtagtccctggagggcatggttttccttttggaaacccctttctctggcaagggagagagctgttctcctttctctctctctcttttttttttttttctattaaagcttccctcctaaacgccccccccaaaaaaaaagaaccaccatatggttttccatagtggatgcaccattttacatttgcatcggcaaagtacaagggttccaatttctacacatcatcaccaacaattattttctgcttttgtattatagctgtagaggccaagggaaaacttccactttgtcctccaagggttcacgaaaagtcaactaacaaaaggaaggttaatggaataaaaggtgtacaaaatttattaatgtgcacacatgtccatgggagtcatacaaaatatgaaccacccagaataagggccagattgttgatgtttttatacccacttctggtttacagaaagaagacaggcttgaaggatggcaagacagcttataggaggaagggaataggaaaagtatggctagcaaaggtggtattgtcatgcagatgaaacttcacaggtaagaactctctctctgaaagaatagatagtagcccacagtgaagttcgtctttcttagatccagacgagggagggagtcctcacagaaagcctagctgtttattttaccaatgtagattttatctacagatgcaaatatcccccacaaaaggcagcttttcaggctatttctatctgaaggctctctaaatagctacctcaaaacatgtcaaaaacctatattttggattaaaataaaatatttttggtttacagccatccaaatgactaatttgtgtaaaacgttattctgctgtggttttgacttgcatttacataacgtttaatgatatatttttatgtatttattagccatctgtatatattatctggagaaatgtctatttaagtcgctcacctatttctaaactgaattatttctttgttgctgctgttgagttttaagtgttctttaaatattttgcatataatctcttatatgatttccaaacattttctcccattatgtggttggctttttcactttattaatatggtcattggtgcacaaaagttttgaattttgatgaaatctaatatattgattattttttttgttgcctgtgttttttggtgttaaatccaggaaagcactgccgattccaatggcatgaagcttttcccggtttttttttttttataagatatgtatacttttatctctgctgcttaggcttttgatcaaaattgagtgaactgtaatatactgtataaaatgaggatccaccattattcttttgtatgtatatatctagtattcccagcaccatttttaaaaaagatggtcattttccaattgaataatcttggcatccatgttgaaaatcttttcagaacatataaaaggatttatttctgggctctctattctgttccatttgtctgtattttttgtatttgtgccagtaccacattgttttgattattgtagctttgtagtaatttttgaaattaggaagtgtgagacctaaaattttatatttattttatgttatttttggagatggtgtctcattctattacctagcctggagtgcagtggcatgtacgtgacatactgcagccttaacctagtgggctcatgcaatcctacagcctcagccttctgagtagctgggaccacaggcacatgctaccatgatagcttaatttctttatttttttgtagaaatggaatcttgccatctctgcatcttgaactcctaggctcaagagatcatcctgcctcagcctcccaaaatgctgggattacatgtgagagccactgtgcccagcaaattttgtttttgtttttcaagacagtttggcaattggaatccctgatgattccatatgaattattgaatgtatttttgtatttttcaaaaaaaagcaggcattttgatagaaattgcattggatctgtagatcactttaggtagtattggcttcttaacaatattcagtcctccaatccatgaactctggatgacatttcatttatttcctgttttttgatttttttaaaaaagcaattatatatggtttttagtgtataagatttttaccaccttgattaagtttatagtcttagttcattttatgttgcaataacagaacacttgaggctgagcaatttatgaagaaaataagtttatttgcttcacaattctagtgggtgaaaagttcaagattggacagctgcatctgatgagggtttcagacttgaagcatggcaagacaggttataggaggaaaggaataggaaaggtatggctagcactcatggtggaaagaggaacaggagagtgtgtgtgcaaaggagcacatggcaacagaggaagcaagatatagaaactaaaggagccagaatattttgccatcacaatatcttagaaactagtccattcccatgagagggagaactcattcatccccatgaaaaggtattagtgtattaatgagggattcacccccatagctcaaatgcctcccactggaatcctcctcccaacagtgcaacattggaaatcaaattccaacacgagtttcaacagaacaaactatacccaaaccatagcattctgttcctggccccctaaaagtcatgttcttctcgaatacaaaatacaataattccatcagtctctaaagtcttaacttgtttcagcaccaacttaaaagaccaaagtccagttatgagcctataaaaaaagttatttagttctgagataaaatggtggaatgcacatagtttagacatttccattccaaaagggagaaatgaatcaaagaaagaaagaagtaagaggttctaagcaagtataaaacccagcagagaggcattgaatcttaaagctccagaataatttcattttttagaatttcaacttttattttagattcaggaggtacatgtgtaggtttgttacatgggtatattgtgcagtgtcaaggtttggagtatgattgatcccatcaatttaggataaacttgatttaacaattcccccgttttggtcattctctaaattgtgggagattgaccaaaatgttagtcattgatttcaccatcaccactgtaaaagtacttatttcctcttgaaacccactaggaaacagcagagcagtgggttttgtaaggtttcaccttacaaggactccaggttattattcttattatttttgtaagtgttagagtagagggtacctccttatgttggaaggtactgtttacaggaggaaaaaaaatacaaaaacctggtcttttctaggatttgcttgtttccttaaagtcttagtttgattatgttacatttagcaagagtgactgtattttagtttggtctaggtgtacagttccaagagtgtggagggtcccttctcagttgtgaaattatgaacccagcatttaaggtcctgaagttttgctgcagtgtggatggcaagggaagtctttttctgatgttctcagaagatctgatcttcaggttctcgattaagaagaggtttattgttctcagtcagtgaaccatgcaaagctttctttacttggtgaaaatacactgtggcacaacatgatcctattgtaaaattagctatcttgcatgggaaagcttttataaaaccagaaaacatgcattggaaataataattgaatgaaatccctctgtaaatgtttcagtgggccatcaggtaacagaatgtacctgaagcattgtcttcccagcaatatgggtttgacaaaccaaacattggtcagaaactattttagcaattgagaagtcactataccaatatatatttaatttggatcattttattttttccacgatgtgtcgtggaatgcataacttttaataacaaaaggtttaagaactcaggaagtacaaggtggctgtcctggatctccaagagtccgtgcttaacattggacttatgttctcttgaataccagttgtttcttcaatttaggtgcatagcactgaaaactgataggttatcacaggtaatttgacttacaccatggtgttcaatttcagtattggctgatttagcatgaaaatctggcaaggtattttcatggtattcaattaatttttgtactacttgggttggcagttttataaaccagtctttttatccaagttccaggaattcttacccagtccaaatgatatgattctaaagttatcagaaacatgtattcaagagtgcttttcagggtcccttccatcctttcataaacctcctaaaacacaccatattctagggttctgtatgcttgtgaagttttcagaaactgcatcagcattaagcaatgaactgtgaaaatgactttaaataattatagttaaagacacaaatgacaaggaaatttggttatttctgtggcctacaataacaacataataaccataatcatgattgatagcatatactcaaacatattataatttgatgaatgtaatataattttacaacatatattaataacatttactgaaatataaccttcaaaacgttaaacattatttcttattttgacaatgcttctcttgtaagttagcatgtcaaataattctgtttacctctctttttgatgcttcatgggccctctgcagcatcccacagttagaggttaaaaaatacttaattttgaaggtgaaatttgattttgggaagcctgtcaactatgttaaagatttaaaacacttaatattgtagaataggattccaggtcaccataagttatttatctagccagaatgataatttgaaaattttgaaaaggcaaaaacctttattcattaatagagggaagacttagctttccaaacaatcttttgttgtatctttctttttttttcctgtagtttattcaaagttgaaaaaaaacattcattattctttaatattacatgaaaatcttgttcaagagtgaaagccaaattttatccttgcattattgccatttactactggttttcttctgacccagtcagatgtaagaggcctctaactggatccaagccacttaattaccagatctaatttgattctggacccagttcagtttttggcatgacttccaaacgcagtttggattagaaatgggctcatagaaacttggagagctcaaaacacaaatatgcggagcttctgaatctgagagagaacttaccatgatgaccagctgctccaagagaacaatggacataatcggcctggtgggtaccttgcttggtcactcagcactcctaggtgtcattataagctctactttggatcccacttctgacatcatctgttaaaacagaaacaaacaaacaaacaaaaacttcagctgaattaaatgtaaaagagtttaattgagcaatgaatgatttgtgaatcaggcagcctcctgagccagagtaggttaagagactgcagcacagctccatggtaaaagaagatttatggagagataaagaatcatgatgtatagaaaatggaagtgaggtacagaaacagctggattggttatagctaggcttttgccttatttgaacaaatttcaaacttctggccacgtttgactgaccaaaacttgatgattgacacaagagtaggctacagtttgcttacacttacatgtaggctatagttcatgatatacagagaaacatttagcccaaacttaaaatatgtaaggaggcagctttaggcaaaacataatctaacaggcctcacatttttgcttggtattgtcctagtagaagctctctgttggggcttcacactgtgaaaagtgtccctgggcccacatgcttttttatacattctttttaatctcaggggagaacaccaagcctctgatagatgcaggaggcatataaggggaagtgtacccagagaatctctgacctccctgcacactgggagaatggggtggagctatgggaattttgtgctgtgtgcagtgtggggaggatcctggcctcttcagttcctgtgtgttgcctagaattaatctgcaaggtagagggcctgttagcaggagtccctcttgctttactgggagttttttttttccttcttttccttttttgcccaataaattctgtcaccctcacccttcaatgtgtctgcattcctaattcttcctggtgatgtgtcaagaacccagttttagctgaactaaagagcaaagttctacatcacctccacaccttcatagctcttgtattcttctatccagcagaattaacaccacatatacatgaatgctgccaagaattagaccttgcatcctttggcgaaatgacccaagttgttcctggagtcatgtaagtgaggactaagctctgattttttttttttaatcttgcccaaactcctttctaaggggtctggggagtcatgccctacaaaccataaattctcatcagatgggttttatttaaccctgtatatcatgatttgctttccaatctatctctggcatacaagagaaaaaaatcaatatgttttatccccaaatatattttcttgccataccttggaatttccctgcaaagtctcttgtgggaaaaatttacattctatagagaatccccttcccctttattttccttccttcctttccagatccaggagataatcaactaagagccaggcaccccttcaagtccgaaaagaaacattttacaacctgctctctctgaagtctgctatctgacagcttcctctgcacaataaaacttggtctccacaattctttatcctaacctgaacatttcctttcatcccaggtcttcagaaaaactcaaccaattgtcaaccagaaaatgttttaatttacctgtaccctggaagcccccgctttgagttgtcccacctttctgaaccaaaccaatgatgtactacttaaatgtatttgattgatgtctcatgcctccctacaatatataaaaccaagctgtaacccaaccaccatggacatatgttctcagggcctcctgagggctgtgtcatgggccatggtcactcatatttggctcataataaatttcttcaaatattttacagtttgactcttttgtcaacataaaccacagttgttccagttagtgtggccaaaatgtggggagcagagtttcaaggcagcacagggcactagcatctcaatttgttcttgaaacagttttgtcctactaggcctctgggccttcgatggcagatgcaacctcaaagatttctgaaatgactccagggcctttccttcattgttttgagcattaacacttaggttccttttatctttgttaatctctttagcacgtagttgcactgtcacaaccttggattgctctcctgaaaattctttttcattttctaccacatgtccaggcttggaatactccaaatccttataaattataactttaggtcatgcctttgctcccaaatcttaactatttgaagttaaaagtaaaaaagcagctgtctgaatgcttttctgcttagaaatttgttctgccaaatattcatcactcttaaattggccttccaccaagtcctaggccatggataatgcagccaagttctttggtaaggtataataagtgtgacttttgcttcggtttccaataattttctccttatttccatttgagtccttgtcaaaatggctttcactgtctatactcctaacagcattttggtcacaatcacttaataattatctaagaagtcccagctcatcttctaggcccctttcagaatctccattagtgctctattcactgcaatataggctttttccaccctgttcttccaaattcattcagccactacatgtcactcagtccaaagccacttccacatttccagatgtctgcgtaggtatactccactcctcagtactaactttcgtagtccactttgtgttgctgtcacagagtagttagggtggcatattttataagaaaaaaaggtttatttggctcacaattctggtagctgaaaagtccaagattgtgcagctgtgcatcttcgtcagggcctcagactgctttccctcatgacagaaaacggaacaggagatgtatgcaaagggatcacatggtgaaagagcaaagaatagaattagggagccgtattcttttaaacaacccattcttttgggaattaaaccatttctgagagagggagaacttaaccccacagaaggatatggatctattcatgaggaatctgcctccatgacccaaactcctctcactaggtctcacttcccaacactgccatactggtgttcgaaatccagaataatttttggtgaggggaaaccatatctaaaccatatcaattcctaagtaagttttttttttcttttccaattgagaatggaattgctctggtagccttttttggattctttattgttaatgtaaagaaatgccactgacatttgtttaatgattttttttcttgagtttttttctcttgtagtatttttatcttactttgttttgagagcaatcctggcttcctagaatgagttagaaaatgttccctcctcttcacattgttgaaagagtttgagaaagattgatgttatttctttaaacatcaaatagaattgaccagtaaagacatctggttcaagaattttccttggtggaattttttttttttttttttgaggcagagtcttgctctgtggcccatcctggagtgcagtggcaccatctcggctcagtgcaagctccacctcccgggttcatgccattctcctgtctcagcctcccaaatagctgggactacaggcgcctgccaccacacctggctaatttttttgtatttataatagagacagggtttcactatgttagccaggatggtctcgatctcatgacctcgtgatccacctgtctcagcctcccaaagtgctgggattacaggtgtgagccactgcacctggtcccttggtggagttttaaataaataattcaatctctgttggttataggtctattaagatttcctattttttctaagttagctaatgtaatttgtgtgcttctaggaatttgtccatttcatttagattatccagtttattggtgcataattcttcatagtgataccttataatcctttttattcctgtaaaattggttgtaaagtctcccccttcatttatgattctagcagttttattcctctctacattttcttagtctctctaaagatctgtcaattttgttatcttttggaagaatgaacttttggtttcactgatttttctctattgctttttcattcttaattttaatttcctctgctttagtatttattatttccatcttactagctttcaatttagtttgttttatttcttattttcttaacatgtacatttggattatatatttgagaccttttttctttttaaatatgtttacagctaaaaattttcttctgatacagttttgccaatgcaccataatgtagtagtctcttgttctgagatatcacctgaagttttttgtttcaggaccgagagagttaaggattgtggacacaaagtgtgaggttggagcaaaagtttaataagctaaagaaaaaagctctctgctgcagagaggacccagaagagggttgccatttttacagttgaatgcaaaggcttttataagaaatcagtgagggctgggcatctcatttgcataaggtgcaaatttctggtagctccagcccatcctcccagtgcatatgcaggcccttcgcttgagttactccatgctgcttttttaccctttcctgagcatgtgttaggggacaaaattttccactgtgggcatgtctgaccaagtcacctgtgtagcctttcttatctgtgcagctgtgaacatgtcttagacaagcctccctgtgcaagttctctcatctgtgcctgcaggctgttcttttgtttgaaagaattcaaccaaagacccaccctaactgccttccaaacaggtttcttcctctctcctctctcattaacacttttgcctctttaccttatatttgtggtgtttttttagttttattcatttcaaggtattttaaaatttcccttgaaatttcttctttggcacattgctagtttaaaagtgtattgtttattaccctcatatttgtgacttttccagtttttcttctgctattgatttctagtttcattacattgtcatcaggaaagataattttcattttttcaatattttaaaataaatatattaagacttttcatatggcctaacataatttatcccaaagaatgttttatgtgcacttgagaaaaatatgttttctgtagtaaagaggaacattttctgtatgtcctttaagtttaattggttcataatgttatttaagtcctgcattttctcgtggttcttctttcaggtttttccatccattattgcaagtgagatgttggagagtcttactactatttcagagctctctactttgtcctttgattctgtcactttttgcttcatgtatttttggagctttgatgttttgtgcatgtatatttctattattttactttcttggtgaatttgcccatgtatcaatatataatgcccttatttgtgtcctataacatatgctgactaagattctattttgtctgacattagtataatcaaccctgctctccttaggtaactatttgcatggaatattgttgttcattctttcacttttaacctatgtatgtccttagtactaaagtgagtctcatgtagacaacagatagctagattgagtgtttttaaaagtccatttataatctctgaaacttttaaatatttaattgttacatatttgtacatatttatggggcacatgtaatattttggtacacagataaagtgagcaatgatcaagtcatggtacttagaatattacttcacctcaactgtcatttctatgttttggaagcatttcaagtttttttcttacagctattttaagatatacaatacattgctgttaattatagttgtgctaatctgctatcaaacattaagatttattccacctatccaactgtatttacccattaaccaaactctctacatatccccctcaaacacagcaatcccagcctctggtaataatcatttcctctaactccatgaggtcaacttttgtggttcccacatacgagtgagtacatgtgattttttttttttctctgcctggcttatttcacttcacataatgacttccaattcaatccatgttgctgcgaatgacagaattttattctttgttatgtacaaatagtattccatagtgtatacatagtatattttctgtatccatttatctgtgaatggacacagattgatttcttatctttgttgttgtacgtagtgctacaataatcatagaagtgataatatctctttgatatactggtttattttcctttggaaaactacctagtaggattgctagatcatatggtagctctatttttacttgtttgagaaatatccatactctttaccatattggctgtactaatttacattcctaccaacagtgtataagaattcccttttcttgggctgggtgcagtggctcacgcctgtaatcccagcactttgggaggccgaggtgggtggatcacgaggtcaggagagcgagaccatcctggctaacacggtgaaaccccatctctactaaaaataccaaaaattaaccaggctttgtggtgtgcacctgtggtcccagctactcaggagcctgaggcagcagaatcgcttgaacccgggaggcggaggttgcagtgagccgagattgagcactgcattccagcatgggtgacagagtgagactctgtctcaaaaagaaagaaagaaaaaaaaaaagaattcctctttgtctgcatctacagcagcatctgttatttttatttttatagtagccgttataattgggataagatgatatctcgttgtggttttgctatgcatttttctgttgattagtgatgttgagcatttttccaatatctgacagatatttgcatatcttcttttgagaattgtctatttatttttttggccactttctaatgcgtttatttgatttcttgctgttgagttgtttaagttccttgtgtattctggatattagtcccttgtcagataaatagattgcaaatattttcttccacttatcgggttgtctgttcactctcttgattgttttattagttgtacaaaagcttttcagtttagttcaattttctatttgtattttttttgttgctggtgcttttgcagtctaagctataaaatctttgtgtggattcatgttctagtgtgttttctctatgttctttttagtagttttacaattataagctttatgttgaagtctttaatccattttgaatagcttttttttaatataatgacagatggggtctagtttcattcttctgcatatggacatccagtttcttcagcacagtttattgaaaagggtgttctttccttagttttggttcttggcaccttcttcaaaagttagttagctatatatacatagatgtatttctgtgtcatctattctggtccactggtcaatgtgtctgtttttataccaataccatgatgtttgtttgagtattatagctgttttaggttgtgctgctataaaggagtatctgaggctggatagtttttaaagcaaataggtttatttagcacagagttctgtgggttacacactaaacatggagccagtatttgtttctgttaagggcctcaggctgcttccactcaaggcagaaagcaaaaaagagccagtgtgtggagatccaatgatgagaaagaaggaaagacagagtggggggagttgccatgctctttttaacaaacagttcttgggagaactcttaataaagcaagaacattctcattactgtgagtataaaaccaaatccttcatgaggcatatacccccattatccaaacaccttcaattaggcttcatctccaacgtttgggattaattttcaacctgatatatggatggatcaaatatccaaaccatagaaatagccttgtcatgtatttgaagtcaggaagtgtgacgtcttcagcttttttccttttgctcaagattgctttggctattctagctcttttttattacatatacatttaaaaatttttctttctttttctgtgacaaacgtcatcggtattttgataagaattgcattgaatctgaagactgctttaagaaatatggctatttaacaatattacttattctgatccatgaggatgtgatggcgttctaatcttttgtgttctctttcattttttaaatcactgttccatagtttttgctgtagaggcattttacctccttgaatacaattattcctgtgcactataaacaaacaaaaaagtattcaaagctccccatccaactgaatggacccctcctctcagccagagtctttctcaggtaaacctgaaacactagccataatatgaatgggtggtcagacatgccttatactttcctctctttttgaatttaggcacacctgaccagcattaacattaaaacagagatcttaagactgccataacagactctttaagtctgaaaggaaacatttacaatctattgtctctgaagcctgctacctggaggcttcatttgcataataagctatttggactccaccacttcttaaccaagacattaccttctacggattctatgtctttagataaactctttcaaccaattgccaatcagaaaatatttgaatacccctgttacttggaaaacccaactttgagtagtcccacatttggggaccaaaccaaagtatatctttatgtattgattgatatcttatgtctccataaaatgtataaaacctagccgtagcttgaccaccttgggcacatattgtcctgagactgtgtcataagcatgtccttaaccttagcaaaataaatgtctaaattgattcttggatactttttattttacagtatgtattttgtagctattgaaaatggtatcttcttgatttcctttttatagctagttcattattggtgtataaaaacactactgtttttttatatggtgatttttattctgaaactttactaaatttattaatcagatcaaagtgttttttatgaaatctttaggtttttctaaatataacattttgtcatctacagagagggacagtttaacctcatcttttacaattgggaaggcttttatttctcttgcctgactgcttgggtataattgtagtactatgttgaatagacctggtaaagtgggcctccttgttattttcaagttcttagaaagaaaaaaatatttccactaagggaggagaccacccctcatattgtcttatgcccaatttctgcctccaaaggaagaaaaaagtaagaactgaaaggcataaatgaaatccacaagcagaaagcccggcgccacaccctgggcctggtggttaaagatcagcccctaacctaatcagttatgttatctatagattacagatgttgtatagaaaagcactgtgaaaatccctatcctgttttgttccgatctaattaccagtggctgcagcccccactcacgtaccccctgcttgctcaattgatcacaaccctctcatgcacacccaagggtgttgtgcatgagttgtgagcccttaaaagggacaggaattgctctctcggggagcttggctcttgagacaggagtcttgccgatgccaccggccgaataaaccccttctttctttaactcagtgtctgaggagttttgtctatgctcatcctgctacatttcttttctctgactgggaagtgaggtgaatggcggatggttgaggcagttccttaggcagcttaagcctgccctgtggaacatccctgcgggggactctgaccagcccgagtgacacggatcttgagagcactcccgggtaggcatttgccctggtgggaggcctcaccagagcagtgtgtggcaggctcccatggaggataaatgcggtggctgaacaccgggaaagaatgagcacttagagtccggacatctaaaacttggtaagactagtctctgaaacttgccctctccgtttgagtggaagtgtggcctgatcacccatggtgtgcctttatcagcactttggttttggttttggttttgacttggtttgaattgattgacaggaccagtcttgggaacttgcccactccatttgagtggaagcgtggcctgatcacccacggtgtgcctttattggcactttggttttggttttgacttggtttgaattgcttgacaggattgtcttgggaacttgcctactccatttgagtgaaagcgtggcctgatcatccacagtgtgcctgtaccagcactttggtttttgtttttgacttgacttggattgcttgatactttggttttggttttgacctggcttggatttatggatactctgattttggttttgattttggtttggttcaaactgcaaaagtgtgtgtgtgctctttttacccgttctttgttttgtggtgtgcgtgtggtgtgagcatggtgttttgtctcgaagaagcataggtcaggcacaaataagcccactctactcggaactatgttaaaaaatttaaaaaaagaatttaaggcagactatggagtactatgacaccaggaaaacttaaaactttgtgtaagatagactggccagcattagaagtaggttggccattagaaggaagcctggacaggtcccttgtttcaaaggtatggcaccaggtaacctataagccaaggaacccagaccagttcctgtacatagacacttggttacagctggttttagacccccttcccccaacacacagtggttgagagaagagcagcataagcagctggcagaggaaaggaaagaccagcagagagagagaaaggaaagagacagagaggaaaagaggcaaagagagagaggaagagtcggagaggaagagacgacaaagagggagtcaaggagagagagagagagaaagaaagagatgggcagagagagagaggaagagacagaggcaaaaggaaagtcaaagagagagacaaagtcaaagagagagacaaagtcaaagagagaaagagagagatatacaagtacttaagaaaaaaaagtgtaccctattcctttaaaagccaaggtaaatttaaaacctataattggtaattgaaggtattctccataaccctataacactccaataccactttgtcgtcagtgtaaacaagcgcgtatttcaaaagcactgagtccttcctatcgaaaatccttaccccagtaacctgcggatggcccaaacacacttaatctgtagcggcaattgctttgctaacaaaaaagtaaaaaaataacttttagaggaaacctcattgtgagcacacctcaccagttcagaagtatcctaagaaataaaaaaaaaaagaaaaaaaaaggggagacagaatttatataaaaagagtattatatggtaaattcttgtcctgaaataactggttgtttaaagacagaaatatttgtaataagtcagaaagttgaggcatgttgaagaattgtctgcgaaagccatgaaacagaaaaatgttataaaaaaagaatttatgcaagaaatgttgtataatttaaaagtaactaggcctcctgaatgtaaaactattgaaaaaaaaaacagtttatgtgcaaggtgttaagaaaagtaaaatgtatctttggtaaaagggttataaggaagcataagcatgtacatttttacctacattaaaaagttaaaaaatattgttttgaaggtttaagcaagttttaaaatgttaattgtaaagaaaattctgtgtgtaaacagattagctaaagttaaagaagtatcatccagtttttctgtgaactggacattaaagtaaaagcataacaagtttttcttaaagcaccaacctgctctttcacaaaaattataaaatgttaaaaagagtctatgaaatcttaccttttggtcaaacattaaaaattagataaatatgtctacaaggttttattaaaattaggtttaacattaataacacactaatataaacataaaatttagcttatcttgtattaaaatcgtacaagaagcatcgttaaatgtaaaatggtatttggctttctttggtttaaaaactaataaaaataggtgctaaaggatatttctcagtaaaaaggcactataaagtccactgccaaggtccccacaattaaaacaaaaggtcaatttcttaaaaattgtacacttggtttatcttccactttcctttatctcaaaaactaaaagtcttttagcacatgtaccactcctagaatttccagtaaaccagcaccagcctgaagatcacgttctcaacaaagggtggaaagaagaaaaactcgagccagcctgggaaggaccctaccttgtgctgctaaccaccaagactgctgttcatacagcaaaaaaaaaaaaaaaaaggaaagaaaaaaaaaaagtggatggactcatcacacctgagtcaagaaagcgccaccccctccagagttgtgggccatagtcccaggggaaaaccctaccaaactaaagctaagaaaaatttaactcttttcttctattctattactcttttttctttcctcgttctattgctgaccatctagttattaacataaccaagtcaatttcatctgaaactgttgcatttaatgcttgccttgttataccttgtggggacttgccaagtcaaagacagctctctgcttcagaaaagtacttccgtccctcctgactctcctcagactgggcattagtaaactaggaccatttaatccagggagattttaataaagaccccagtgccaaccaggagtcttactccccgatgtagagctttcatgccgtagttggtccaatgttctgtggaccactaaagagcaaggatggactgcccaactggtttttgtaatttcctaaaaccatatattcattttactagaggatcatagaagttaaagacttaaactttagcaattaagacaggataccaagatgcaaatgcctggttaaaatggatcaaatattccatctgcatgctaaataaaagcaattgctatgcttgtgcacatggcaggccagaggcctagattgtcccctttccactaaggtggtcctccagttgaccaggtgtgggctgtatggcagctcttttccaggattctacagcctggaataataagtcatgccaagatctctctgctatatcccaaagtccggcaccctgcaggtcagcccccgagggccatccagcttccgtctcccaacactaagttcactttgtgtctctcatgacagggaggaaacttagtgttccttggatatctgaaaagatgcagtgagcttaagaattttcaagagcttatcaatcagtcagcccttgttcatccccaagcagatgtgtggtggtattgtggtggacctttactgggcactctgccaaataactggagtggcacttatactttagtccaattggctatccctttcaccttggaatttcatcaaccagaaggaaaagaaataagacatcataaagccagagaagctccttatgggtctttcgactctcatgtctatttagacgcaattggagtcccatgaggaagaccagatcaatttaaagcttgaaatcaaatagctgcaggatttgagtcaatattttggtaggtgacagttaataaaaatgtagattagataaactgcatctattacaaccaacaacaatgagcttttcatgagttaaaggaaaaactcatgtcggccccagccctgagactacctgacctgaaaaaactctttacactctatgtgtcagaaagagaaaaatggcagttggagttttaacccagactgtggggccctggccaaggccagtggcctatctctcaaaaaactatacagggtttccaaaggctggccctcaggtctaagtgccctagcagcaatggccctgttagcacaagaagcagataaactaacccttaggcaaaacctgaatataaaggccccccatgctgtggtaactttaatgactaccaaaagacatcattagttaacaaatgctagattaaccaagtaccaaagcttgctatgtgaaaatcccagcataaccgttgaagtttgcaacaccttaaaccccaccaccttgctcccggtaccagagagcccagttgaacataactgtgtagaggtgttggacttggtttattctagtaggcccaacctccgataccatccttaaacatcagtagactgtcagcggtatgtggacaggagcagcttcgtcaacccctgcaaagtgactctgaagaagacgacaagccctgctccagtcacactcagaagctaactggtccacgcatggctgaagaatgagaaaactcattgcaggactcattttccttaaaatttggacttttacagtaaggacttcaactgacctttctcagactgaggactgttcccactgtatacatcaagtcactgaggtaggacaaaaggttgctatggtcctactattttatggttattataagtgtactggaactctaaaaagaacttctttgtataatgttattctatacaaggtatgtagcccaggaaatgaccaacctgatgtgtgttatgacccatctgagcctcctatgaccacagtttttaaaataagattaaggactgaggactgctgggggctcataaaggatatgagtaaagcgctagccaaaacagaagaaaaaggggtgcccaaacaagtcaccttaaaatttgatgcctgtgctgtcattagcagtaataagttaggaataaggtatgcttctctgaattagaaaagaggctatatagcagaaaataagtacatctgtcataaatcaggactttgtggaaataaatataaatactggccttgtgtcatttaggccacttgaattaaaaaaaaaaaaaaagaaaaggatccagtccacctttagaaaggaaaaaatggcccttcctgtactaaaggacaatgtaaccccttagagctagtaataaccaatccccttgatcctcactggaaaaaagatgagtgtgtgaccttaggaatcgatggggccagagtggatcctcgagtaactatcttggttcaaggagaagtttacaaatgctttcctgagccagtgtttcaaactttctatgatgaactaaatgtgccagtaccagaaattccaggaaaaacaagaaatttgtttttgcaattagccgagcatgtagcccagtctctcaatgtcacttcatgttatgtatgtggagaaactgtaataggagatcaatggccatgggaagcccgagaattagtacctacagacccagttcctgatgaattcccggatcaaaagaatcaccctgataacttctgggtcccaaaagcctcaattattggacaatattgcatagctagagaagcaaaagaattcactcaccccataggatgacttaattgtctgagacagaaactgtataatggtaccacaaaatcagtcacttggtggggttcaaatcacacagagagaaatcaatttagtgaattcccaaagttgcaaaccgtgtggacccacccagagtcccaccaggactggacagcccccactggattatactggatatgtaggcatagagcttatgccaaatttcctgacaagtaggcaggtagttgtgttattggcattattaaaccatcgttcttcctactgcctatagaaacaggcaaactcctgggcttccctgtctatgcttcctgcaaaaatagaagcatagctataggaaattgaaaaaaatgataaatggccctctgagagaatcacacaatattatcggcctgctacttaggcacaagatggctcgtggggataccagacccccatttacatgatcaactgaatcatatggttacaagctgtcttaaaaataatcactaataaaaccggcagagtcttgactattctggcccggcaagaagctgaaatgaaaaatggtatctatcaaaatagattagctctcgactgcttgccagcagctgaagaagtctgtaggaaatttaaccttactaattgctgcctacacttagataatcaagggcaagtagttgaagacatagttagagatatgacaaaactggcacatgtgcctgtgcacatggttcccagcactaggaggatttaaaactcttataataagagttataatagtaacaggaacctgcttactgctcccttgtttgctacctgtacttctttaaatgataaaaagcttcatcgctacgttagttcaccaaaatgcttcagcacaagtgtactatatgaatcactatcaatctgtcttgcaagaagacatggttagtaaaaatgaaagtgagaactcccattattaagtgagagtcccaaagggggggaataagagaggagaccacccctcatattgtcttatgcccaatttctgcctccaaagaaagaaaaaagtaagaactaaaaggcagaaatgaaatccacaagcagaaagcctggcaccacaccctgggcccggtagttaaagatagacccttgacctaatcggttatgttatctatagattacagacactgtatagaaaagcactgtgaaaatccctatcctgttttgttccaatctaattaccagtgcatgcagcccccagtcacatactcgctgcttgctcaatcgattatgactctcatgcgcacccccttagagtcgtgagcccttaaaagggacaggaattgctcactcaagctcggctctttagagaggagtcttgccgatgcccccggccgaataaaccccttccttttttaactcagtgtctgaggaattttgtctgtggctcatcctgctacaccacttttccccattcagtgtgatgttagctgtacatttgccatatatggccattattatgtcacaatatgttccttctataccgagtttgttcagagtttttaatcatgaagggatggttaattcattcaaatattttttgtacctattgagatgattatgttttttgtcattcattctgttgaggtaatttaccacatttattgatttgtatgataaaccatccttgcccacctggaataaattttatttgatcatgacgtgttatctttctaatgtgctgttgaattccctttgcttgtattttgttgaggattttttttctatatttatcagagttattggtctataattttttttgtttatatctagttttagtataaaagtaattcaggcatcatataatcagttatggagaaattgctaatatttaacttttttttttttttttgagacagagtcttgttctatcccgaggctggagtgcagtggcgtgatctctgctcactgcaagctctgcctcccaggttcatgccattctcctgcctcagcctccctagtagctgggactacaagcgtccgccaccacacctagctaattttttgtattttcagtagagatggggtttcaccgtattagccaggatggtcttgatctcctgacctggtgatctgcctgccttggcctcccaaagtgctgggatttcaggcatgagccaccaagcctggccaatatttaacattttttaataatttgaggaaaattggtaaaattggtgttttttttttttttttttttttttttttttttgatggaatgtccctcttgtgctcttgttgcccaggctggagtgcagtggcatgatcttggctcactgcaacctccgcctcccgggttcaagtgagcctcctgagtagctgggaatacaggtgcccgccaccacaccaggctaatttttgtacttttttttttttttttcagtagagatcaggttttgccgcgttggccaggatgatcttgaactcctgacctcaggtgatctgctcgcctcggcctctcaaagtgttggttttacaggtgtgagccaccatgcctggccatttattttttatgagtgtggtagaatttggcatcaaagccatacagtccagggcttttctttgttgaaagtctttctaatactgattcaaacttgtgactcactatttgtctgttcacattttctatttattttttcctcactcagtcttgtggattgtatctctccaggaatttatacattttctgtttttcagtttgttattatatagttgttcataatagtctccaatgctgatgaaaagagtcaaactctgtaaaatatttaaacagatttattctgttttaaatggaccatgatacagcctttaggagctcctgagaacgtgtgcctaaggccgttggggtgcagcttgattttacacgttaggaagacatgaaacgtcaatcaaatacatttaagaagtacattggttaggtccagaaaggcaggacaactaaaagtggggacttccatgttataggtggatttaaactttttctaattagccatttgttgaaggagttatcaatagaaaggaatgtctgggttgcaataagacattgtagagaccaaaggtttagcgtgcagataaagcctttggctagcaggcttcggagagaatagattgtaaatgttacttatcagacttaagatctgtgttgatgttaatgctggagaggtataatgaggcttgtctgacccccacttcctgtcatggcctgaaccagtgtttcagggtagagtgcccttgacaaggaagaagaccatttagatggttgggagggggagttcagaaatttatttttggtttacacggatgacatttcgtatgttgtgacatcaattgtgatttctggttttgtttgggtattttctctttcttggttggtgtaggtagtgatttgccaatttgattttttattattttttccaaaaaagcagctgttcatttcattgaatctttatattgtatttttagtctctaccttcaattagtctgctctgattctatttctttccttctactaatttgatgttgggtttgttcttccttttctagctcctcgagttgcatgattaaattgtttatttgaaattattcaacttttatgaagtaggcatttcttgctataagctttcctcttagcactggtttttctgtatcccttaggtttggaatgttgtatttgcattgttatttgtttcaagcatctttttgatttctgtcagtttgttcattgacccaatagtcattcaggagtatagtgtttaatttccaaagttcttgttgtaattgatttctagttttaattcattgtcatctgtaaagataccttttatgactgaatttaaaaatttgttgagacgtgttttttggcctaatgtatgctctatcttggagaatgttccacgtgtcaaaataaacagcagcaggtgccgctgttgaataaaatattctctaaatgtcagttaggtctatttggcctaaagtgtactttgaatgcaaagcattttgttaattttctatctaatatgtctaatgctgagagtggggtggtgaagtctctgactactatttgagtctctatctccacttagatatggtaatatttgctttatgtatcttgctgctctagtgttaggtgcatatatatataattgttatatactctggcaaaattgtataaaaaccttctttgtctctttttactattttgacttaaagtctgctttatttaacatgaagatagctactactgcttccttttggtttccatttgtgtggaatttatttttcaattcctatactttcagtccatatgtgtttttacaggtgaagtgagtttcctatgggtaccataggtaccataaagaagttgggtaatacatatatatatatatacacatatatatacacatatatatatatgtgtgtgtgtgtgtgtgtatatatatgtatgtgtatatatatgtatgtatatatatgtatatgtatatatattcagccaatatatatctttaaattaaaattaaatcaatgtaaattcaaggttattattgatatagcagaacttattcttgtcattttgttaattgttttctggttgttttgaatattctttttctcttaattcctctcctgttgtttatgattttggtttggtggtttttggtaagtggtaacatttgagtccttcctctttatttgcatgtgctctaccagtgtgttgtatacttcagtgtgttttcaggatgatagatatccttttgctgccaggtgtgggatttcattaagcatttcatgtagggccagtgtagtggtaatgaattcccttaatttttgcttgtcttggaagtaatttatttcttctgaatttatgaaggcttactttgatgagcatactattcttgaatagcagggtttttttttttctttttctttcagcagtttaaatatgtcatctcatttgctcttgacctgcatgggtttctcctgaaaaattcacagtgtgtctgacgaggattcctttatatgtgagtagatgcatttatcttgctgtttttagaaatctctgtctttgacttttgacagtttgacttggaaaaaaactttttgaggtgtatctatttggggatctctgagcttcctatatatggctgtataaatttctagacttcaaaagtttttaggtattattttgttaaacagactttctatgcctttgcctttctcttcacctgtggaacactcaaaatttgaatatttgattactttatggtgccccatatgtcaaatatgctttatttattttttattcagttttttttggtgtgtaatttcaaaagatctgtcttcaggttctataattcattcttccagttgatttagtctaattttgaagccatcaaatgtatattttgcatttattgaattctttaattccagggtttctgtttgcttatttttaaatttataatatttatccctttgttgaatttctcattcatatcttgaattgattttcaattttttgtgttgttaatatgtcttctcttgtatctcactgagcttttaaatatcattttgaattattttgacatttcatacatttctttttttattgaagcttgttatttgagaattatttaattctctcgaaagtgtcatgagtttgaatttttattagagagttgaatcatttgacatttagagaagtgttaatttgctatttgcttcttgtatgtcttatgctttttgcttaattttctattgcagcctcctttcgtgttaatacaattttgtagtgatgtctttattcctttttaattttttaataaatattctgtctatatatttatgtttaccatagggattacatataatatcttcatgttataagaatcctcttaaattaatataaactaattacatacaaaagctcttctcttttacagccccttatccttcgcggtttatgtttttgatgtcacaaattacatccttatgtatagtgtacctatcaatgcattaataattttttgcatgtttcttttaaatctctaccaaaaaagtggggtccaacccaaaattacaatactacattgatggatggatattagttatatatccgatttatatgtatatataaaaatagactttatggatattatatatatattatatatatgtttatatatgcacatttgcccatgtatttacctttacaaaagctatatcctcatatatcttttagttactgtctagcatcttttaattagaacctgaagaattctgtttagcatttcttgtagggcacctctagtggtcatatgctttcttggttttgtttgtttgaaaatgtctcatgtctttctcattttatatttctttctccaattttattcatcagtgttttataattttgagtacacaaatatttcacagctttggtaaaatttattcctattttatttttatgctaatgtaaatggtattgtattctttcttttcttttttttttttccattgagattgagttttactcttgttgcccaggctggagttcaatggcgtgatcttggctcaccacaacctccgcctcccaggttcaagtgattctcctgcctcagactcccaagtatctgggattagaggcaggcaccaccatgcccagctaattttgtatttttggtagagacggggtttctccatgttcattaggctggtcttgaactcccgacctcagatgacccacccgccttggcctctcaaaatgctgggattacaggtgtgagccactgtgcctggcctggaattgtattcttaatttccttttcacattcttaatcatcactgtataaaaatgctacaggccaggtgcagtggctcatgcctgtaatcccagcactttgggaggcagaggtgggcagatcatgaggtcaagagatcgagatcatcctggccaacatggtgaaaccccatctctactaaacatacaaaaattagctgggcgtggtggtgtgtgcctatagttccagctactcaggaggctgaggcagaagaatcccttgaaaccgggaggtggaggttgcagtgagccaagatcgcgccactgcactccagcctggtgacagagcgagactaccgtctcaaaaaacaaacaaacaaaaaaacaaaacaaaacaaaaaactacagattttgcatgttgattttgtatcctgtaaatttactcaatctgtttattatttctaacaggtttttgatggagcctttaggattttctctatatataatcatgtcatcagcaaacaaggaaaatttaactttgtccttaccaattttgatgccttttattcatttattttgcctaactgttctggctagtacttcaagtactattgtaaatagaagtggcgtagaagtgctgattagacttccttgtcctgttcctgattttaagaaaaactcaaattttcattattgagtatgaggttagctgtgggttgtcatatatggcctttattgtgttgagttacattcattctgtacctaatttgttgagaagtcttatcatgaaaatatgtaaaattttgtcaaaatttactgctaagtccatttggtctaaaacagttcagtacagtggctcctttttcattttgtgtttcactaatctacctgttgttaaagtgtgatatttaactaccctacgattattgcattgcaatctctctctcccttcagatctaatatttgctttacatatttatgtgctgtgaaatcggttgcatctatattaaaagttgttacatcaccttgatttttatttatattgacctttttaaatttttagtttttttacttaatgcatattttgtctgttataagtagctatcactactctctttggtttcaaagtccatggaatacattttttcatcacttaacttttagtctctgtgtgtccttaaagttaaacctcttgtaagcaacatagagttgggtgttttattgtttaatccattcaggccatgggaaaatttatttatattcaaggtaattattgatagtaagaacttactgctgccattctattcttttctggctgttttgtagatcctttgtttcctatttcctctcttcatgtcttcctttgtgatttgatggttttctgtaatattatgctttaattcatctttttcttttgtatgtctaatatacatttttgctttgtagttaccatgaaggtaatgtaaaacatcttataacagggttggctatacttatatcagaccttaatattgtcacctgaatgatccttgttggcaagacctgtgggagatcttcagtatctgtgaggggtgtcagtaaactcatctgtgtctctctgcccagtaactaggctctagggctggcaatcatgaaggttgcagccagtgatgtgtacatgtttcactgcagaagctagttgtaatcatgagcgttccagcacaggccacctagagggctgggttcagaggtatgagttgaggctgagtatgagtgcacatgtggcagtgcttgctgtcagcttgcacatgaacgactgaacaggccatctgaggttcagcagtaagatgaagtcatgtgtgcatgcatgggcagcttcaggaataagctggaagtgtgcacacgtgtgcagctccaggagccagctgtgtgtgtaggcagtattttggaggcaggagacaagaggcatggcaaggtgcttgttcaagttcaactgtggggctgggctggcagtgtgcaacagcctagcttcagtggccagccttgggtgtgcaagatgttggggctagagccttcagcaggggccctgggactatctgtgggcacaagcacagtagctgcactgggtctctgggacaaagcacctgcagaggcagcagctggggtgactccacaaaggaagagtcatggtttagtcacctggaaaataccaatggatacagtagtgagtcacctagttgggctaactatggtgagagtagctcaggtggctctagggaggggagaggaggaaagagaaagaaaaaaagagagagagaacatcatctggtcaggtatctggtgactgtcaatgttgcttgatgagtccctgggccctggtgactgcagcagcagcagttgtgactctgggtgactccaggaaaagggagtgtctaaagtacatggagatggtgaagaaaaaatactgcagggcctttggtggcaaaaactacagagggttttctgctcttttgttggcagttttcctcagtggtgaaagccgctaagctcctctgtagaacaagtcaatgatgttagtaatcaagaacacggagtagttgtgggcaatgattgctgcaggggctgcacatccaccaggagggttgttgaggtcctcagtggagatgtctgctagaatcctgtgctgagcagaccactagggttcactctgagactattcacatggccgatactgattgagcctgtcccccttctttttctctgccatatccagatgtctcagccatagcatttctcccactgatctgtgtggagtgaaactgaagctgtcatttgggcaacattccaaaagcccgaggaagctggttgtacatcctccttttcttttctgtgcaaggtgggcaggcatgccagagagttcccactccatgctgagaagtgccagcttgaggaatgggttaatgcaggtgaaatgaaatgatttttttaatactttttgtgtggttcttctcagtttttttttcactgtatttcagaggctcttaagtggacccctaagctcttccatttagttttattcacaacaaattgttgctctttgtgggaacaggaaggcttgattgcagactccaccatatactgatgtaattattttcataaatttttaattacaaaaaagatttaagaatttttttgaacataaactctggtatgccatctgcaatggaaatcatatttagtctttgcctttaagaggctttcatgtattcaatgattgacataagtcaataggcaattacaatacaaatgtgagtatacagtgctacgcaaacacatgaaagggacatttatcatattccaatggataagaaaaggcttaccttaagaagtgacatctaatctgtgagtaaatgggaaatgaaggaaaatcgtttaggcagaaagagtgccatgtttcaacatccctaagaccaaatgtggtaagaccatggggatttccaggaattgaagtagttaaggattgttttgagaagtaagactagataagtacctcttaatcagatagtgaaaggccttggctagaattttagaatttggaattattctgacagttatgggagctcattgataggttttaaacaattagacacaaatatttattgagtgcatacaatatataagtattataataattgctgcgtgagaatgcaaaggaactctattatcaagttaaagacaaaagagacatggaaaataacaagtaggtgctaaaatgtaagtaagtgcaaaagaagctaaaaaaagacatcactggggccagtatcagtcaaaattttctaactgtcttttgtttctagcctagtgaactttttgggaaacattattttcatagatttttaggcttaccgtctgacaatcagtcatccacagagtctttcatgattagatacttcaccacaaggtgggaatctcaaaggcttcttttatatagccaggggcttggccttggggctgttttgaaaaaacagtcataataatctctcatcatttatgactactatgtgtattttttatgcagaccttggtatttcatccttgtactaggtagaaaatcttaaatttttccaattgcctttatgtttattggtaacaatcagtatgatctactatactatggtgtactaaactcacattcctgggaggccatattttgaagatcttttttcctgttcaagttccatgggataaaacacaaatgtatgtccttcaataaaataattttactttaagatatttatattgaagtaaaacttttgcacaggtgcaaaaagaaatatattctaaaatgtttattgaatactgtttgtggtagcaaaaaatgacataaaactaaagtaaaatggattaaataagtatattattttcataaaatggaatatttatacctcagtcagaattgaatgaagtagtttgatctgttagaatgaaagggagaaaagaacggaacagaagcagctcaatggcaacacagatttattgggagaaagacctgcggagagggggtaccagctagtgccagagcccccttcccgcttacaggctggaccagttacagtcccgggcaggagaggtctgggattgttgtgaaaatggggtgggggcggtgtgtttggctgctgataatgaaggaatttagtgcagccaggggttaggcctgggacctgcctgacaggatgtttctcacagctcaggccctggtggaattttccactctgaccagtttgtaaaatggtaggggtctgcaaaatagtgcagtttgggctaacattcttatttcttactttagtataaaaaggaaaaagggcgtcgttgatcatctggctgcttcctgctggataggggcgttgtgattagggcctgggttctggagcttccgaatggtttcctcgtaggctctggtattagacgtggcaaaggtgaaatatattatcaatgtgtttttgcatgcttgcctggataaaacaattcagcctttgggaaatgaagcgggatacaaggttaaatatgcatggcccaatcattagtaacaggaagaggaagatcaggggtcctaggaagggggcaacccagggtatccatcttagaagggatgatccttgccaccaggagtcagcgacttgatgtcaaagctctgcagccctgtcatgaagcctacgaactgcgatatgaacaatgccagattcattaacacagaaacagcattcttcctggaggtatatgcaggtaccccctttctcagtggttaggaggtccaggactctccagttttgaaggatgactcccacgaggaagtctaattgtcgttggagactggtaatggaagtgtgcatatcttctacggtgttagaaagggttgtgaatagtgtttggtatgaggtgattgaggtggttatgcctgctattccagtgccaagtgcagcagtgatgcctaatcctgttagcagggtgatgagatgtagagcccatttatttcttatgggtgaagaggagatagaggcttctacagaaattagaatagtttggttagggggtaggatgttgatggttggagcctgaaagaccagggtgcaagttcctgaccagttggctggtaggcaaagatatcagtttgtatcacacaaaaagaagagactgggggtggacaggcagaagttgtaggtgaaggtaggtagccatgatagggtattttcgttttcccaaattgggtaactgccagccagagcggcacctgtaagggcctgatagggagtcttggctagggagttgatgaaggctgtttggttttggagagagaaagaaattgtctttgtcaaccgttagccattgctgccccggtgtggtggctgtcaggtaccagtcacaggtgagggaattgttacattttttccagggggcacctttaaactggagacatagagagcagagttggcagcggggaagccaggaattggatggaaggaaagaaaagaggatccggtggtgaggtgtagggatgtgtggatggtaggcgagccagaaaagcataacaccttctgccaggcagaggtggatatgattttgtaattagggtgtagaattgatggtctacagggagtgcaagggtaaaaataagaccacatagggactggggaacctgtcccaccattgtggcgtgggctggattagggtaggttcggctgagacataaggggggtggggatatgaaggaagtttgagtagaaatggtacccccatattggtggtttagatgatgctgtgttggtttgtatggatgttagtccagaagctattaggtgaaggagggcaacagccctacctgaaaccatgctgagagagctgagtttgaaggaaaggtgtttagctgagtttccaggttatgaaccggtttcaggaatgaatcagccaagaatggtatagccaagtaagaaatgtgtaagctcacgttggactgtgtccatgtaagtaggtcagccggaagagccgtgaatcattgggtgtgtgtagaaagacaaatccagcagttagaggagaggggagattgtgactgacttaatacgtggtgtgtgaggctgatgaagggggcccagctgtcagtgattgggggtggggactcagaatatcccataagcagagaaggcaaaaggagaaaaaggagatttgtgtaggtgtgaaatcctggaaggtgccttgcagccatagctcctcaattagcatgaggaattgagatggattatctaagggcgtggggaaggggtaccaggagagatctgagacaaggtatgaagtaaaagatttaagattggaagtggagagtgtcatgggccagtgcctttcggatgggtgacttctggaattcttgttaggcacagcgaggttggtcctgtgggaaaggaagaatatttccggggtgaggagacttcggggtgtgggccgggtgcctttttaaatttggaatggtgtatacaatagggaaaggatgttaactttgcagcagcggggatggtgaatataacctgatagggacccttccattttgttggaaaggggaggaggggtgtgctacccagacccagtctcctggctgtaagggtaagaaagtgaattgggaagaatcctcaggtttggggaggtgagtgtcagtgtactgtcggactaagtgttgagtgaggtgcagtgctggccaggtgtcctgtaagggaggggatggagcaaagttctgtaggacgaaagaacgtccatacaaaagttcaaaaggacttagatttagaggttttcgggggagggccctgaggcacataagggccaagggaagaagtgatattcagttttcattttgatctctagggaaagtttggttaactgttgttttaagagggcattcgcctgttcaaatttacccgaggattgggggtgatagagaatgtgaaaaacccatatgatgtttaaagacttagaaacctgttgagtgacttgggagataaatgctggtcaattgtccagttgtatagatgaggggaggctgaatcaaaggatgatgtgtgtgaggaaggtagaggcaatggtgtgtgccttttcagtggtagtaagaaaggcttctatccacctgaaaaggtatctaccatcgtgaggagatatcagactttctttatgggggaacgtatgagtgaagtcaatttgccaatcctgtcccggcaactggcctttgggcctgaagggagggaaaaggaggtggtctaagggcccctgaggggaagtctgactgcaggcagagcaacctttagtgaggcggtccaagctgatggccatggtaagggaatgtatacaggtttttagaaattggagcaacgggagataacccgcatggaattggttatggatgtgggtgagaacagaaagtttttgggtcttgggtaggatgagtttgtagtctaagtaaattcagctttcgttatgaacagccctggagccagcaaggcacctttttcttcttgggtgtatgctagggaaaatgggcaataacaatagtgttctaagggctgcctgccaggctgccgaatctgctaagaagtttcccttggttatggcatctgtagccttttggtgtcccttgcaatggataatgacggcctctagtggtagtttagctgcctccagcggcttgtgtatgagtttgccatttattatggcggttctttttgtagttagaaaaacccctttcctgccagattacagtgtgagactgtaggacatggtatgcatatttggaattggtgtaaatgttgaccctctttccctttgctagagtgagggtcttggttagggcaaatagttccgcttgttgtgaggtgatatgtgatgagagagcattggattataggagtttgttttcggcaatgatggcatagccagctgccagatatggttccttaaaagagcttccatcaatgaaccatgtgggttccttccgcaaaggggcttctgaaatgtgttggaaaggggaggagagggaggctaagaggtctaggcaagagtgggggattcagaattggaagtacttatagggaggagggtggttggatttagaattttacatctctggaaggtgttagagggttgctgtaagctggatggcaggaggaaaagaagagatcaatggctcatggggtcccataagttatgggaagatgcaatagtaatgtgctggtagagggtgagtttttgtgcctctgaggccagcaatgtagctgcatccagaactttcaagcatggaggccagccttggatgatagagtccagttttcagaagtatgcaatggcttctggagtgttgccacgggtttggcagagaaatccaagggcaaggccttgattacaatgaacatacagggtaaagggtttaatggaattgggtagtcctagtgctgggacattaaaagggcatctttcagtttttagaagtgggagttaatgggcaagctgggtccaaatgttctaggatggacccacgtgatgccgtgcagagtggtttggtcaacaggccaaagttaatgatccacagctggaagtacccaacaaggcccaaaaaggaagggtccttcttggtgtggggaaggggcacatcctgtattagctccttccatcgggctggcatggctcaagaattaggggttagggtgagtccaaggttagtgacttgggtttgggctacttgagcctttgtaggtaaaacctgatatccctggccatagaggaaatttagaagttgggtgatgtgttgatggatagatcaaaggagggactacacataaggaggtcattgatgtattgaaggaggctgctaggagcaaggggaagctcgattagttccttggtgagagcctgcccaaataggagggggctatcccggaacccctgtgggagtacagtctgttagttaggtagatgtgtgagtatctgggtctgaccaggtgaaagcaaaaagactttgggaagccagatccaagggaatagtaaaaaaaaaaaaaaaaaaaaaaaaaaaaaaaaaaaaagtcccttagatccaatacagagaagtgtgtgctagatgggggaatatgggagagtagagtataggggttgggggccactggataggttggtacctccacttggtaaatgacatggagatcctggaccaagtggtaaaatctgtctgtttttttgacagccaggacaagggtgttgtggggagagttaacaggtttgagaatctgagcttgtaaaaactcacagataataggtttgaggcccctgaggctggctgggctaagggaatattgaggctgatgaaggaaaatggaggagtcttggaaggttattttgactgggatgtgatgtgtggctattgtgggtttagaaacgttccacacttctggattgacagaaggtaacagagtggatagcaaagatgagggggaggagagggaagcatctggacagcagagtaaaataaaaggggtagaattgcaggaggctagtcatatgggggcctggaatttactcagtatattccaccccaagataggggtaggacactaagggataactaagaaggagtggatgaagggggtattgaataggttgcataataggggaccagtatgtgcctagaggggattccattgactctcacaatagagatagaagaactgaggagggtcaagaatattctgataaaactgagtaactagtccccagatctaaaaggaagagcatgggcttaccaaagactgacagcgttaccctgggttccgaggtggtgatggcggtgggggcagcggaccctgggccccgtcagtcttcagcagccaggtctacaatgcttgccagactggaaccagggttgcaggacctgtttgagttagaggtggtcaagcggggtgaagagtcttgttgagtgcaatctgacttccagtgtcccttgataccacagatgaggcaaggttttgagggcggcacaagattggggcagactcttgcccagggaccctgttggctacacttaaaacagactcctgatggggactgtcatgaggttgaggatttttgtatgcattggggaatcctgttgtatggcagctgacagcatctggtatttagcctggtctcttttaagctttcgggtttttatttcttcctctctattgttaaagaccttgaaggctgctttgattaagtctctttaggaggtttgagggccatcctccagtctttggagtttcttttggatgtcgggggctgactgggaaatgacgtgtaaatggaggtagactctgtcctcggcagtgtcagggcttaagctggtatatttaatcacggtctctgaaaggcaggagaaaaaaagagtagggtttttgtcaggggccttgagtgatttctttatcttttcatacttgacagtcgtaagggcggttttattcatgccagttaggaggcatgttatcatatggcctagtttctgtctgtctgcagaagccacctgataatcccaactggggacagtactgggaatagcgagggttgtgactgggttatgggcagcatcttgtccgtggagggtgtctgcttgggcctgatccagatatgttccctgttctccagggtgagggaggaggagaggatgacagaaatgtcatgccaggtaaggtcataagattgagtgatatacagaaattccttgtggaaggatgtggggtctgtggaaaaggagtcaagtctcttttcaatctgagagccatcagctacagagaaaggaacatgaactcagactatgccttcagtctccataacatcccccaatggggggactttagagggcctctgggcctgtgcctggttttcagcagcagaagggggctgagtatgagatcagttatggtggggagagggtagaggagatgggggataggaacaagggggtgggggagccgaaggggaaggaggaggagacggtggtgggagtggggctggggggcgggtggggattcgtcgtctggataaaaatcagaggaggaggaggaggagggcttgtctggaaggggaggcattttggcagatttcttgtttaagaggagcagctggtaaggtgaacaggactgatagagggaattggcaaaagcctggatatagagcatcttggaccacttgccattgtgctggaggacattttctaaatcatgttgaatttggaagtcaaaagtcccatctgggccagcagccatcattgtccagcttatactggggccaggccacattacaaaggaaaataaggcatttagttttaatggagtcggccaagcccagtgctcggaggttccagatgagacatctgagaggggtgtctggaggggatttcgaggagccctgccccatatgagtggctgggagggtgaaaaatgtggagtaggggagtgagtatcccaattctaaccatgagaagggatggagaagagccggggtgcccccgtagctcttcgtggtcccccagaaaccagagtggtcagagcgtgagcattctgagggcatcccctgagaaggcaggccagggtcacccagtggtgaccggggaatcctcttacctggcgctggggttttctggctaacaggcagaaatatgagaggaatccagagggtggaaagggaaactcacccacaattggaggccggtgttggatgcaatgggagtggtccttgccagagccacagagaggaaagagggggaaggagaaagcggtgggaggatggggccgagagaaagaattcctccgtagaaagacgaaagtgggcagggctgggaaccaggggccaatcaggatttgggaattagcccggggcgagctgccgctgcctcttccttcccaggttgcaaggaagtacctctcccttgtgggatctagaccccatcccaggttttggcaccaaatgttagaacgaaagggagaaaggaatggagcagaggcagctcaagggcaacacaggtttattgggagaaaggcctgcagatagggggtactagctagcgtcggagccccagtccttcttacaggctggggcagttctaggcctgggcaggagaggtcggggatggttgagaaaatggggcgggggtggtgtgtttggctgctgataaaggaaggaatttactgcagtcaggggttaggcctggaacctgtctgacaggatgaatttattgccctcagggtttaggcctgggacctttccaacaggatgtttctcacagctcaggcgctggtggaattttccattctgaccagagtttgtaaaatggtggcagtctgcaaaatggcgtggcttgggctaacacgatcaacatgcatcaatttcacagacaaaatattgggcggaacaccccaggataatacacaaaatgaaactgttttggtaaatactgaaaacatgcaaaacaacataaatgttatttttatatactaaaatatgtactaggatcttaataatatacatggaaaaataaacacaagaaggagagggaaatgggattacattatagcacaaaaagtattttaatttcatttgtaatgaattatttgtttaaagagaagctaaagcaagtataaaaatgttataatttaatagttggatggtatgcatttaggaatttatgttaatccctttactattgtgcctgttggaaatatttcattattaatgttaaatattattttggaaagataaaaaggtatattaataaatttatagcgatataaatacataaatatgataaataataaatcaattatagtaaaatgttaatattagaaggttatatttggatgttcaaaacctaattctttcaatatttctgaacatttaaatattttataataaaatgtttgagtaaaataataatggatcaatttctgaaatgaaatgagcaaatgatacaacaaagtgaatatttatttctaacaacccagcagttgtttgtgttatctataaatcaatgatagggtgaaataaaacctctcggattggaacaacaaatatgtgtggtaaaattttgatactagcatgcaattcacttaaatgaaaaagaaacacagaaaatatttatcccaatattgccaatacaaagaaataaaaatgaaaaataattaaaaattggacaagcactaaaagcagtatttaaaaaagtctattttaaataccatatagaagatgaatctaagaaatatacacatactttattttcctcaagattactgactagaggtttttccaacgtgcctaatccatttagacgagcaaaaatagtggttcttctctgaaaattatataacaaggaccacagcagttaagcagaaaaatgaaaaaaaattctgaatctgggaaacagaaggaaggcatgaagttctcttggctgggatcagctaaatactgggtacgaatccccaacatgggaaagcatgagtgagtgcttctctgcagttcacttttccactggggaatggtgaaatccagaccacaggagagcaccttaactttctgaatccctagatctaacttgggtaatggccgggagcctataagaaggaactgctctgggaagtgttccatgtacttcctcagacttgggtacctaaagaaaaatgacattctagattttagctcttagcaagctctgtggggtcaagggagcttgaggcagtggcagtctttggcattagagagacttgcactggggcacggacaactagggctcaaacgggaggagctcccacagccagaacagagatatgagtgtagtgtggactccagctactggtaccagaactgagcttctcttctaggaccagagaaggaggagaattgcctgggaggcatggtattgaccaagtcagtgacttctaatactagggactttgttggaaactagaagcaaattgtagtgactagccaaatattcaaactgcttaccacaattggtacaggagagtgaatgatgtcaagtctggagtgtgagggggaagcacatttcacttccactggctaagaatgtggcactggcaccacccctccctctctgtgctgagaccttgatgaagaagcagttgtccctcacccatgcattcttccagaggcccgagtaccatgatgccacccccaacagggctggtgctttaatccaccattgaggatcctgagtgtaggtttcccatgcctggttccagttagtttcaactccaacccaaggcagaacatgaactcatgaccctgaacattccatggtatcatgcaccacctgggccacttgagcaattttctcagataaagaggttgggcataaacacttctgctatcactttagctggctgtaacctgcaggcaccaactactggcatggaggtgaatctgcacagcccattacaataacagctgacataagagcacaacgctcaggaatgataaaatgtttttatgaccactgctacctgcatgaggcatgccacctcagctgttcagttcaggaaatcatgagagcactcacccatttagtatacttggcatttgagaaagattactggcttttgagaaagatcatattaagggtatttagaagcaaggaaatcatacaatctttgccactgaacacagccaaacagccttacacaacatacaccagagtcacatcaagaatagcctcccccatgaaagtacattcagaaataaaaaaagactaatactccagatatgcagtgatcaatgtaaagatacaagaatcatgaaaaagcaaggtattatgacactttcaaaggatcgcaataattctctagcaatagattctaacaaaaaatcctcaaaatgccaaataagtcagaatattgatttttaaaaagctcaatgaaatgcaagaaaaaatctgaaaccaatacaaagaaatacaaaatcaattcagaatataaacaatcaacttatcaagaatataaatatctttaaaaaatcatgtcaaattttcaacaatataccagaacaagcaaaataaagaatctcagaacttgaagacaggtgtgttgaaatagcccatgaagacaaaaacttttaaaaagaataaaaaagaatgagaaaggccttcaagactcatgggactaagagctaccaaactttcaaattatttgtattcccaaaaaggaataaaaattttaaaaatgatataaaacctatttaaagaaataattgatgaaagcttccagattatgcaaagaaatgtagacatacacatacggggggaccaacaatctcttggaaaatacattataaaaaggaattcactatagcatactctcatcagactgtctaaaaaatgtgaaaaaaagaattgtaaaattatcaagagaaaagtatctactgacccacaaggaaaccctatcagactaagtgaaaacatactagcagaaaacttaacagtcagaacagaatgggatagtattatcaaacgcttaacaaaaagctgcaatcaacaattttatatccagctagattaagcttcaaagaagaagaaataatttccagagaagcaaatgctgaggaaattcatcaccactgcactaacttatgagaaatgcccaaaggaatcctaaacatggaaattaaaagtcaatattcaccatcatggaaacacccagaaaaagtaacctcacaggtattataaaaccatcacataaaggatgaagagaaataaatcaaatggtgattcaatacaataacactaaagactaacagaatttataaaacagctggataatacttttatttatttatttattttgagacagagtctcactctgttgcccaggctggagtgcagtggcgcgatctcggctcactgcaagctccgcctcctgggttcacaccattctcctgcctcagcctcccgagtagctgggactacaggcgcctgccaccacgcccggctaatgttttgtatttttagtagagacagggtttcaccatgttagccaggatggtctcgatctcctgacctcgtgatccgcccgcctcagcctcccaaagtgctgggattacaggtatgagccaccgcgcccggcctggagaatacttttatacatttttatatttttaacaatatgacagtaactaaatgtaacatatcattattaaccctgaatataaatgaattcaatgctccacttaaaagacacagattgacaaaatggatttagaaaattatgatccaaccatatgaagcttacaagaaactcagtttacctgtaaagatacatttaaactgaaagtaaagtgtgaaaaaaaattatgtacaaatagaaacagaaagcaggagtcactatatttatatcagataaaacagtctttaaatcaaaaacagtaaaaaaaggcaagataatcatattataaaaaatatggccaagtcatcaattcagtaagaggatataacaattctaaatgtatatgcacccaaaaccaaagctcccaccattcataaacaaatattagtagacctaaagaagagatatacagcaattcattaataatgggggacctcaatgccccacttacagcactagacagatcaatgagacaaaaaatacaacacggaaactttggatttatgttgaattttagaccaaatggacctaacaggcatttatagaacattctacccaacaactgaagaatatacattcattcttctcattgcacatggaacattttccaagacaggccatatgttaggccacaaaacaagtcttaacacatttttaaaaactgtaatcatatcaagtatcttctcagaccacaatggaaaaaacagaaataccaagaggaaacactgaaaatatacaaaagcatgggaattaaacaacacactcctgagtatttaggtcaataaagttaagacagaaatttaagaaaatctttgaaatgaatacaaatggaaatatataccagaacttctgggatataacaaagcgaagaaagtttatagcagtaaatgcctacatcaacaaagtagagcaatcaaaaaataacaacctaatgttacacctcaagaaacaaccaaaccaagaaaaaaccaaacccaaaattagcaaaagaaaataaataaataaataaataaataaataaataaataaataaatcagggcagaactaaataaactacatcaaaaaccaaaccaatacaaagtaatcaataaaacaaaaaactcactcttcaaaacaaaaaaggtttcttttttgttctgataaacaaaacaaaacaaaataaaacaaaaagaattgataaacagaactgataaaccactagctagactaaccactgcaattcataacatacacataaaaatgatcatcggatactcttttgaacaactaaatgctcacaaacttaacaacctaaagacaatagatacattttgggacacaactaacctcccaaaaactgtaaaaagaaaaagaaatggaaatccagaacagatcaacaatgaagaaggagattggaatagtaataaaagaaaaccccaaaaacaaaaaaatccatacccatacagattcacagctgaattctaccaaacctacaaagaagaattaatatgaatactcctgaaattgttccaaaaatgtgaggaggacagaatttcccttacttcattctaagaagccagtatcatcctgatatataaaccaaacaaggacacagaaaatagaaaccagaaaaagtacagaccaataacactgatgaacattgaagcaaaaatcctcaaaaaaatactagtgaaccaaatccaacagcacatcacaaagatactgcacagtgatcaagtgggttttataacatagatgaaaggatggttcaatatacacacatcagtacatgtgatacattatataaaaataattgagaataaaaatcacatgatcatctcaatatacacagagaaaacttttcataaaattcagcatcccttcatgataaaatactcaataaactaagaataaaaagaacataactcaaaatgacaaagaccatatacaagaaatgcaaaaccaacatcatagtcaatagagaaaagtcgaaagcttttcctctaagaacttaaataagacaagaatgcaactttcaccactcatattaaacagagaactaaaagtcctagccagagcattcaggaaagagaaagaaataaaagccatctaagttggacaagaggaagtgatattattgctatttgcagatgttatgcttatgtatctataaaatcctaaagattcaaccaaaaatttcctagatttgataaatgagttcaatacagatttaggatacaaaagaaaggtataaaaatcagtagcctatttatacaacaataatcttatctgagaacaaactcaagaaggaaattccattcacaatatctacaataaatgctcaggaatatatttaaccaagaaggtgaaagaaaaactgcaaaacactgacaaaataaattatagataatacaaatggaaaaacatctcatgctcatgaattggaaaaattaatacagttaaaatgaccatactgaccaaaacaatctagagattaaatccaatcatgtcaaaatataaatgttattctttcacagaattagtaaaacaatagtgaaattcacacaaaaccagaaaagtgtgtagatggccaaagcaatcctaagtgaaaagaacaaaggtggaggcatcacattacctgacttcaaattatactacaaggctatagtaaccaaacagcatgaaactggtatgaaaatagatacatatgttaatggatcagaatagaggacccagaaataaagccacatgtctacagccaactgatctctgacaaagttgacaagaacatacattgaagaatgacactcttttcaatcaatggtgctggagctcttgcactaacactgaacagaaaacagtggatacttcccagccctgagcagccactcctgattgtggagcactgagacggcgcccagacttgtgcctgccagaagcccacccttgagccagcaccatctccagcatgaccacatgccccatgaaccaacatctgagtcaaaaactttgccagcatgtctatagacaccatcaggggctgcctgtacctccctcccaccctgcattgccttcaccactgtggtgaacatttgcagagaggcaggcaccctggcaccaacttaccacactgctgcagctgctgctactgctgttgctggcatatgtgaatgaggaaggatctggctgtaaacatactataaaacgctttggctgacactacccattggagtgtagtgaacagcagtgcaggagcaccttggccctcatagtgcagtaaattcctaaattcaaggaggcagagaacaaagttgagacccaatacaagttccccacagttagagaatgcagtccaaaagttgggaggtaagcgctggccacctaaaatctttcagaaatgaagccagttggctgtaaggactaagatctgaatttttttttaatcttgtccaaattcttatgtaagggatctgaggagtcatgccctacaaactataaattatcatctgatgggttttatttaaccctgtatatcgtgacttactttccaatctgactctggcataaccttatgtgacaaagaagaaaataaaaatattttaccccaaaatgcttcatcatattttgaaatggcccttcaaaaccatcctttgtgggggaaatttgcatatgtaaagactctctaataatatagctagatctttttcttccaggccctcccaatcctgaagatattaactgagattctagcaccttttaaagatctgaataggaaatatttgtcatctattgtctgtaagggcagccactatgagacttcagaaaccttggtctccataatcttttatcttaacctgaacatttcctttctattaatcccaggtctttagacaaactcaaccaagagtaaacaagaaaatgtttaaattcacccaaagcctggaagccccttcttcgaattttcctgcctttctcgaccaaaccaatgtatttctcaaatgtatttaattgatgtttcatgcctccctaaaatgtataacaccaagctgcaccccaaccatcttggacacatgttctcaggacctcctgagggctgtatcacaggccatggtcactcatattgggctcaggacaaatctcttaaaatattttacggagtttgactcttttcatcaacggctgcatccaacttataccacaatcaagccctcaaaataattagataggataaaataaagtaagcaacagcaaagattgtaggaagataagcacggaaagaagagaaagaatcaacccaagaatcctgaagactcaaaaagcccaggtaccttctttcctccaaatgaccacatcacctctcctgcaagagttctgaaccaggttgagatggctgaaaggacaaaaatataattcagaatatgaataggaatgaagatcattgagctacaggagtacactgaaacccaatccaaggaagctaaaaatcatgataaaacaattcagaagttgacagacaaaatagccagtataggaaataacattactgtcctgatagagctgaaaaacacactatgagaacttcacaatgcaatcataagtatcaatggcagaatagaccaagtggaaagaaagaatctcagagcttgaagcctatctttttggaataagacaggcaaacaagaacagacataaaaagaatgcaaaggaatgaacaaaatctttgggaggtatgggattatgtaaagagaccaaatctacgattcaatggtgtacctgaaagagatggggagaatggaatcacttggaaaacatttcaggatatcatccatgagaacttcctcaacctagatagaaaggcaaacatttaaattcaggaaatgcagagaagcacagttagacactttacaagaagatcatctccaagacacataatcatctaattctccaaggtcaaaaaaaaaaaaaaatgttaatggcagctacagagaaaggtcaggtcacctacaaaaagaagtccattagactaacagcagacctctcagcagaaaccctacaaacaagaacagattgaggacgaatattcaacattcttaaaaaaaaaaaattccaaaaccagaatttcatatccatccaaactatgcttcataagtgaaggagaaataaaatccttttcagacaagcaaatgcagaggaagtttgttatcagcagacttgccttataagagctcctgaaggaagcactaaatgtggaaaagaaaaacagttaccagtcactaaaaaaacacactgatgtaaaaacacaccagtgacactataaagcaaccacacaaataagtgtgcaaaataaccagctaatattatgacagaatcaaatccacacgtcaatactaaccttgaatgtaaatatgctaagtgccccaattaaaagtcacagagtggcaaggtaaataaagaaacaagacctaaaactatgctgtcttcaagagacccaggaagtaagacacaggaagacagacacctcgtgttctcacttataagtaggagataaatgacatgtaaacatggacttagagtgtagaataatacacaatatagactcaaggatggggatttggcagatgaaatattaattaatggatacaatgtacattattctggtgatggatatactaaaagccctgacttcaccactatacaatatatccatgtaacattattacacttgtaccccataaatttatacaaataaaataaaatgaatacagtcatacagcctactggtatgcatgtacactgtgaaatataataacattatattatttttatttttctattttttattattgatatataacataaattttagtattttaaaatgtgtacttcagcagttttcagtattttcacaatgctgtgcaactattaccactatctaattagagaacatttccatactcccatgttcattaacatatactctccatcatcttcatctctaagtcattggcaaacatttatctactttatatctccatgaaattgcctacacttgacatcctttttcttccagggagcatcttttcaacattcatccattttggagcacatatcagtaattaatttatttttatggcccaatatattattgttttgctagaccacattttgtttaaccattgatggactttttttttgtgtacaagattttgtttgaacatatggtttcaattcttatggttatagagttaggattagaattgataggtcacattggcattctacagtgaattattttataaactgtgaaagtattttccatagcagctgcactattttacattccctccttcaatatatgaggattcaaattttgcaaatcaccaataccatttatttccttattaaaatatttatagccatcccagtggatataaagaataccttactggtttgcatttccctatatgattaatgatgttgaacatatttttgtgtgttcatttgtcatatatacgtcttctttggagaagtatctattcacataatttggttatgttttaactgaccaaattatttttgtttttctctttttattgttgttttaagtgttcattatatgttatgtacactagactctaatcagatatattgatggcttgaaaaggctttctctaattctgtagattgtcttttcatggtagtgtccttcaatgtacaaaataaattttgaagtcaaatttatctatattgtcatttcttgcttgatctttgtgtcatactttaaaaaggtgcctaatcaaatgtcattaaaattttcattttttatctaaacattttatacttttacctctcacattcaagtctttgatacatatgagtgcaactccattattttgtatgtgcatatccatttgttccaggaccatttgttgaaaaggctattccttccccattaaattgtcctggcaatcctttttaagatcaattgaatattaatgcatgggttaatttctgcactctgaattctattatattaccttatataggtctacccttatgacagtagcacattgtcttaactactatagctttgtagtaatttgtgaaaacgggaagtgtggttctccaaatttcctctgctccatcaagattgttttggcaatactgagccccaattttccaattttatgattagcttgtacgtttctgcaaagaaaagactattgtggttttgaaagggatttcagagaaacatagaggaaaagacaaactttatttccctctatgcccacctaacacagcacagaacactgcacttctattattaatatgtgaggattattccctcacacaccaagcaattcttcaatggacaccaactgggtattccattattcaattccgacagtatttagttgggttggatagtgtcagatcttgtgagatatcacaagatcatatctcacaagatctagtgtgctaaatcttgtgagatggagccctcacaggttgaggcctctatctcacaggaatgtccccgcttcaacactaattggaagtagcaggttgtcacctgtacttctgagtgtccagctatgtatcagaattcccatagctcccaacttaggtttaattgggtaggacagcttgtggaactcaggaaacatgtacatttactaatttagtatttttttaatggaatggatttttattttctagaattttttaaattatactttaagttctagggtacatgtccacaatgtgcaggtttcttacatatgtatacatgtgccgtgttggtgtgctgcacccattaactcgtcatttacattaggtatatctcctaatgctatccctcccttcttcccccaccccaccacaggccccagtgtgtgatgttccccaccctgtgtccaagtgttctcattgttaaattcccacctatgagtgagaacatgcggtgtttgcttttctgtccttgcgatagtttgctcagaatgatggcttccagcttcatccatgtccctgcaaaggacacgaactcatccttttttatggctgcatagtattccatggtgtatatttgccacattttttaaatccagtctatcattgttggatatttgggttggttccaagtctttgctattgtgaatagtgccacaataaacatacgtgtgcatgtgtctttatggcagcatgatttataatcctttgggtatatacccagtaatgggatggctgggtcaaatggtatttccagttctagatccctgaggcatcgccacactgtcttccacaatggacgaactagtttacagtcccactaaaagtgtaaaagtgttcctatttctccacatcctctcaagcacccgttgtttcctgaatttttaatgatcgccattctaactagtaggagatggtatcacattgtggatttgatttgcatttctctgatggccagtgatgatgagcattttttcatgtgtctgttgcctgcataaatgtcttcttttgagaagtgtctgttcaaatccttagctcactttttgaggtttttgtaggttgcctgttcactctgatggtagtttcttttgctatgcagaagctcttcagtttgattagataccatttgtctactttggcttttgttgccattgcttttgatgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctcgccagttttcccagcaccatttattaaatagggaatcctttccccattgcttgtttttgtcagctttgtcaaagatcagatggttgtagatgtgtggtattatttctgaggactctgttctgttccattggtctatctctctgttttggtaccagtaccatgctgttttggttactgtagccttgtagtatactttgaagtcagggagcgtgatgcctccagctttgttcttttggcttaggattgtcttggcaatgcgggctcttttttggttccatatgaactttaaagtagatttttccagttgtgtgaagaaagtcattggtagcttgatggggatagcattgaatctataaattaccttgggcagtatggccattttcatattgattcttcctatccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctccctgtttgtctcttattggtgtataggaatgcttatgatttttgcacattgattttgtatcctgagactttgctgaagttgcttatcagattaaggagattttgagctgagattatggggttttctagatatacaatcatgtcatctgcaaacagggacaatttgactttctcttttcctaactgaataccctttatttctttctcctgcctaactgccctggccagaacttccaacactatgttgaataggagtggtgagagagggcatccctgtcttgtgccagttttcaaagggaatgcttccagtttttgctgtttcagtatgatattggctgtgggtctgtcagaaatagctcttattattttgagatacgtcccttcaatacctagtttattgagagttttaacatgaagggctgttgaatattgtcaaaggccttttcttcatctattgagataatcatgtggtttttgtctttgattctctttatgtgatggattacgtttattgatttgcatatgttgaaccagctttgcatccaagggatgaagctaacttgatcgtggtggataagctttttgatgtgctgctggatcctgtttggcagtattttattgaggatttttacatctatgttcatcagggatattggtctaaaattctctttttttgttgtgtctctgccaggctttggtatcaggatgatgctggcctcataaaatgacttagggaggattccctctttctattgattggaatattttcagaaggaatggtaccaactcctctttgtacctctggtagtctttggctgtgaatccatctggtccaggactttttttggctggtaagctattaattattccctcaatttcagagcctgttattggtctattcagtgattcaacgtcttcctggtttaggctagggagggtttatgtctccaggaacttatccatttcttctagatcttctagtttatttgcgtagaggtgtttatagtattctctgatggtagtttgtatttctgtgcgatcggtggtgatatctcctttatcattttttattgcacctatttgattcttctctcttttcttctttattagtcttgctagcggtctatcaattttgttgatcttttcaaaacaccagctcctggattcattgattttttgaagggattttttgtgtctctatctccttcagttctgctctgatcttagttatttcttgccttctgctagcttttgaatatgtttactcttgcttctctagttcttttaattgtgatgttagggtgtcaactttagatctttcctgctttctcttgtgggcatttaatgctataaatttccctctacacattgctttatatgtgtcccagagattctagtaggttgtgtctttgtcctcattggtttcaaagaacatctttatttctgccttcattttgttatgtacccagtagtcattcaggagcaggttgttcagtttccatgtagttgaacagttttgagtgagtttcttaatcctgagctctagtttgattgcactgtggtctgagagacagtttgttacaatttctgttttttacatttgctgaggagtgctttacttccaactatgtggtcaattttggaataagtgggatgtggtactgagaagaatgtatattctgttgatttggggtggagagttctctagatgtctattaggtccgcttggtgcagagctgagttcaattcctgcatatccttgttaactttctgtctcgttgatgtgtctaatgttgatggtggggtgttaaaatctcccattattactgtgtgggagtctaagtctctttgtaggtttctaaggacttgctttatgaatctgggtactcctgtattgggtgcatatatatttcggatagttagctcttcttgttgaattgatccctttacgattatgtaatggtcttctttgtctcttttgatctttgttggtttgaagtccgttttatgagagactaggattgcaacccctgcttttttttgttttccttttgcttggtagatcttcgtccatccctttatgttgagcctatgtgtgtctctgcatgtgagatgggtctcctgaatacagcacactgatgggtcttgactctgtccaatgtgccagtctgtgtcttttaattggagcatttagcccatttacatttaaggttaatatccttatgtgtgaatttgatcctgtcattatgatgttagctggttattttgctcgttagttgatgcagtttcttcctagtatcaatgggctttacaatttggcatgtttttgcagtggctggtactggttgttcgtttccatgtttaatgcttccttcaagagctcttgtaaggcaggcctggtggtgacaaaattttgcagcatttgcttgtctgtaaagaattttatttctccttctctcatgaaggttagtttggctggatatgaaattctggattgaaaattctttccttaataatgttgaatattggccccaactctcttctggcttgtagagtttctgccgagagatccactgttagtctgatgggcttccctttgtgggtaacccaacctttctctctggctgcccttaacattttttccttcatttcaactttggtgaatctgaaaattatgtgtcttggacttgctcttctcaaggcctatctttgtggcattctctgtatttcttgaatttgaatgttggcctgccttgctaggttggggaagttctcctggataatatcctggagagtgttttccaacttggttccattctccccgtcactttcaggtacaccaatcagatgtagatttggttttttcccatagtcccatatttcttggaggctttgttcagttctttttactcttttttctctaaacttctcttctcggttcatttcattcatttgatcttcaatcactgataccatttcttacatttgattgaattggctactgaagcttgtgagtgcgtcatgtaattctcgtgccatggttttcagctccatcaggtcatttaaggtctcctctacactgcttattctagttagccatttttctaattttttttaaggtttttagctccttgcgatgggttcaaacatcctcctttagctcggagaagtttgttatttccgatcatctgaagccttcttttctcaactcatcaaagtcattctccgtcgagctttgttccattgctggcgtggagctgcgatcctttggaggagaagaggcactctgatttttagaattttcagcttttctgctctggtttctccccatctttgtggtttaatctacctttggtctttgatgatagtgacgcacagatggggttttggtgttgatgtcctgtttgttagctgtccttctaacagtcaggaccctcagctgcaggtctgttggagtttgctggaggtctactccagaccatgtttgcctgggtatcaccagcagaggctgcagaacagcaaatattgcagaacagcaaatgttgctgcctgatccttcctctgaaagcttcatctcagaggggcacccggctgtatgaggtgccagtaggcccctactgggagatgtctcccagttaggctacttgggggtcagggacccacttgaggaggcagtctgtccattgtcggatctcaaactctgtgctgggagaaccactactctgttcaatgctgttagacagggatgtttaagtctgcaaaagtttctgctgccttttgttcagctatgccctgcccccagaggtggagtctacagaggcaggcaggcctccttgagctgcagtgggctccatccagtttgagcttcccagctgctgtgtttacctactcaagcctcagcaacggtggatgcccctcccccagtcttgctgccgccttgcagttcgatctcagactgctatgttagcaatgagtgaggctctgtgggcatgggaccctccgagccaggtgtgggaaataatctcctggtctgccatttgctaagactgttggaaaagcacagtattagggtaggagtgtcccgattgtccaggtaccatctgtcatggttttccttggctaggaaagggaattccccaactgcttgtgcttcccgggtaaggccatgctcttccctgcttcagctcacactcggtgggctgcacccactgtccgacaagccccattgagatgaacctggtacctcagttggaaatgcagaaatcccccatcttctgcgttgctcatgctgggagctgtagactggagctgttcctatttggccatctttagaattgtaatacaagatagccaaaaaatgcagccagaaagagcatttctcaccaagagaccagaccattaagaagactggcacactctgaacagatcttcagaaggaaggcactgagtatatacagaggaaggatgcagatcttgagctgaagggaaaggaagctggaaaccctgcacagggctggcaagcaaccggactcattcatgatcccagtggctctcctagggaggtggtatgttaaatagccaagaagtggctcaatctcaccatagacatccagaatccgaactgccagggacctcatgactcccatggacgtttgagctggcaaggagagctgcttggagaggtggcagggacaggactccagtctgtgtgaagctcagagaatttgacacaggaaaggctgcatggccagtgatgcccatctcccaaggcttggcatgctcctctaggagactttggaatttgttgactgttggacctggacagagcaagaatgtcttccctgtgggatggggcaaatttgatctgagaaccctcctgtctgccagcctcttccaagatcccttcctggctgtcctcgatggtagaacagtcttgaacacctgactttggtgcatcccagtcactgctgccatatcttattcactggcagactctgcctgtcagagagcttcagcagaagggttcctgccaacatatacccacataaagcatccccccaccactttgcaagcacactcacctgcagtttccctctactactttgttggtgtacactcacctgcagacaccaacccctactttgcattgctggtgcacacacaagtctgaaacttatagcccttctgccactggtgcatgcacatgtgcacttcacagccacaatcctgacaccaccagagcatgaacgtggaccccattgtactgctgctgccacaaatacaaactcatgtgaggagtctgccacatcaccaccacgacaagcatgcatgcattgactctactgcactgctgctggtgaatgcacgtgcatggatcccaatgcatagctatctcccactcaagtatgcacacacaaaccctaccatcccaccaccgttggcaagtgcatgtgaatgcagacaccaatgccactgctacaatgaagtgtttttgctggcactgcctatgagaatgttgttgccagcagattgagaaaaacttagatgcagttggttcttaccttcaaagggccaaagaacaatgtcatgtgcctagacccaggccgccagttacagcacattgcccaagaatgctgagctgatccttgacccctacaatcatctagagaaacaaagccagtcaatcgaactcaacttacaacacagtcaaatccacaagggcatcaaagaaagtaaaatgactatccaaaggacagaaacttcaaagattaaaagaggattagcccacccagatgacaaaaaaaaaaaaaacaaaaaacagcccaataactcaggtatctcaaaaactagcatgtcttcttatcatctccaaatgactgtactagcttcccagcaattgttcttaatgctgaaactgctggaatgaaagacatagaattcagtgtctgaatagctatgaagattaatgagattctggaagagttgaaacccaatccaaaacatctagtgaatccaataaagcaacacaagagcagaaagataaaattgccattttaaaaaaatcgaactatctaatagaggtgaaaaactcactgtgggaattttataatacaattggaattgttaaaaaatagaccaagctgagaaaagagtatcagaaaaagagtatcagagctcaaagacatgctttgaatcaactcaatgagttaaaactaaaaaagaaagaataatacagaatgaacaaaacctacaagaaatatgggattatgtaaagagaccaaactgacaactcattggcatccctgagagagaggaagagatcaagcaacttcaaaaacatattagaggatattgtgtacaaaaatacctgaacctcactagagaggtcaacattcaattcagaaaatgaagagaaccctgcaagacactatgaaagatgacaatccctaagatacagtcattacattctccaaagtcaaagtaaaaaaagtattcaaggcaggtagagagatgggcaggtcaccaaaaagggaatcccattgtataagtccattttcacactgttataaaaaactgcctgagaccgggtaatttattaaaaaaaaaagaagtttaattggttcacagttcagcatggctggagaaacctcaagaaacttaaaatcatggcaggaggtgaaggcgaagcaaggtaccttcttcacaaggtgacaggaaggagaagtgccgagaaaagtggtaagagcccgttgtaaaaccatcagatctcatgagaactcactatcatgagaacagcatgggggaaactgcccccatgattcaattacctccacctggtctattccttaacacttggggatgttgggaattatggggattacaattcaagatgatatctgggtggggacaaaaagcctaaccatatcacccatcaagctaatagacttttcaacagaaatgctacaagctacaaaatactggggccctatattcagaattcttaaagaaaagaaattctaaccaagaatttcatatccagccaaacaatgcttcataagttaaggagaaataatatgcttttcagacaagcacgtactaaggaaattgagacaagcatgtgctaaggaaattcactatcaccagatctgctggataaggaatctttaagagagttgtaaacatggtcataaaagaatcacacctgctaaaacaaaaacacatgtaagcacatagtccacaaccactataaagcaactacacaatcaagtctgcataagaaccagctaaaatcatgatgacaaaatcaaatctgtacatatcaatattaatctttaatataaacaggttaaacatcccacataaaagacacagagtggcaagctggcaaagaagcaaaactcaactatatgctgtcttcaagagacacatctcacatacaatgatatccataggctcaaagtaaatggatagagagaaatataccaagcaaatgaaaaacaaaacctagcagaagttgttattctaattgcagacaaacagacttaaaaccaataatgatcaaaaaagataatagaccaactgaaacaagttggttctttgacagaataaagaagattggtagatcactaactagactaataaagaaaagagatacaaataaacacagtcagaaatgacaaaggggccactactgccaacccaacataaatacagaaaaacctgagactagtacaaacacctctatgtgcacaaactggaaaacctagaaggaatgaatacattcctggaaacacactacctcccaagattgaaccaggaagaaactgaaaccctgaacagaccaataagttctgaaattgcatcaataataaaaagcctaccaacaccaaaaagccctggaccagacagagtcacaaccaaatgttgtaagatatataagcaagatctgtaccaatgctactgaaactattccaaaaattgaggagtgtcttctccctaactcattctatgagactagaataatttgaatatgaaaaccaggcagagccacaaaagaaaggtaaaacttcaggctaataatcctgacaaacacaaatacaaaaatattcaacaaaataccagcaaaccaaatccagcagcatatcaaaatgctaattcagcacgaacaagtaggctttatttctgtgatacaaggttggttcaatacatgcaatcaataaatgtaatttatcatataaactaaaacaaaaaccacaggatcacctgaatagacacaaaataatagaaacactaaaaggaaagtgacatagaaaagggaagttaggtacaaaaacagcttgattgtttacagcttggtgtttgccttatttgagcatggcttgaacagttgcctgcctatgattcgttgaaactctatgactggtacaatagtaggttacagtctatttatacctccagttaggttacagttcaccatgtacagagaaaccttcaggacaaacttaaaatatgtaaggaggcagttttcggctagaaggcagttttaacaaatctcccctttcggtcaacttctcaattttgagaaattgactacatctttaggtgttgacataattgtcaccatcataagtagacttatttgttctcaaatcctaatgataaattgaataaggggtattgtaaggtaagaacaagaaaacaaaacagtaggaaaaaactgattacctctggttaccttttcataagggttaaagcagagggggctcacttatgtcagaatctcctgttttcaggagaacaacagcagcaaaaaaaaaaaaaaaaaaaaaaaaaaaaatccaccagtgtcttttgggatctatcttcttccttaaagtttcagttttcttacatcgcatttagcacaagtaaccccactttggtttgttctcctggggcttagtgcaggagcttagttcagaataatggcctcccataattgtggtcaataattcctccctttttgtcaagttctcacttagatgagcgtgtgaccaaaacttggggctttagcactactctcgattatcaccattttgaatttctggtcttagtacatcattcgtagcttatggtgtccatatgattatgcattttgagtttttgttgatcctgtgaaagagatatttgatattctataggtgactgcatgcatgcattttaaaatttgagcgaatgcatgcaccaccagactactattatgactatcacaagaataacaacaaaagtttgaagtatgttccctagccagggtccccatgaaccaccctaattaaaatcaaatatgtcaacaaatgaaccagacaaatagtctattcattttaaccaagcagcctgtttgtcaatcccctgcaagtgaatctctataatacctgtgtgccacaagaagtgtcagcaactgcacagattcttccttgttcagccagtaggtaatctagagcaactctattattgaccacaactttagcaagataatttacagaagtctgtttgctaccatggcagtcatagtaaaatctgataaagagagtattattagcattgaatttctaattatttcctcatttacatttacacctggccttggaaaaagggacataataatgtccatctagaatgatgaaggcctcttgttaatgttctttttgacttatgatgtcaattaacaagagtggaccagtgttctatttctgactgattatggagcaacaaatatgccattaaaattcctagcccacactggcctttcatttttcatccattaaggcacaaagttgtccatatatacagttggctacaaaatacatcacaaataaaagtatatcccatgggtgcacatgggccctttttctcattctattttttcatagagacataagcaggaaaaaaattgagaggtaagagtctgatgatggcaaagaagtcttaatctgtgatcttggaaaatttgtccatgtccacaataccatctgcttctgaggagaacactcctggttagctttaccttgagttctctgatgaacgtacaacatttataaaagtctggaggggcctttatgagttgtgagatgatgaactaaaggttcctggtcctaaagttttgctgcaggtgagtgaaggggggtgcaacgcgtgggtggcaaaagcagtctctctgatggatttactgaagacaaaatgtttgagctctatattagaaaagtaagattgtccttagttggaggatcatggaaagcttcctttacttgttgaaaatacattttggcataatgtattaaaaccttgatgattctgctcaaatcagagtttaggagtgggagttacatgaggttatactactgtgaagagaggtcttccagtgactatttcataaagggtcagtgtatgttttccactggaagtggatctgattgtcatcagactgaaacatctttaaccaagataattcagtagactcggttagctttgcctaatgctattgtgtttgtaatacctcatttcaactgttttccaaattatccagtgaaataagtacctctctcactaaagatttatccatgcataccccaagaagaaaacacatttcctaataaccttttagctattgttgtagaatcagccttcttgcataggaaagcttctatacaaccagaaaacatacacgaaaatggcaattagtaggaaaaataaaaacaaaagttaaataaaataaagaataaaaagggaacacaatgtttaaatctagtgattttcccaaataaacagaaatgatcaatagtgaaaaagttctagagttgcaagagacctcaaggggtccttcaaatagggctattacctcatttatatttacattaagccatggaaaaagggacaaaacaaataatgcccatccagaatgggtattacccaagagacttaatcttttaggataatggatggaaagaagctaaaaaacactctcattctaaaaatactccttaagctaataaaaagagcaaatgaaaaatgcaaatgtttcaagcttaagtaattgtagtattgtcaaagcttattggaatggagattcaaaaatttcctggggagcttattccaggatttaaatattctttctgacccaacgttctccattctatctaacaaacatttatacactataaacccattttctctatttctgtcttctggagaaaagaaaaatgccagtcagctaccagaagacaatttacgtgcctacagacagctgagccttcttttcctttataacaacactccatggtagataataatcaaatgcattattcaatctttttctgtcttggagtttcaatctcatctacagcctctagtgctctgaaatcaagtaaatgacttccggagtaaatctctttgagaaatgctataaaaaaactttcttataaatttacaggttagcagtagtcaaaattgggtacttaggatttatcatccctcaagctatttagttggtattacatttaaaagttactgattctgcctacaaccagaatcagcagagcctgccattccatttgcattgcttatatggtcaattactgcagtcataggccaatcccattgcaatttttccctttttctaagcaggaaaagaaatcccaacaacttgagttgctttcatatgggtatagagtctggttccagttaaatacattattatggaacttattgaataaaggcaagtatctcccagctcacagatttgaccttgacctgcctcacctctcacaatacacaactgtttaagctttttcatataaagacagccacacaatttcctatttatgtcaactattatgttaaaaacatttaattttatttaatatatttttaacttgtctaaattttctaaacatttttacatctttcctacctcgtgaagaacaaaagtaggcacatgagtatgataatcctttgatccttgtatggaatggtcacatataaaggagactattattgtagtggaacatctatatcaatgctattactattaaagcattttagcagtaaaaaaaataaaagaaaatggaaattaaaatctctcaataaatgttcaaatggcctaaggttttgattatcttcccagggttatggatttaacaaaccaaactttggtcacaaaccatattaaccatttagaacagtcaccataccaataactttaagatataatttggatcatttcatttcttctatgattgagtcatggactgcagagcttttaatggaagctttaaagattcagaaaggaccaggcagctgtttaggctctgcatgagtagatgcttaaaactggatttatatcctctgaaatatcagttttgtttcaccagttcaaggtcatagcactgtatattaaataggttatcattggtaatttgacttggaccactgagtttattcaaattgcagatctcaacaatctcagtactgtcttatttagcactaaaatctggaaaaatattttcttggaattcaattaatttttgtcttttgtggttagcagttttatataccagttaatctcttcattagagttcttgtaattattacccagcccaagcgatactaaagttattagaaactcataatcaagagtgcctgtcagggtcatttccatcctttccatgagctttgttgaagaaggattttacttgcttgtaaagagctttcagaaaacatgtcagaattaagcaattacctgtaaacaatagttaatatggtcatggttaaaggcacaattgacaagaacatcgagttatttctgtggtccacaataatttaacataataaccatcattatgactgataacctatactgagacatatcagaattttaggaatatcatacaattttgtaatgcatataatagcatatctataaagctataacttggagattaaacattatgtctttttttggcaatgcttcccatatattttaacatatcaaaaaaggctatttgttacttctcttttggaagctgcagtggcttttagtaatatcccaaagttaaagatcaaaaagacttaattttagaatttagtattttattctggaaagtttgtcaaataccagatatttaggactcctaatattaaattaaaagtttaaaacactaatcaaaatgatatcacagattactgtaaaataatattcatttagtgaaagcaataataaaatggtttttaagaagcaaaatcctttattctttgatagaaaacacactcagttttccaatcaaaaaatctataaaagtatgaaatagaatctgcctctcctttccttttttctttactgtagtttactttaaaagtgaaaaaaactctatctgataaatattacatgaatgtcttgtttaaatgagaaaacaaaattttacttttatattagtttattatcaatactaaagatagttttgacaaattgtcataaacagatccatctattctcaggttttgacaacagatttccataaaacttttataacctcttacaaattaaatttttttattcctcaactttttagactcctttagttttatctacattatttttctccattttgaaacatttaaataacctttaaactagacaaaattattttttctttaggaaaagccatatcctcaaaccttttttgaaaacttcctcatgaaaaacacatcttacttttcgaatactctctgcatatagaattgtttcttatattgagtaattttaattacatatattaatcaaaattttgactctatccccaatttccagtgaaaaaccaaggaagtaattaattttgaactattttatacaagtatttatagatgaaaacaatttcataagtttttagaaagatgtttcttcaattttttaattaacaggtctaaatatatttaccttttctataccatctaaaaattagatgccaaagtatatgaactgcaacgaaaacatatgtttaataattaatatttcagtattttcactaacccacaattgactcagtttatgattatctattatttaatttaacatgtgtttaacattttaaattactaagaagaattttgaaatgatgacacacatacccttcctaacatcttccccagttttcctggttcccaagaagctacctggcactcaagaaaagggatgaagtgcaggacctgtcttggctctaaatttacatatcaaatacagagctcaggacagaggacaggtctgtgaagaggatgtcctggggttgggggagtagggagagatagcagtaggagatatacctaatgtaaatgatgagttaatgggtcaccattttgtcaaaggccttttctgcatctattgagataatcatgtggtttttgtctttggttctgtttatatgctggattacgtttattgctttgcatatgttgaaccagccttgcatcccagggatgaagcccacttgatcatggtggataagttttttgatgtgctgctggattcggtttgccagtatcttattgaggacttttgcatcgatgttcatcagggatattggtctaaaattctctttttttgttgtgtctctgccaggctttggtatcaggatgatgctggcttcataaaatgagttagggaggattccctctttttctattgattggaatagtttcagaaggaatagtaccagctcctccttgtacctctggtagaattcggctgtgaatccatctggtcctggacttttttttggttggtaagctattaattattgcctcaatttcagatcctgttattggtctattcagagattcaccttcttcctggtttcgtcttgggagggtgtatgtgtcaaggaatttatccatttcttctagattttctagtttatttgcatagaggtgtttatagtattctctgatggtagtttgtatttctgtgggatcggtggtgatatcccctttatcatttttgattgcatctacttgattcttctctcttttcttattagtcttgctagcggtctatcaattttgttcatcttttcaaaaaaccagctcctggattcattgatttttgaagtgttttttgtatctctatctccttcagttctgctctgatcttagttatttcttgccttctgccagcttttgaatgtgtttgctcttgcttctctagttcttttaattgtgatgttagggtgtcaattttggatctttcctgctttctcttgcgggcatttagtgctataaatttccctctacacactgctttaaatgtgtcccagagattccggtaggttgtgtctttgttctcattggtttcaaagaacatctttatttctgccgtcattttgctatgtacccagtagtcattcaggagcaggttgttcagtttccatgtagttgagcggttttgagtgagtttcttactcctgagttctagtttgattgcactgtggtctgagagacagtttgttataatttgtgttcttttacatttgctgaagagtgctttacttccaactacgtggtcaattttggaataagtgggatgtggtgctgaaaggaatatatattctgttgatttggggtggagagttctgtagatgtctattaggtccacttggtgcagagctcagttcaattactggatatccttgttaactatctgtcttattgatctgtctaatgttgacagtagggtgttaaagtctcccattattactgtgtgggagtctaagtctctttgtaggtctctaaggacttgctttatgaatctgggtactcctgtattgggtgcatatatattcaggttagctctccttgttgaattgatccctttaccattatgtaatggtcttctttgtctcttttgatctttgttggtttaaagtctgttttatcagggactaggattgcaacccctgcatttttctgttttctctttgcttggtagatcttcatccatccctttattttgagcctatgtgtttctctgcacgtgagatgggtctcctgaatacagcacactgatgtgtcttgactctatccaatgtgccagtctgtgtcttttaattggagcatttagctcatttacatttaaggttaatatccttatgtgtgaatttgatcctgtcattatgatgttagctggttattttgctcgttagttgatgcagtttcttcctagcatcgatgatctttacaatttggcatgtttttgcagtggctggtactggttgttcctttctatttttagtgcttccttcaggagctcttgtagggcaggcctggtggtgacaaaatctctcagcatttgatcatctgtaaaggattttacttctccttcacttatgaagcttagtttggctggatatgaaattctgggttgaaaattcttttctttaagaatgttgaatattggctcccactctctactggcttgtagagtttttgccaagagatccactgttagtctgatgggcttccctttgtgggaaacccgacctttctctctggctgcccttaatatttgttccttcatttcaactttggtgaacctgacaattatgtgtcttggagttgttcttctcaaggagtatcttgtatctcgaggagttctctgtaatttctgcatttgaatgttggcctgccttgctaggttgggcaagttctcctggataatatcctgaagagtgttttccaacttggttccattctccccgtcactttcaggtacatcaatcagacatagatttggtcttttcacatagtcccatatttcttggagtctttgttcatttctttttactcttttttctctaaacttctcttctcacttcatttcattcatttgatcttcagtcactgataccctgtcttccatttgatcgaatcagctactgaagcttgtgcattctgaagatttcttttcttgttactttgttgtctggcattggcattgtgactatactggccccacagtatatgctaagaattattccctctaattctatggtttagaatagtttgaggagtagtgccattcatcctttaagcatttggtaatatttttgagtggttacatctaatctcggcttttctttgttggaagtttttaagataccgactaaatgtctttatgcctttatgacagcagtttctgtcattctaggaatttgtctatttcatctatgttattcaatttgtcatacaactgttcacagtattttttatgacacattttattcttttatcattaatagtaaaatccccttttgccaagggtctcagtgtgcatgctggggcattgacttcaacactcagccagatggtctgcacctgtttcttagtcttcactttctgtttacctagatactcaaagtcagccagaagtcatatctttgggcctgttcaggtctctgtttagcatgcccacatttctatgcatgcatttgtctttttagtatcccccaaattggttgaaacatttccaagcccatatgcattattcactcctcatcttttcctcttaagtttgttggacaatctattgtttgcctaatatccattatctcaggctggagcaactaaaacaattgtatttaaatgtttttgagtcatgtccacagaaagtggtttttaatactgagtcctaaatcaggcaaaataatgactacattttcaagttgggtgttccagggacaactaaacatgttaaagagtgactattctttgggaatatggctttgaaagatgtataccactgacatgctctctttagtatcaataaggtgaactgttatattttccacgggttcagacaagctggaatatagggaatagtatcagtagaagttaaaatggataaagctccctattcttaatggtattcagccatttttctccattttattccctaggtttctatacacatttgattaatttacagagttcctacagtgttgattgtgagttttttttcccttgcttttttccctcagagttcttagtctaccattttactgacataaattgtattcaatttttaaaaatctttagctgcaggctgggtgcggtggctcattcctgtaatcccagcactttcggaggccgaggtgggcggataacctgaggttgtgagttcgagaccagcctgaccaacatagaaaaaccctgtctttactaaaaatacaaaattagccaggtgtggtggcacatgcctgtaatcccagtgactcaggatgctgaggcaggagaatcgcttgaacccaggaggcggaggttgtggtgagccaagattgtgccattgcactccagactgggcagtaaggacaaaactctgtctcaaaaaaaaaaaaaaaatctttagctgcataaatgactacacttctgctgtgttattgacttttcataaatgtttttgtggtaactgttttttaccttgcaccaaaaaaaataaaatggaaaagagtgatgcacctcagtgcactttcttcccagtgtgcaggccagtcagaggttctctggggacccctttatacttggctgtctcactccccctctaaggaagtacatctaactgccattagaataaagataagggtaaggatgaagaccaatcttaactgcttcctgctgacagggggcgctgttttggggaaaactgcagtcagagctcccttaaaggcctatgtaagggttcccagcaaaagggactattctctcaggttccagttgcatgaccgtttgtagttgatggcctaaagccaagaagagacaaaccgggttattacaaaacatgtattaaaatgaaacaaggggaggggtaaggacagcttaaaaatcccgaggccttttaccagttggcatagggagaggaagcctgaaagcctgattggtaaaacaaacaaacaaaccaacaaacaaacacctttacccttttgctggcatgttgggcttctgggttcccttcccttgagcccaatcttaagccaaccagtttaaggtttgggaaattaactctttccagtttggaggatgcatctgagggtagtgtcctatagtagggagacacagttacctatcagtgaagagaggacagaggaggagaatagaaaaaagaaggagcttttcaaaggagtcccagggatcaggatgtatttgaaatgggtacagactcaagatgaatggctacccatctagaaagaggggagcaggcattcccagttcccttctctttctagcagatacccagaatgcattagggagagaaggaagagcatcctctttcccttttccgtccttgcatccccaagttctgggaaccttggcaggtgccacccatgggtgccaaaatggcttgcaaccatgaagcagggagggcctagagaatagaaattatctgctctcatctatatctctatgacaactactgtcagtagctttgacgttccctagacctcatttatgccatggatactagcattacttttatccatgaaacaagaggcttggcttgattggcaggaattagcaatgctcgcctgtgctgcacattttaacctcccttatcatctgtctctggatcccttaggtccagttttcttcctaaggctttgacctgaagcttggaattgagtttgggagaaaaatctgtctcgggggtttgcgtggactcctataataagccaaatgctaaggtgaagctgtagaattgagtcctccttcaacaagggagacaaaaagatgtcttgtgacatgaccagattaactggtggctatagttatgcttggtaaatttgggtgcagggtgcttgtatttggttagctcccttggtcttgttttcccaaaaaggaaaactccaagtggtgggcatcctatttattcccattacctggcaggatttgcaggataattgctcagaacttcagtactgatccagatttttacattacccatccctcttgttatttctgaggtgcagccagagattgctgattggttcacaggaacaagtagggttagtttaaaatgtaggcaaaacttaaaaacaactagtgagtttagaatttaatgacaaatgtatggtaagttttgaaacataatttctttatatctagttctaaattttgctaaaaaactcaaatcatgatagggctaagtggtttgcaaaatagactttagtcttatatttggcctgattatttgcataaagtgcagcaagaataactatttctacataggccctttagattggctttgaagaaactctgttccacaaggagtctcagataagaccttttaaagccaagcccaaccacgtgtttgtatccttaaatacctgtgagttgggtaatcctcacctcttaagttcccaagataaacttggagctgctaggcctgttagaaagtgacatttgttactgaccacaggtcaggaagcctgtacagggactgtgtaggtaagggcatgaggccagtttctcccacagagcttttacccactctgcaagttgagattgactccttaaagggaagcatatgattccagtcaaagccttggtaaaataaccagtttcttcaattgtgccctgttgcaaaagaaaaatggattcttattgcactgatgcaaacaactctattaccataagtttagaatactcacagatagtttccaaattatagaagaatcagagaaaaacaaacatgctacaaattttgttcacaggagtataccttattcaattattaaaggtcatatataattcaaaatagtttccttgatgttgagaaacaaaacaaggatcagcaatattccaagcaaaagttaaaaatatttggttcagtttcctgagttcagtccacttagttaactcttattttgcttgatatttgtcaacatttcagctcttaatgagtgctctacattttcctttattccaatgtcacaatgtccaaagatatcagaaactagtatttgagagcacctgtcaatcttatcacttattataaaccatcttttgaaaaggattaaaacaagacaattgtctatgtataacaaaatgtccagggtaattacagttagaaacacaatagacaaagtagtttggttatctcagtggtttacaataacttaacaaccttaattacggttgatggcagatacttagacattagaattttagaaatcccatacaattttggaatatatattagtattattcaccaaaatataacagaaaggagattgaacaccattttggcattcccatatacctaaatatgttaaataatcctgtttacccctcttttctgaacactccagtggcccttctggagcctccaaaaagccaggtgtcaggaaagatagttttgaaactgaagtttgattctgggaagcctgttaaataagttagaggattaaaacactcgattttacaaaataaaatttcagattaccataaattatttattttgccaaaatgatgactcagaaattttaaataagtaaataaccttttgttttaatgctcaatttacataaaaaccatataatgccatttcgaatttatgcaatatgttcacacagaattttgcaagattaatttttacaatccttccaccacttgtttgaacttttagctttatcctttctaattcaaaataattcttcaaccctaggcagaaatttacattataagaagatatgccttcttatagtctttaactaaagaacacattttactgttcttacaaaccttgcatataaatctatttccagtaatcttaattacatgtcataatggcaagtcctagcaatttttacctttaatctaaaacctggtaagttgttttaattgtgtgctaggtgcagtcaaggtttgactccttccggcataattaagagcacagttagttccatatgcccccaggccttaacaattgtgaagctggcaagttaaatagttcttaaaacccaaagggaaatttataaccttaaaacatttaggaagcttagtacctaacctgcataatttagtccatctatttatatttggatggcgtctgctttttatttctcaaagattaaagtcacatgaactgaaaggtactacagcttttaccttccctttaagaaatatttgatgcaagtgcttgccttcctttaggcctaattagagctctttttatataaattacacacacaacacatatataactacacagacaggcaggagaaaatccaaccccccacaagatccttttacacaaccaaaactttacagagaatataaaaagtgatctttatcattcctagcctagcaaaacatcttccaaaaggaaaaaaaaaaaaacttatttaaaagttaaccgctggacaatgtggagaagaaaaaaggatgcctgggggaagagtctcctattcttatgcaactggttcctccacccggaagaaaagcttaactgttgtgggatggagttagactccctggctgggagatggggagacttcatagacatgtggcagggaatgccagcaagccacctggggtgctttgggccatgtgttccagccccagcaaggaggggagggtggtgaggagccactgcttcccagtctgtcctgaaaaagtaaggaaagagcaatggaaaggcccctgactcctgcgagcaacggggtgggggcagtttgccttaccctcagacgtctgaggatgaaaaggcttagaaatgagagggaaagagatttattggtttgcatctccccttctcaagccccacattgggcaccaaagctgttgtagagctttctctttagttcagctaaaagctgggttcttgtcacatgaccatgagagattaggctggaagacactttgaaaagtgagaaaaatgaaatttattgggcaaaaatggaaacaggaactttcagcagagtgagagtcctgctagtatatgcttcccactttgcagattgaatatccggttccccccaggaagaggaggggccaggttcctccctgctgcaaatggtgcaaacttcctgaggctccaacccagtgtgcattcctcccagtgcacagggtgatcagaggttctctggggacccttttatacttgcctgtctcactttaacataagaaaaatattataatttaaattctttgcatttcataagtttttagattgttttcctcagtgattcttatcttcaggttcaagaaattaaatatactttaaaattgtttgagtctttgttgcagacaagattgcatggactcctttcttgctgcttctctcccaaatgtatattgagaaacttttgcattaacatgaggaacaacaacaacaacaacaaacaaaataaaacaaaaacaagaaacaaaaaactctgagaagtgtaaagaggaaggtcaactggttagggacccatgtactgaaattgcaacataattgggtgttttataacctccaaccaaaagaagatgactcaagactagcattttctgacatctcaataagcaatagtaggttgcaatctgaggaggctcaactctccacccaataaagcaaattaccagctgacaacaatagtaatagcaataggactggcaaaaaaaagaaattcatcaaaaccaccactgataataagtagtcagtggaagtgttctctccaactgggactgaaactccctccctcactgatatgcaccaggtagacaggtggtatcagcaaagaggaccttgccacaacaagtgacctgggctgaaaagcctcttgtcacaggcgagagattcccttctcacatcaagagaaaattggcaacaaggctgatttggaaaagggaatactggccctataagtggcctagtgtaggaaatctcttcatccccccataccagagactcttttccttcacctagagatacctgacagcctgaactgtggaaactctttccacccccacacgtagtagcaaaccagtttataaaagtatgccagaatctgtatgatacacctaaacagaatcatatattggtaaaattaaagatctaaacatgaccatgtgtttcctatcataatatcccaaatatctataataaaattgaaaattacccatcacaccaaatagcagaaaaataacaacttgtatgacaaaaaacaatcaacacactccaagactgacagaaattggatgctagaattaattggcaaggactttaaatcagcctttaaaaaatgtttttaaaagcaattacaagctattttgagagaacaaaaaattaaaatacttcagaaaataaatagatgttaaaaagaaccaaatgtaaactatggaactgaaaaatacaataagagaaataaaaataaactttattggacagacaaaatagaagaggtagaatgataaaagatagaaacagtgatcttgaagaaagatcaacaaagtagatcaaatctttttttttttgagacagggtattactctattgcccagactgaagtgtaatggtgcaatctcagctcactgcaacctctgcctttcaggttgaagtgatcctcccacctttgccccccaagaagctgggactacaagcatgagccaccgtgtctggctattttttgtagaggcagaatttcacaatgttgcccaggctggtcttaaactcctgaggttaagtgatcccccacttcagacttccaaagtactagggttacaggcatgagccatcacacctggccacatatataaaatcttaaaaacagaggccaaggtgggtggatcacttgaggtcagcagtttgagaccagcctggccaacatggtgaaacccatttctactaaaaatacaaaaattagccaggcatggtggtgggcatctgtaatcccaactacttggctggctgaggcaggagaattgcttgaacctgggaggcagaggttgcagtgagccaaaatcacaccattgcacttcagctgggtgacaagagtgaaactccctctcaaaaacacaaaaacaaaacaaaagacacacacacacacacacacacacacacagacacacacaaccagaaacaaatataataaaaggagaaactcaaggacctttgggaaaataacaaagacacaacatttaaaccatcagtggcccaaaaagagaggaaaaaaattggggttgaaaaattactgaaagaaataatggctgaaaactccacaacttagagaagacacaaacttacagatacaagaaagtgagagaaccctacagaagcaaaagtaagctgaaggaaatcctcacaaaaacataacataattaaactcataaaaagtaaaggcaaaaaatatcttcaaaataattcaaaaaagtgacagaactaccaaatggtaaatctgtaaaaatgtagaaaatctgaataaagtgttttctctacactaattttaaaaaggttttctgtctccaagctgagtaagtccacatgaacattaagtaagaaaaagtataaaagaaaaaaatctaagcataaaagtgctatccatactttcaaaatccttggattctctacctttaaattttattcagattttgttccaaaacaatacaaatggtttgaatgttgactccataaacgtttacaacctctgaaaactgttttaaaagcctgaaagagcaatgacttaacccttacagaatagccatggattttgaacaaatagtcaatgtttactatgtaacagttgctttccccattacccttttcttggaagaaataaacagcttccttctggttttaccagaatgcatccattatctctttccacaatgaaactaacatagttacatagagattacagatgcacataagtcaacaactcatgcataatcttaaaaatgctaaatttcaacacaacaatgaagatagaaaatatcatctaaggttctgtcttatctctctagccaagtagagttactttgataaattttgaatttatttttgggcacgtttttacttattttccaggaaaacattcttaacatggacaaacttgagcactgcaatatgctttgatgttaatttttaaatcatcagtatactcttctaaaattgaaagtcttacaaataggcctctttatccttcagagagccatttcatcaatactgagcttttacaaatcagattagaggtagaggtaattagcaaaactaccattttgttcagtgccttacagatatgatgggattagtttcagatcattacaatgaagggaatatcaaaataaagtgagttacacaaggtttcccagtgcacataaacattatgtttacattataccatagtatattaagagtgcaatagaattatgtctaaaagacaatgtatacactgtaatttaaaaatgctttgttgctaatgattatctaagcctttagttgagtcccaatctttttgctggtggagagtcttatactgatgttgatggctgctgactaatcagcatggtggctattgaaaattagagtgtctgtgacgaggaaattaaagaaagaaaaataaaattaaaaagaaaaaagaaataagctttcctgtattaggctgacttatcccagaggcagcaacaggcacagcccagacccaagaagagcctagataaacactatctgagaagctaagacacaaaagaatgtgttctagagactcccagcactccctcaacataaggaagaaaaaaaaatttcctttcttttatagtatgagtttataaagattcctgatatctgtaactagtaacttcaagtattccattttatctaagaagtacaatgaaagtcatgagctgtccgagcaggcctgagctacagccacctgggcgccatagtgaaggttatgagataagccagtgcaaggcttgtttgagcaagcctagataacagccgtctaggcttcatagataacagccatctaggatgtatagcaacagtcatgtgtaatcctgagttatgcacctgtcacaatttaattaactgcctttgttctgcctctgtatccttgcttttgtgccagtacactttgagccactgtaagcttatttcaggccagcccaccccctttttgaagtgtgtataaaggttaagtgctgtctttgttctaaggcccagtcccaagatgttaaaccactagatctgagtgcactcaatacatcctcccactttaccccgaggtctctctagtcctcctgattcccacaacatctgtggcaatttttcaaaataagacaccaataaaatttgccacataaactgactcttcctttcatgaaatgtatctccatagacagtgatgttgtttgatagcattttacccacagcagaacttctttcaaaattagagtcaatcctctcaaaatctgcccctgctttatcaaacaagtttatgtaatattctaaatcatttgttgtaatctcagcaatgtctgcagaatcttcaccagaagtaaattctaaatcaagaaaccactttatgtgttcatccataagaaacaatttctcattcatcaaagttttatcatgagattgcagtaattcagtcacatcttcaggctccacttctaattatagttatcctgctattgctactacatcttcagttacttctcccactgaagtcttgaactcctcaaaatcatctatgagggttgaaatcagcaacttccgaactcctcttaatgttgatattttgatctcctcccttgaatcaagaatgtccttaatgggccgggtgtggtggctcatgtctgtaatcctagcagtttgggaggccgaggaaggtggatcacctgaggtcaggggttcatatgttcttctcgacatatgaaaaggctcaagcaaccacactataggagtggaagacttaaatagcccactggcagtgttagatagatcattgaggaagaaaacttacaaagaaatactggaattgtactcaatatgtgacctattgaacctaagagacattaacaaatactccaaccactaaatgcaaattacacatttttctcaactgcacacagaacatattctataatcagccacatgcttggccacagagcacatctcaataaattaaaaaaaaatgaattcataccaaacgctttcagactacagtgaaaaaaaatagaaatcaatatcaagatcccgcaaaactacaaaagtacatagaaattaaaaaaattctaaattaaggtaaaaattaaaaattatttgaaatgaatgaaaatggagacacaatacaccaaaattgttggaatgtagctaaagcagtgtgaagaggaaagtttacagtgctaaatacaaacatcaagaagttagaaaggtctcaaatgaacaatctaggatcacacctagaggaacttaaaaggaaaaaaaaaagaaatttaccccaaagctaacagaaagaagaaataactataatctgacaacaacggaatgaaatcaaggtgtaaaaagctatacaaaaaatcaataaaaacaatatttggttctttgaaagagtaagtaagattgatagactgatagctagattaacaaaaaataaataaataaaagatccgaataagcacaatcaggaatgacaaagatgacactctaatcccaaagaaatataaaagatccttagagactattatgaacacttaaatgcacacaaattaaaatatcttgaggaaatggataacaattcctcaaaacaaagaacctcccaagaatgaaccaggaagaaagtgaaaacctgaagagaccaataatgggtttcaaaattgaatgagaaaaacaatcaaacaaacaaacaaaacaatgagaacaacaacaaaaaaacaggtgccaaccaaaaaaggtctggaacagatggattcacagcagagttctagcagacatacaaagaactgttatcagttttactgaaactattccaaaaaattgaggaggaggaggaactcctccttagctctttctatgaatccagcatcatcctgatatcaaaatttcacagagacacaacaaaaaataaaaactttaagccaacattctcgatgaacatagatgcaaaaatcctcaataaaatgctaacaaaatgttaaccaaatctttcagcacatcaaaaattaattcactatgatcaagtaggctttagtcctgggatgcaatgttggttcaacatatgcaaatcaataaatgtgattcaccacataaactgaattaaaaacaaaaaccacatgatcatctcaatagacgtagaaaaagcattcaataaactccaacatcccttcatgataaaatcccttaataaataaagaaacatacctgaaaattataagagccatataggacaaacccacagccaatattatactaaatgggcaaaagctgaaatcatacgccttgaaaactggaacaagacaaaactggaacaagatgcttactcccaccattcctattcaacatagtactggaagtccttgacagagcaatcgaacaagagaaagaaataaaaggcatccaaataggaaaagaagttaaactctctctctctttgctgacaatatgattacatacctagaaaaccctaaagactctgccaaaaggctcctagagccacaaaatgacttcagtagagtttcaggatacaaaattaaagcataaaaatcagtaccgttactatgcactaatagtactctagctgagagccaattcaagaatgtcacttcaataccatttacaatagccgcaaagaaaatgaaatacctggggtgcgggggtgttccaagatggccgaagaggaacagctccagtctgcagctcccagtgtgatcgacacagaagatgggtgatttctgcatttccaattgaggtaccgggttcatctcattgggactggttggactgtgggtgcagcccacggagggtgagctgaagcagggaggggcattgcctaagctaggaagcacaagtggtcgggggatttccctttcctagccaaggggagccatgggagactacctggaaaaacgggacattccccacccaaaaactacacttttcccaaggtctcagcaaccagcagacacggtgatcctctcccatgcctcgcttggcaggtcacacacccacggagccttgctcactgctagcacagcagtctgagatcaatcttcaaggcggcagcctggctggcggaggggcgtctgccattgctgaggcttgagtaggtaaacaaagcagctgggaagctcaaactgggtggagcccaccgcagctcaacaagacctactgcctctagactcgacctctgtgggcagggcatagctgaacaaaaggcagcagacaacttctgcagacttaaacgtccctgtctaacagctctgaagagagcagtggttctcccagcacagcgtttgagctctgagaatggacagactgcctccttaagtgggtccctgaagcccatgtagcctaactgggagacacctcccagtaggggccaacagaaacctcatataggtggctgcctctctgggatgaagcttccagaggaaggatcaggcagcaatacttgctgttctgcattatttgctgttctacagcctccgctggtgatacccaggcaaatggggtctggagtggaactccagcaaactccaacagacctgcagctgagagacacgactgttagaaggaaaactaacaaacagaaaggtatagcatcaacatcaacaaaaagttcatctacaccaaaaccccatctgtaggtcaccaacatcaaagaccaaaggtagataaatcacaaagatagggggacaccagaggagaaaagctgaaaattctaaaaatcagagtgcctcttgtcccccaaaggattgcagcgcctcaccagcaacagaacaaagctggacggagaatgattttgacaagttgacagaaggaggcttcagaaggtcagtaataacaaacttctccaagctaaaggaggattttttttttttttttaagaaggagtcttgctctgtcgcccaggctggagtgcagtggcgcgatctcagctcactgcaagctccgcctcccgggatcatgccattctcctgcctcaacctcccaagtggctgggactacaggtgcccgccaccacacccagctaattttttgtatttttagtagagatggggtttcaccgtgttagccaggatggtcttgatctcctgacctcatgatctacccaccttggcctcccaaagtgctgggattacaggcgtgagccaccatgcccggccgttaaaggaggatgtttgaagccattgcaaggaagctaaaaacctagagaaaagattagacgaatggctaactagaaggtagagaagaccttaaatgacatgatggagctgaaaaccatagcatgagaacttcgtgacgcatgcacaagcttcaatagaagattttatcaagtgtaagaaagggtatcagtgattaaagatcaaattaataaaataaagtgagaagacaaggttagagaaaaaaaagtaaaaataaatgaagaaagccaccaagaaatatgggactatgtgaaaagaacaaatctatgtctgatcggtgtacctgaaagtgatgtggagaatagaaccaagttggaaaacactctgcaggatattatccaggaaaacttccccaacctagcaaggcaggcccaagttcaaattcaggaaatacagagaacaccacaaagatactcctagagaagagcaaccccaagacacataattgtcagatttactaaggttgaaatgaaggaaaaagtgttaaggacagccagagagaaaggtagagttacatacaaagggaagcccatcagactgacagcagatctctcagcagaaaccctacaagccagaagagagtgggggccaatatttgacattcttaaagaaaagaattttcaatgcagaatttcatgtccagtcaaactaagcttcataaccgaaggagaaataaaatccttcacagacgagcaaatgctgagagattttgtcaccaccaggcctgccttaaaagagctcttcaaggaagcactaaacatggaaagaaacaaccggtaccagccactgcaaaaacatgccaaattgtaaagaccattgatgcaatgaagaatctgcatcaattaatgggcaaaataaacagctaacatcataatgacaggatcaaattcacacataacagtattaaccttaaatataaataagctaaatgccccaattaaaacacacagactggcaaattggatagagtcaagacccatcagtgtactgtattcaggagacccatctcacatgcaaagacacacataggctcaaaataaagggatggaggaaaatccaccaagcaaacggaaaacaaaaaaatacaggggttgcaatcctagcctctgataaaacagactctaaaccaacacagatcaaaagagacaaagaaggccattacataatggtaaagggattaattcaacaagaagagctaactatcctaaatatatatgcacccaatacaggagcacccagattcataaaggaagtacttagagacctacaaagagacttagactcccacacaatcataatgggagactttaacaccccactgttaatattagacagatcaagaagacagaaggttaataaggatatccagggcctgtactcagtgctgcaacaagcagacctaatagatatctacagaacttgccaccccaaatcaacagaatatacattcttctcagcaccacatcgcacttactctaaaattgaccacataattggaagtaaaacactcctcagcaaatgtaaaagaaaagaaatcacaacaaactgtctctcagaccacagtgcaatcaaattagaactcaggattaagaaactcacttaaaactgcacaactacatggaaacctaacaacttgctcctgtgtgactactggataaataacgaaatgaaggcagaaataaagatgttctttgaaaccaatgagaacaaagacacaacataccagaatctctaggacacatttaaagcagtctgtagagggaaatttatagcactaaatgcccacaagagaaagcaggaaagatctaaaatcgacaccctaacatcacaattaaaagaactagagaagcaagggcaaatacattcaaaagctagcagaaggcaagaaataactaagatcagagcagaactgaaggagatagagacacaaaaaaacccttcaaaaaaatcaatgaatccatgagctggttttctgaaaagatcaacaaaattgatagactgctagcaagactaacagagaagaaaagagagaagaatcaaatagatgtaataaaaaatgataaaggggatattacaactgatcccacagaaatatgaactaccatcagagaatactataaacacctctatgtaaataaactagagaatctagaagaaatggataaattcctggacacacactttcccaagactaaaccaggaggaagttcaatctctgaatagaccaaaaacagcctctgaaattaaggcaataaataatagtctaccaaccaaaaaagtccaggaccacatggattcatagcagaattctaccagatgtacaaagaggagttggtaccattccttctaaaaaatcccaatcaatagaaaaagagggaatcctccctaactcattttatgaggccaacatcatcctgataacaaaacctggcagagacacaacagaaaagagatttttagaccaatatcccagatgaacatcaatgcgaaaatcctcaataaaatactggcaaactgaatccagcagcacatcaaaaagcttatccaccatgatcaagtcggcttcatccctgggatgcaaggctggttcaatatgcccaaatcaataaatgtaatccatcacgtaaacagaaccaatgacaaaaagcacatgattatctcaatagatgcagaaaaggcctttgacaaaattcaacagcccttcatgccaaaaactctcaataaactaggtattgatgggacatatatcaaaataataagatctatttatgacaaacccacagccaatatcataccgaatgggaaaaaaccagaagcattgcctttcaaaactggcacaagacaagaataccctctctcaccacttctattcaacagagtgttggaagctctggccagggcaatcaggcaggagaagaaataaagggtattcaattaggaaatgaggaagtcaaattgtccctgtttgcagatgacatgactgtatatttagaaaaccctatcgtcgcagccccaaatctccttaagctgataagcaaattcagcaaagtctcaggatacaaaattaatgtacaaaaatcacaagcattcccatacaccattaacagacagagagccaaaccatgagtgaactcccattcacaattgcttcaaagagaataaaatacctaggaatccaacttacaagggatgtgaaggacctcttcaaggagaactacaaaccactgctcaatgcaataaaagaggacacaaacaaatggaagaatattccatgctcatggataggaagaatcaatatcgtgaaaatggccatactgcccaaagtaatttgtagattcaatgtcatccccatcaagctaccaattactttctttacagaattggaaaaaactaatttaaatttcatatggatccaaaaaagagcctgcattgccaagacaatcctaaggaaaaagaacaaagctggagccatcacgctactggacttcaaagtatactacaaggctacagtaaccaaaacagcatggtactggtaccaaaacagagatatagaccactggaacagaacagagccctcagaaataatgccacacatctacaaccatctgatctttgacaaacctgataaacataagaaatggggagaggattacctatttaataaattgtgctgggaaaactggcgagccatatgtagaaagctaaaactggatcccttccttacaccttatacaaaaattaattcaagatggattaaagacttaaatgttagacctaaaaccataaaagccctagaagaaaacttaggcaataccattcaggacacaggcatgggcaaggacttcatgactaaaacaccaaaagcaatggcaacaaaagccaaaatagactaatggtatctaatgaaactaaagagcttctgcacaggaaaagaaactaccatcagaatgaacaggcaacctataaaatgggagaaaagtgttgcaatctacctatctgacaaagggctaatatccagaatctacaatgaactcaaacaaatttaaaagaaaaaaacaaacaaccacatcaaaaagtgggcaaaggatatgaacagacacttttcaaaagaagaaatttatgcagccaacacacacatgaaaaaatgctcatcatcactggtcatcagagaaatgcaaatcaaaaccacaatgagataccatctcttaccagttagaatggcaatcattaaaaagtcaggaaaccacagatgctggagaggatgtggagaaataggaatgcttttacactgttggtgggagtgtaaattggttcaaccattttggaagacagtgtggtgattcctcaaggatctagaactagaattaccatttgatccagtaatcctattactgggtgtatacccaaaggattataaatcatgctactataaagacacatgcacacctatgtttactgcggcactactcacaacagcaaagacttggaaccaacccaaacgtccatcaatgatagactggattaagaaaatgtggctcatatataccgtggaaaactatgtagccataagaaaggatgagttcgtgtcctttgcagggacatggatgaagctggaaaccatcattctcagcaaactatcacaaggacagaaaaccaaacaccgcatgttctcactcataggtcggaattgagcaatgagatcacttggacacagggcagggaacatcacagactggggcctgtcagggggtgtgtggctggaggagggatagcattaggagaaatgtaaatgatgagttgatgggtgcagcaaagcaacatggcacatgtatacctatggaacaacctgcacgttatgcacatgtaccctagaactgaaagcataataaaacaaaaaatatttatttctaaaaatccacacaaacaacaaaaaaagaaatacctaggaatacagctaaccaaggaggtgaaagattactacaaaaagaattacaaaacactgctgaaagaaattagagatgatataaataaacaaacacttcatgctcatgttcagaagacttaatattattaaaatggccatagcacctaaagcaattgacagattcaatgctatccctattaaactaccaacaacattttttcacagaattagaaaaaaagacttctaaaattcatatggaaccaaaaaaagcatctggataaccaaagcaactcaaagcaaaaaaaaaaaaaaaaaaaaaaaagctggagcagcactttttctgacttcaaactatactagaaggctacagtaatcaaaacagcattgtactggtacaaaaaacaaaaacaaagaaagacacatacaccaagggaagagaaaacggaactgagatgtaaaggtgcacacctaccaccacctaatcttcaacaaacttaagaaaaacaagcaataggaaaaagactacctattcaataaatggtgctgtgagaactggctatccatatgcagaagaatgaaactggaccattacctaccaccatatacaaaaattagcttgagaaggattaaggacctaaatgtaagacctcaacctatgaaaatcctggaagaaaacctagaaaatgcccttcttgatattggccttggcaacatatttatggctaagtcctcaaaataaattgcaacaaaaataaaaattgattaaataagacttaattaatctaaagagcttctgcatagcaaaagaaactatcaaggaagtaaacagacaacctatagaaggggagaaaatacaaactatgcagccaacaaaggtctaatatgcagaatctataaggaatttaaacaaatcaataagcaaaaaaccactccatttaaaattgggcaagggacatgaacggacatttctgaaaaaaaagacatacaagtggccaacaaacatatgaaaatatatcatcattaatcataagagaattgcaaatcaaaccataatgatatgccatctcaaaccagtcagaatttattttgtggaaaaataaaaacataatacgttggcaaggctgtggagaaagggggacacatacctttttggtgtgaatgtaaattaatttagccattgagtagagcactttggagatttctcaaacaaccaagatttgaaccaccattccactcagcaattgcattactgggtatatatccaaaggaaaataaatcattttacccaaaggatgcatgcacctgtatgttcgtcacagctctatccacaatagcagaaatatggaatcaacccaggtgctcatcaatggtggattgtataaggaaaacgtaatccatatacaccatgaaatactacacagtcataaaaaagaatgaaatcatttcctttgcagcaacatggatgcaactggaggccattatgctaagcaaactaatgcagaaacagaaaactaagtaccacatgttattacttataagtgagagctaaacactgggtacacatgaacataaagatgggaacaataaacactgagaactactagggtgtgagagaagggggagggggagggctgaacaactaccttttggatagtatgttctctaccttggtgacgggttcagtcgtatcccaaacctcagcatcacacaataaacctttgtaataaacctgcacatgttcccactggttctaaaataaaagttgaaaaaaatgataattatcctcctttttgtattaagattattttgatttcaaatgacaggaaacccaatcacaagtgagctaagtaaaaatacttttttttttttttttagacagagtcttgctctgtcgcgcaggctggagtgcagtggcctgatcttagctcactgcaacctctgtctcccaggttcaagcaattctcatgcctcagcctcccaagtagttgggactataggcacatgctaccatgtccagctaatttttgtatttttagtagagatggggttgcgccatgttggccaggctggtcttgaactcctgacctcaagtgattcacctgtctcagcctcccaaagtgctgggattgcaggcgtgagcccccttgcctggccaaaaagatcaaattttgtctccctaattgcaaagtcccagggaagacttgcctctgtcatggcttgatcaaagagataaagtgattacacttaaaccaaactgagaataagattagtagttacggtacaagtttgaaattttatgtcacatatatgaggtcttgggtctccaatgatttgccctttactcacatagagaacactggacattcttactgttccacggaatcttatctgcaggccgaagtcagttaattattatcttgtatggttcacatcttgtttactgcaaatacctcacaaatctatcttatcatgccctctttacaaattgggattggcagaaatgcggataaatatcctcattctgagtgaacacactatggctgtctagttgaacaaatgatccttgtagccagtttgaacaaggtgccatctctctgaggtatgctaacgttctgatataataatatttttggataagaaaaatttcaaatcaaactgacaaacttgctttttttttttcactcttgttgctcaggctggagtgcaatggtgcgatcttggctcactgtaacctccgcctacaaggttcaagttattttcctgcctcagcctcctgagtagctgggattacaggcatgtgccaccacgcctagctaatttttgtatttttagtagagacggggtttctccatgttggtcaggctggtctcaaactccctacttcaggtgattagcctgccttggcctcccaaagtgctgggattacaggcgcgagccactgtgcccagtccggaattgcttttttttttgagaataaaattttgaaagctggaaaaagaatttccaatatatgctacaacttgcagaggaaacagatatggttgtggtgcaagcagtagccatgggtccagacccctttatcatccttatcaaacttccccagtcactcagattcttttctgaattctatgatgagcactgcactcaagaggagcactgtgttaattagcaatggatcttaattgtaggaggagtcagaaagcaccttatttgtggctataagacagacagacagactgtccactaaatgatgaaagtggtgaggagaaaaatgaaatcagatatatagtttattactttataatgtatgatttagttacagtggcataacttcagctaacagcgtaaaaataaatgttgtcctccggtttgccctagattcaataattagaatacatttaacaattgtacctgtaatgtaaaacattgcattttttgcctttatacttggccaaactagagatatttcattttcagttgacactgacagaataaggttaataagttacataaataggacaaagatataaaattcgtagaggattatgaaacatcacagaaaattgaatattaatttgaaacgttatttgatatggtgttttgatgtcatcacagcagctacgtggcacttagaatctgtgcatctgggggagggagagcgcgctgattgtggaacttaccattggaactcagtgctgccctgtcccaacagaaagcaacaccaggcagaactcacattgtgtccacagagaaagcaattaaaccagctctagaaatcatcaatcccagcagtaggaacctaagttccagcaagcctctcaccatgggataaaatcctctggaaccctaaacaaactggaaaggcagtctaggaaataataattgcaattcttgggcaagtcctggttctgtgcttggctcagagccagtggacttgaggggaatatgacctagtgggacacctcttgggttgccaaggtagtgcttgttccaccccctccttaatcccaggaagcacaaatagcagctccaggagaaactccttccctctgcttgaggggagagggaagagtaaagaggactttgtcttgcaacttggataccagttcagccacagtaggacagggcagcaagcagagtcctgaggcacctgcctcaggccaaaggggagtccactgccttgaatggagaattccaggcctggcagcattcatcacaagctgaaggtagagcctttgggcctttttggtgccagctcagctgcagtagaaagagcactggctagattcctaagatttctgactgtagaacctggctccctgatggcatctctggacctgactggggctgcggggaacttgccaaactgaatggaaagacacaaacctggctggctctgccaacttctgattgcagaggcctaggaccttgtgtgaacaaggcagtggttacccgaggccttgagcgagaccaagtaccatgctggcttcaggtctgacccatcacacaagtaccatgctggcttcaggtgtgacccatcacagtcccagtggtgcggaccacagtagtgcttgtgtcacccctcatccagctccaggtggctaatcacagagggagaaagaaagagagaaagagagaaagagagagagagagagagagacagagagacagagagagagagagagagagagagagagactctatttatttgggagaaagtaagggaagagaacaagagtccatgcctggtaatccaaagaattcttctgaatcttatctaagactactgaggcaatacctcttcaagtctgtaagagccacagcttaactgggcttgtggggcctcctaatgtagatatggctgcagaaaacaaaagcttagataacaacacccaagtccctttgaatacctgaaaagccttcccaagatggatgggtacaaacaagcccagactgtaaagagtacaataaatacttaactctttaatgtccagacactgatgaacatccataagaccatccaggaaaacatgacctcaccaaatgaactaaacaaaggaccagaaactaatcctggagagacagagataggttacctttcagactgagatttcaaaatagctgttttgaagattctcaactaaatccaagataaaatagagaagaaattaagaatcctaatagataagtttaacagagattaaaataattaaaaagaattaagcagaattttgagatgaaaaaatgcaattgacatactgaagaatatgtcagagtctctcaccagcagaactgaccaaggagaaagaagaatttagtgagcttcaagataggctatttgaaaatatagtcaggggagacaaaaaaagaatgaagcacacctatgagatctagaaaatagcctcaaaaaagcacttctaagagttattggccttaaagaggtcattgagaaagagataggggtagaaagtttacacaaatagataataagagataacttccccaaactagagaaagatattaatatacaagtgcaaaaaggttataggacaccaagcagatttaatgcaaagaagactacatcaaggcatttaataatcaaactcccaaaaatcaaggataaaaaaaatgatattaaaagcagcaagataaaagaaacaagtaatatacaaaaacaagtaatatacaatgcagctccaatacgtctggcagtagacttttcagtggaaaccttataggccaagagagagtggcatgccatatgtaatgtgctgaagaaaaacaaaaaaacaaaaaacctttttatccaaaagtattttatccactgagaatatccatgaaacatgaaggagaaatactgtcccagccatagaaagtagaaggatttcattaacaccaagtttgtcctacaagaaatgctaaagagtttttcattctgaaagagaacaaaattaatgcgcaatcagaaatcatctcacagtgtaaaaattactggtaatagtaattactggtaatagtaagtgcacagaaaaatacagaatattataacactgtaattatggcatgtaaactacttacatcttagtagaaagactaaaaaatcaaaataataaaaacttttcaagagagatagtacaacaaaatataaatggaaacaacacaaagttaacaagtggaagaaaaaagttaaagggtagagtttttattaattttcttttttctggtttgcttgtttgttgaggcaatcagtgttgagttgtcatcagttttaagtaacaggttgtaagacactattaccatgaggtaacctcaaattaaaaaacatacggtatattaaaaaatagagcaagaaattaaaataaatcaccaaagaaaatcaccttcactaaagaaagacaggaaggaaggaaggaaagaaggtaaagaagaccacaaaacaaccaggaaacaaataacaaaatggtaagagtaagtccttacttgtcaaaaatcttaaatgtaaatgtgctcacctctccaatgagaatacatagagtggctaaatggataaataaacaagacccaatgatcccttgcctacaagaaacacactttacatataaaaaacacacagagactgaaaataaagggatgaaaaaatattccatggaaatggaaaccaaaaaagagcacaaattgccatacttaagaagaaaaaactataagagacaaagaaggtcactctacaatgagaaaagggtcaattaactcagtaagagaatataagaattataaatatacatgcacccaacacaggagcacctggttatataaagaaaatattattacgcctaaagagagatagactccaatacaatagctggagatttcaacagcttattttcagcattctgtcataaagacagaaaatcaaagaaacattggacttaatctgcactacagactaaatggacataatagatatttatagaacattggatttgtgggcacagaaaacacattcttcttctcagcagatgtaacattctcatggctagaacataggttgcaaaacaattcttaaagaattaaaaaaattgaaattatatgaaatatcttctctgatcaacatgaaataaaaccagaaatcaataccaagaggaattctggaaactataaaaacacatggaaattaaacaatatgttcctgagtgactggtgggtcaatgaataaattaagaagaaaaatgaacaatttcttaaaaccagtgataatgataacacaagatatcaaaacgtatgggatacagtgaaaacaatacaaagaagaaaatatatagctataagtgcctataccaaaaaagtagaaaaactgtaaataacctaatgaggtgtcttaaagaactaggaaagcaagaacaatgaaaactcaaaattaatagaagaaaaaaagaaataataaggaccagagcagaaatataattgaaatgaataaaagatcaatgaaatgaaaattggattctagaaaagataaacaaaattgacaaacctttacccagacccagaaaaagagagagaaggtccaaataaataaaatcagtgatgaaaaaaagacattagggggcggttccaagatggtcgaataggaacagctccagtctacagctcccagcgtgagcaacgcagaaggacgggtggtttcttcatttccaactgagttaccaggttcgtgtgactggggcgtgtcggacagtgggtgcagggcagtgggtgcagcccacttcgagagccgaagcagggtgaggcatcagctcacctgggaagtgcaaggggtcagggaattccctttcccagccaagggaagccttgacagacagcacctggaaaatctggtcactcccacccaaatactgcgctttcccaagggtcttagcaaacagcacaccaggagattataacccgcggctggctcggagggtcccacacccacagagcctcgctcattgctagcacagcagtctgagatcgaactgcaaggtggcagcgaggctgggggaggggcgcccaccattgccgaggcttgagtaggtaaacaaagcagccgggaagctcaaactgggtggagcccactgtagctcaaggaggcccaactgcctctgtagactccacctatggggcagggaatagctgctcgaaaggcagcagaaacttctgcagacttaaacgtccctgcctgacagctttgaagagagtagtggttctcccagccggagtttgagatctgagagcaaacagactgcctcctcaagtgggtccctgacccctgagtagcttaactgggaggcaccacccagtaggggcagactgacacctcacatggccgggtacacctctgagacgaagcttccagaggaacgatcaggcagcaacatttgctgttcggcaacattcactgttctgcaacattcgctgttctgcagcctctgctgctgataaccaggaaaacagggtctagagtggacctctagcaaactccaacagacctgcagctgagggtcctgactgttagaaggaaaactgaaaaacagaaaggacatccacaccaaaaccccaactgtacgttaccataatcaaagaccaaaggtagataaaaccacaaagatggggaaaaaacagagcagaaaagctgaaaattctaaaaatcagagtacctctccgcctccaaagaaatgcagctcctcgacagcaacggaacaaagctggagggagaatgactttgacaagtggagagaagaaggcttcagaagatcaaacttctctgagctaaaggaggaagttcaaacccatcacaaagaagctaaaaaccttgaaaaaaagattaaacgaatggctaactacaataaccagtgtagaaaagtccttaaatgacctgatggagctgaaaaccatggcacgagaactatgtgacaaatgcacaagcttcagtagccgattcgatcaactggaagaaagggtatcagtgattgaagatcaaatgaatgaaattaagcgagaagagaagtttagagaaaaaagagtaaaaagaaacgaacaaagcctccaaaaaatatgggactatgtgaaaagaccaaacctacgtctgactggtatacctgaaagtgacagggagaatggaaaaaagttggaaaacactgcaggatattatccaggagaacttccccaacctagcaaggcaggtcaacattcaaattcaggaaatacagagaacgccacaaagataatcctcgagaagagcaactccaagaacatacttgtcagattcacgaaagtcgaaatgaaggaacaaatgttaagggcagccagagacaaaggtcaggttacccacaaagggaagcccatcagactaacagctgatctcttggcagaaactctacaagccagaagagagtgggggacaatattcaacattcttacagaaaagaattttcaacccagaatttcatgtccagccaaactaagcttcataagtgaaggagaaataaaatcctttacagacaagcaaatgctgagagattttgtcaccaccaggcctgccctaaaagacctcctgaaggaagcacaaaacatggaaaggaacaaccagtaccagccactgcaaaatcatgccaaattgtaaagactatcgaggctaggaagaaactgcatcaactaacgagcaaaataaccagctaacatcataatgacaggatcaaattcacacataacaatattaactttaaatgtaagtgggctaaatgctccaattaaaagacacagactggcaaactggataaagagtcaagacccatcagtgtgctgtactcaggagacccatctcacgtgcagagacacacataggctcaaaataaagggatggagaaagatctatgaagcaaatggaaaacaaaaaaaggcaggggttgcaatcctagtctctgataaaacagactttaaaccaacaaagatcaaaagagacaaagaagaccattacataatggcaaagggatcaattcaacaagaagagctaactatcctaaatatatatacacccaatacaggagtacccagattcataaagcaagtccttagagacttacaaaaagacttagactcccacacaataataatggaagactttaacacccaaatttaaacaaaagacagaccaacgagacagaaatttaacaaggatatccaggaattgaatttagctctgcaccaagtggacctaacagacatctatagaactctccaccccaaatcaacagaatatacattcttctcagcaccacattgcgcctattccaaaattgaccacatagttggaagtaaagaactcctcagcaaatgtaaaagaacagaaattataacaaactgtctctcagaccacagtgcaatcaaactagaactcaggataaagaaactcactcaaaaccactcaactacatggaaactgaacaacctgctgctgagtgactactgggtacataacaaaatgatggcagaaataaagatgttctttgaaaccaatgagaacaaaaacacaacctacttgaatctctggcacatatttaaagcagtgtgtagagggaaatttacagcactgaacacccacaagagaaagcagaaaagatctaaaattgacatcctaacgtcacaattgaaagaactagagaagcaagagtaaacactttcaaaagctagcagaaggcaagaaataacaaagatcagagcagaactgatggagatacagacacaaaaaacctttcaaaaaaatcaatgaatccagggctggttttttgaaaagatcaacaaaattgacagaatgccagcaagattaataaagaagaaaagagagaagaaagaaatagacacaatgaaaaatgagaaaggggatatcaccaccgatcccacagaaatacaaactaccatcagagaatactataaacacctctacgcaaatcaactagaaaatctagaagaaatggataaattccaggacacatacaccctcccaggactaaaccaggaagaaggtgaatccctgaatagaccaataacaggctctgaaattgaggcaataattaatagcctaccaaccaaaaaatgtccaggaccagacggattcacagccaaattctaccagaggtacaaggaggagctggtactattccttctgaaactattccaatcaacgaaaaagagggaatcctccctaactcattttatgaggccaatatcatcctgataccatagcctggcagggacgcagccaaaaaagagaattttataccagtatccctgatgaacatcgatgtaaaaatcctcaataaaataccggcaaactgaatccagcagcacatcaaaaagcttatcctccatgatcaagtgggcttcatccctgggatgcaaggcaggttcaataggcggaaatcaataaatataatcaagcatataaacagaaccaaatacaaaaaccacatgattatctcaatagatgcagaaaaggcctttgacaaaaattcaacaacccttcatgctaaaaactctcaataaattaggtattgatgagacgtatctcaaaataataagagctatttctgacaaacccacaggcaatatcatactgaatgggcaaaaactggaagcattcctgttgaaaagtggcacaagacagggatgccctctctcaccactcctattcaacatagtgttggaagttctggccagggcaatcaggcaggagaaacacataaagggtattcaattaggaaaagagaaagtccaattgttcctgtttgcagatgacatgattgtatatctagaaaaccccattgtctcagcccaaaatcttaagctgataagcaacagcaaagtctcaggatacaaaatcaatgtgcaaaaatcacaagcattcttgtacaccaataacagggaaacaggaagccgaataatgagtgaactaacattcacaattgcttcaaagagaataaaatacctaggaatccaacttacaagggatgtgaaggacctcttcaaggagaactgcaaaccactgctcaaagcaataaaagaggacacaaacaaagggaagaacattccatgctcatggataggaagaatcaatattgtgaaaatggccatactgcccaaggtaatttatacattcaatgccatccccatcaagctcccaatggctttcttcacagaattggaaaaaactactttaaagttcataaggcaccaaaaaagagcccgcaatgcccaagaaaatcctaagctaaaagaagaaagctggaggcatcacgctacctgacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagaaatggggaaaggattccctgtttaataaacggtactgggaaaactggctcgccatatgtagaaagctgaaactggatcccttcattacaccttatactaaaattaattcaagatggattaaagacttaaatgttagacctaaaaccataaaagccctagaagaaaacctaggcaataccattcaggacataggcatgggcaaggacttcatgtctaagacaccagaagcagtggcaacaaaagacaaaattgacaaatgggatctaattaaactaaagagcttctgcacagcaaaagaaactaccatcagagtgaacaggcaacctacagaatgggagaaaatttttgcaatgtactcatctgacaaagggctaatatccagaatctacaaagaactcaaacaaatttacaagaaaaaaacaaataaacccatcaaaaagtgggtgaaggatatgaacagacacttctcaaaagaagacatttatgcagccaacagacacatgaaaaaatgctcatcatcactggccatcagagaattgcaaatcaaaaccacagtgagataccatctcagaccagtcagaatggcaatcattaaaaattcaggaaacaacacgtgctggagaggatgcggagatatacgaacacttttacactgttggtgggactgtaagctagttcaaccattgtggaagacagtgtggctattcctcaaggatctagaactagaaataccatttgacccagtcatcccattactgggtatatacccaaaggattataaatcatgctgctataaagacacatggacatgtatgtttattgtggcactattcacaatagcaaagacttggaaccaatcgaaatgtccatcaatgatagactggattaaaaaaatgtggcacatatacaccatggaatactatgcagccctaaaaaaggatgagttcatgtcgtttgtagggacatggatgaagctggaaaccatcattctcagcaaagtatcgcaaggacagaaaaccaaacaccgcatgttctcactcataggtggttattgaacaatgagaacacttggacacaggaaggggaacattgcacaccagggctgttgtggggtggggggaggggggagggatagcattaggagatatacctaatgtaaatgatgagttaatgggtgcagcacaccaacatggcacatgtatacatatgtaactatcctgcacgttgtgcacatgtaccatagaacttaaagtataatttaaaaaaaagaaaaaaagacattaaaattgatactgcagaaatcaaagaattattagatgtccctatgaacaactatacaccaataaattggaaaacccagaagaaatggatgaattccaaaatgcttataacctaccacgactgaaccatgaagaaatccaaaatgtaagctgatcactaagaagtaacaagatagaagccaaaataaatagtctctcagcaaagaaaagtccaggacctgatggcttcactgttcaattttaccaaacacttaaagagctaataccaatcctactcaaactgttctgaaacaatgaggagtgaatacttccaaactttctatgagaccagtagtaccctgctaccaaaaccagaaaaagacacatcaaagaaagaaaaccacatgctaatatatgataaacattattgcaaaaatcctcaacaaaatactagcatatcaaattcagcaacatattaaaaacattattcatcatgaccaggtgagatttatcccagggctggaaggatggatccacatatgctaatcaatcattgtgttacatcatatgaacagaatgaagggaaaaaaatgatcatttcaattgatgcagaaaaaacatttgacaaaattcaacatcccttcaagataaaaactctcaaaaaataagcatagaaggaacatacctcaagacaataaaagccataaatgacagactgatagctagtatcatactgcatggggaaaaactgaaagcctttcctctaaattctggaacatgagtatgccaaatttcaccactcttattcaacataatactgaaagtcctaactataagaatcagaaaaaagaaagagataaagggtgtccaagttgaaaagaaataagtcaaatcaccctcctttgcgaataatatgatcttgtatttggcaaaacctaaagactcagcagaaaattataggaactaataaacaaattcagtaaagttcaagaatacaacattaacatagaaaaatcagtaacatctccatatgcaaacagtgaacaatgtgaaaaagaaaccaagaaagtaacacaatgtaaaacagctacaaataaaatttaaaacattgaaataaacttaactgaagaagtcaaagatttctacaatgaaaactatgaaactttgatgaaagaagtgaagagtatacagaaaaggaaatatattcaatgtccatggattgacagtatcaatattgttaaaatgtctacactaccagaagccatctatagattcaatgtaatccctatcaaaataccaatgacattcttcacagaaatagaaaaaacaaccctaaaatgtatatggaaacaccaaaaactcagaatattaaaaactgttctgagcaaaaagaaccaaactgaaggaatcacgttacctgatttcaaattatactacagagccatataaccaaaacagcatggtaatgacataagaacagacacataaattaatggaacagaacacaggacctggaaacaaatccagacatctgcagtgaactcaatttcaacaaaggtgccaagaacacatgttatggaaagaacagtctgctcaataaatgtcactggcaaaactgtgcagaaggatgaaacttgattcctatctctcaccatatgcaaaaatcaaatgaatatgtattaaatacttaaatcgaagacctcatactatgaaactactaaaagaaaacattggagaaactatccagtacattggaataggcaaagatttcttgagtaataccctgtaagcacaggcacccaaaccaaaagcggacaaatgggatcatgttaaaattaaaaagcttctgcagagcaaaggaaacaaagagcaaagtgaagagacaatccaggttgggaaaaaaaaaagtttgcaatctctccacatgacaagggattaataattaaaatatctaaggtgctcaaacaactctattgggaaaaatctaataatctcattaaaaaatgggcaaaagatctgaatttttcaaaagaagacatacaaatggtaaggaggtatatgaaaagttcctcatcataaatgcttatcagagaaatgcaaatcaaaactacaatgagatattaccttaccccagttaaaatggcttatagccaaaagacaggtaataacaaatgctggtgaggatgtggagaacagggaaccctcgtacactgttggtgggaatataaattggtacagtactatggagaacaatttggagttttctcaaaatactaaaaacagagctaccatatgatccgtcaatcctgttataaggtatataccccaaagaatgggagtcagtatactgaaaaaatacctgcactctcatgcttattgtaccatttttcacaatagccaatatttgaaagcaatctacatgtccatcaacagatgaatatataaagaaaatgtggtaaatatacacaatggagcactattcagccataaaaagattgagattctgtcctttgcaataacttagatggaactggacatcattatgttaagtgaaataagccaggcagagaaagacaaaattcttatgttctcacttacttgtaggagctaaaaattaaaacaattgaactcatggagctagagactaaaacaatggttaccacaggccaaaaagaatagtgcagtggaaagttaatggttacaaaaataaagctagataaaatgagtaagatctagtattggatgtcacaacatggtaactacagtcttcaataatttcttatacattttaaaagaactaaaagattataactggattgtttgtaacacaaagaaaatataaatgcttaaatgattcatatcccatttaccctgatgtgattattaggaagtgtttgcttgtatcaaaatatctcatgttctgcagaaatatattcacctactaagtacacacaaacataaaaaaatttaaaaaataaaataaaaataacagtaaataaaaaatgggacaaggacctgaagagacatttctcaaatgaagaaatataaatggccaacttgcatatggaaaaaatgttctaaatcactagtccgcagagaagtgcaaattaaaaccacaatgacatatgacctcgcattttttagagtgccttttatcaaaaaggtaaaagaattgttgacaaggatgtggagaaaaaagaacccctgcacactgttggtggagatgtaaattagtacagccattatggaaatcagtatggaggttcctcaataaattaaaaataaaactacttcatgatccagaagtctcacttctgggtatatccaaaggaaatgaaatcagtatttcaaaaggatgtctgtactcccatgttcattgcagcattattcataatagccaagacatgtaatcaatctaagtatctattgatgaataaaggaagaatatattatatatattagaatgcattttatatttatatatatgtatacacacacacacacacacacagtggaatactcttcagtcttaaaaagagggaaattttgtcttttgcaataacatggatcaacctagataacattaggtaaagtgaaataaggcaggcacagaaagacaaatactgcattatcttatttgtatgtggaatccaaaagagttgaatgcatataggtagtgagtagaatgatggttacctgagacttggagtggttactaggactgggtgttgggggaattttttcaaaggatacaaaatttcaactagatagggagaataagtttaagagatctattatataaagtggttaatatagctttaatgttttgaaaattgttaaaacagtagattttcagtgttctcaccaaaaaaataagtaggatatatatatacattttatatatatatatatatatatatatatatatatatatatatatatgcatgcttaattgagccattccactatgtacacatatttcaagagttcatattgtatactataaatatattcaatttttatttgtcaatgaaaaaacaaaaacttcataaatttatgagctgctatggaggtaaaggtcttagaaaatttttaaaaaagagattgggtaaaattttcttgctctagctgcaagagcatggctttaggtgtaaagagctgggagaagtactctcaattagtgaagagaaaatgtgaggtaactaatgtttatttccatcttttactaaatactttaaacaaggatacacttccaattacataacagctaaacttgttatttacataataaatttttaaaaacgtaaaaatttacattattacataatagctaaatagataatagctaaattttttgtaccaaaatgtgttttataattcaccttttgaggaactttattcttatctatatccaggatacactgtgaggtatcctcaaaaataagtttttaaaaattattattattattattattattatttgagacagagtctcgctctgtggctcaggctggagtgccatggcgggatctcagctcactgcaacctccgcctcccaggttcaagcgattctcctgcctcagccttccaagtagctgagactacaggtgcccaccacctcgcctggctaatctttgtgtttttagtagagacggggtttctccatattggccaggctggtgtcaagctcctgactttgtgatccacctgcctcagcctcccaaagtgctgggattacaggcttgagccacggcgcctggcctaaaaattattttttaaaaaactgcagctaatttaacatccttactctttattctcattatattttcctctttctctatcacaaattattacatatattgacacaatgttaaatttttttcttctcctttcttaacttagtgcctttttgtaaagacaaattgaagttggagagagagtaggactcttcagattagataacagtattacagtattcacacaacttaggtttagataccttttattacacataaactgttatgcttgtatttttgattaattttaaaatgtggtaaaaagtaggaaaaatcactgataatctttacatattcaagatatttaagattgaaaatatttagaagaataaattttgttttcaaagagattaaataagcctaaaataatatattttacagaatttttgaggaattatatttatatttgtaaaagattttaatagtaagctatagttagataatatatttcgacagtaaagccactttcaaagaatatctcagagacgctggcgtaatttaaatagtaactaaaagggctatgtattacttttctatggctgctctaacaatttatcacaaactcagtgacttaaacaatgcacattttttctcctacagttttgaaggttagaagtctgaaatcagcttcactggggggaaatcaaaatgtaggcagaaccacactttccctagagggtttaggggataaaagactttgcctttgcagcttctagagctgcattccttgcattccttagctagagactccttcctttgtcttcaaagccagcaaaatagcatcttgcttcactggtaacacactgtcttctgtctcaaatctgcctctgccttcttcttataaggacacttataatttcattcagggcccacccagataattcggaataatctcaccaactcaagatcctttaattaatcacatctgcaaggtctcagttaccttataaggtaacatgcacggattccagggattaggacctggatatctttggagtcattatttgtcctaccacaagctaaaatcaatttctgaaattcatgtaaaatctgttgaaggcacagcacatctctgaatataaatggttattttaatagtcttctaaaattttcttttaaacaccaataattgcaatctgcttatttttcatgtagaaaaatatttttttctcctaaaatttgcatttgaatgatacctttttttttgagagagaggggcgagtcttactctgtcacctgagctggagatcagtggctccatcttggctccctgcaacttccgcctacatggttcaagtgattctcctgcctcagacccccacatagctgggattacaggcacgtgccaccacacccggctaatttttgtatttttagtagagatagggtttcactctgttggccaggctggtcttgaactcctgacttcaggtaattcaccagcctcagcctcccaaagtgctgggattacaggtgtgaaccaccacgcccagcctgaaaggtacttttacacatgttaaaatccacagctaattactctgtaaatatttaatattaaattgtgactaccaattttaaaaacaagatagaaaaagttgaaatcatgcatcacatacaagaaatgaatccttactctcacagcccttccacaactgatgtcagactcttacgttagtttcttttttcttccccttgataattttctctaatctcctttactatttaaattttctcaaaacccacttcactctaatgccattattcctgtagatgtttgtcctctgactacctctccattattacttcctttcctacttttttcataccttgctttatcctcatggaaaacatgtaaatcatttcaacaaacactgattgggccctaactttatgcaactgcctatcctagggacttcttaggcatagtaaggaataagaagtagcccttaaaaggctcatgctatctcagaaagggaataagacaggtggagtcaaagactagagcaagctctatataatgcaggcaaactctggaagatgtatgatcctattgggaggattatgcttaatttcaatgttcataatcaaataatttgtcaggagtgggaatggagagaaataaaacacagtaacaccaagcgtcactattctttgcatgaaccctgcccaccatctgctcatcaatatgcttctgcctacagaagaaaagttaacacttttgtagaagaatacgagctctttcaaattatcagactcagagaggcattaaagtaagacaataatcacatcctactccccccttttgagccatttattcaactattaaaactgcttggtagctatgaagtagctatgaattaacctaataatgtggcactggacactatatcccataccctatagcttaacaatgtatagccaatcactaatcaatgttatttttgtaaaccagtgagaattcctgacaaacaactttgtatcagccaactccctgtgcctcttctttgcctttagaaatctgctcgtaacaaaggcccaatggagctcctatcctaggttacttggctctgagttttcccagcagctgcccttactttgtctgaaataaagtctttcaatcatattttgtccttcactctccttcttttagggtgacatatctggtgctgtgagcagaattcagacacctctgaccatctgacattcctccttgactcagcatttggtcagctctgaacctcttgatttattttgactctttgagaaagtattgaatgtgaagtgttgaggcctactgaaatctggtccttcccactttttggttgaaggtctagactctgcttgaggtgtttttttccaaacctcactttccaaacctcaaaattgaggttttccatctttaccctaaaggtaaggtatttgggttacaagcaaaacaaaaacaaaactgactcttctgcctctggctcatgataggaggtctgggtcacagtcaggcaaacagctccccagagaacttcagccttttctacctctgtcccacggaagtaaggtctgggtcaaggtattggaaattaggcactggtggtttcattttaatagcatgctttttaatattgcagcagttgcttagaaatgcagacctaccttttcatttgtgacaaattcctgttagttcctaatggaaaaatgcagagggtgagttctcttgccccaaggaaaagaggagatttgcttcctctggcccatttgggtgctgcaggtgactgaagactacaccaaggtgtcagggtcattaaccatgacgcaacatgaagtagcctcatggggccctcccccccagaagaacatctttatgaactcccttttctgctcttccattaggatataatatgagggactggtcccctatatgttgagtaccctgctgccacccagcagttagaaacagactaggatacataagaaagctattcatgactcttgggtgacatctagaggagtgatgttcataagaagcatacttcaaacacaaaacatattcatgaccttggtaacttttgaaaagctcctaaattatgggaaatcaagcttcaaactctgaacactcttttaagcaacaactgccattagaaacacattttccatttcagctctaactgctccttcttctcctacccctgcatcttcatattctccttcatctgaactttcctgtcttgctttacttcttctagcatcagtacctgagggaactttccatgtctccgatcccctcccttaaacttccattctggcagcctttttcaaggtgtgattgtacagcacctcttcctgtacggaagaggtgggtctaataccccttgggcaaaaattgaatttaagagtgttatcaaaggcttccctgacctgttccaagattctatatggtttgcaaaagaatttgatctgactctttgaacttatgagcctggatattctgacctatatcaattaattcacatgttggtgtcagaaggcaaggccattgggtggttaaaaaaggcaaactgaaataatcctttagaggattttcaaaatcagactgaagcagaccatgaaggggtctgcattttgtccaagtctctccatgatgccattccccaggtctttcctttaaaaaaatgtatattggaagcgagttgagcaatgtactcaaaaggccagatgaatctgtagttatttggaatggcaatgagataagctttcaacaatattccaaagtggttgacactagcctccaagattaccagaacaattttctcataaactctactttcttcaattgcttaaatgaggacttggttaccttagttaaaagacaccagtttcttaactgggtgaatatacaaacccatgaattagtaagctttcagagcaaaatgattcagaaaaaagatagaattaatgcctcaaagattattaatttgcacctcaacaactggctagttaaaccaggccttttaagaaaagacaaatgcctctttctaatgataaaagaggtgtctgcttctatttcaaaaagtctggccatttcggaaaggattgtagaaaacttaaataatagcaggaacaacaaaagcacaggatgccataagatgaatagggttgctctgaggatcaaaatgggattttcccattaggagaagtggaaatgctcataaatggagaacagacatgcaccctcatagtcactttatgtcttcaaccctacaccccttaaattgtccccttcctcagagtaataaactatacaaacagcaggggtatctaatcaacctatgactgtatataagtccaaatccttagaatttcatgaaggctcattgagtaaccttcattcctttctgcatggtcccttggctcctatacacctctcaggcagagattttttggaactttgcaatacatacatttccttctctcagaaaggtgaaatgttaaattcagagtagaaggagctaatggaacaattacagaatgagaattaaactactgagattataaaactacggatctgacatattttttctaaaccaagaataggaaatggcactaatgatttattgcaagctttgctggaccacttatggtcccaatcttccattaacattaagatatattcaactactggctgggcgcagtggctcacgcctgtaatcccagcactttgggaggccgaggagggtggatcacgaggtcaggagatcgagaccatcctggctaacatggtgaaaccccgtctctactaaaaatacaaaaaattagccgggcgtggtggcaggtgcctgtagtcccagctactcgggaggctgaggcaggagaatggcgtgaacctgggaggcggagcttgcagtgaaccgagatcgtgccactgcactccagcctgggtgaaaaagtgagactccgtctcaaaaaaataaaaaaaaagatatattcaactacccccattaaagtgaaagtaaacctgcttaagatttacccaatattagacaatacccattagggtccgaagcaatggaaagaaccagacctataataaggtataattattccttgtatcagcccatataacattctgaccctttccataggaagctgaacgggaagggctggcattttctgtaagatttgagagctatcaacaacgctgtggtcccaagacatccgatggtacaaaacccccatattcgtttggcagcagtccctcctgaaagtaagaaatttactgtggctgatttgcgcagtttttttttttttaaagcattccagtagagccagagagtcaatatttatttgcctttacttatgacaactgccagtattcccagacctttatgccccaagattataatgagagccctaccaatttttctcaattattgaaatctgacttggctaatgtatatttctcagagggatctatacttgtccaatatgtggataatcttttcctttgttctccaaatatgcaaacttctaaggatgatagcataaatttcttaaaataattggcacctaagggacataaagtttctaaaaagcaactccaattttgccagacacaggtaaaatatttaggatattttatttctaagaaaggattgctcataaacccagacaggattaaaggcgtcctgctttactctaagccctcaacaaagaagcaactttgaggatttctgggattggctagatactgttaaaattaaatacatattttttctttaatagctcaccctttatataccctcctggaaatggatcaacctgatctttgtgtttggacttcagagagactaaaagccacataagtcatcaatgaacatcttataactagcacctgtcttaggtcatcctattgacagctttttctttcccctgttcattcatgaagacaaggcagatgccctgggaatactaactcagaaacatggggattataatgcacccggtggatattacagccggcaacttgatgcagttgctaggatgccaccttgcttaagagcaatctctgctactgctaccctctttagatatgggatcctctttcaccatgtacttaactcatacagtggaaacacttctgaacttctttcatgcccaacattactctgtttatataatagagttgtttcttatgcaggtcttcttctgccctcacctaaggttaccatttcctgttgttataatattaacccagccactcttttgctttttcctactgacaagacaccacactactctatcatcctgaccaaccaaattcttacacttcaacaggacctacaagaaacagttataaataaagctgatgtaatttggttcactgataattcttatttgaaagataaatctggaacttacagcgatgtttatgtcattgtgtctctaactgggattatagagaataatcctcttccagatgggggagaataatcctcttccagattattaaatcagctcagcaggcagaattgaagtagcccgtgattgtggaatgctgtggaagcaacgtggatatctgatctcatcaagtcaacccatcaaaaatggtcaacaagtctccgacctctttgaagcaatccctgaacccaaatcattggccatcatcaaaatctctggttattcgacattagaaactccagagagtaagcacaaccatttcactaacactttaggtaagcatgcagccctgaaggttatatcaggcatgtcttgaaatgaccttacaaacttactacgcatttacaattttacaagcacaaatgggagctcctaagaaggagatagagctctggaaaaataaagacggcaagttgtccccagaaatgggcttatgttatggacttgatgatagactgatctttcccttaaggcttcaattacatgtcttacagtatgttcttgagctcactcattgaaatctagacaaaatgatagcatgaggaaaaaaaatattaaaaactatatcctgctattgcacaaacaatgtgttctcactgtaccgtttgtcccaaacataatcctgcaaatccccttcatgggtcacaggggcattttccttcaactttggatcctttgagatattgtaattggactttatccagctgcctctatctcagggttaccagtgtgttctggtattaatttgcgtttctgtcattgggggttgaaacatttccatgctgacaagtcatggccaaagtaataggaaaagtgttattagaaaagttttttttttttttttttttccatagggagttcaatctgagctccatggcgactgaggaacacacttcactggtcaggtaattttatctatttgtaacatttggcctatattccatcatttctgttgtgcccatcacccccaatcctctgaactggtgaaatgaacaaatgatattaaaaagctcaatgcaaagctaacagaaatttttaactttctctagccagcacctctcccattagttctgctcaacctacaatccaccccactcataaaacgtcaagtctctttctttgaaataataacaagaaggcctatgtggctagataaaagagcttatgaacctgtacttcttaaaggtgatatcctccattattgccaaggtctcacaaaacttcctaccataaattccaaattaataaaggattcctttcgcaatgagctccagggagataaaggtaacagagaccatggcctacaacctggagattttgttaactgaaaacaacatcaaataaaagattccctgcaaccccactggaagggatcatatcaggtattgaccaatccttgtgctgccaaagttaagggtgttgactcaaggattcatgtttctcattttataaaagcggctctaccagagtggacattttctatcaccagacatgctcaattaaagctgacctgcaatcttcctgatcagcaccgcaagtaactgacatttgctgtagtctgcttctgcttaagatactggttcaggcctgtataaccagttcctcatgattccaatgattactgtgcctgaaattttcatctcctttttctgttgaccggaatattatgtttttaggctgccttcatattgtaggaatcctctcttggtggttttggtaaaataatcatatatatatatatatatatatgtatatatatatatacacatacacacacatatatacacacacacatatatacacatttatatacacacacacacacacacacacatatatattaagatatagcatactagtcttattgttaatatatgtactttagcaacatgcccatgatcaagcttcagtttttactgtccctaattaattgaattacagcatggagaaatagttctctggttcatatctcataaactgctattacatttggaaatctaacaagatgctgggtttgccaccctaaaccaccaacaactttcgacgacagtgacccattgctacattctgtcctaaatgccaccagtatttctaattgtactcataacccaattcaggggtcacataaaacaaaaccaaataggtctgtctgattcattctaacctgccatgtttcaatttaacccatcagaatctcacagtcaaaacaactgctgcctcactctgaaatgacagtggtaaaaaccatgatgctgctagaatgttaaaagaaaaacaatcgctcctgctatcaggatccagtcttttctcttgatctaacatttctgacccatggtttaaaaatgtcccaaaactgatatattgaaattatagtacactcacctctactccactaggatttacttttgtctgtgaaggagatcacagacatttacttttgtctgtgaaggaaatcacagacatttacttttgtctgtgaaggagattttatatccatggatataaaaatatctaagggcatagaatgaggaatagtagtgtcttttaaaatacttggttttatatatatatatgtatgtatatatatatatatgtgtatatatatatgtatgtatatatatatgtgtatatatatatgtatgtgtatatatatatgtatgtgtgtgtgtgtatatatatatatatatatatatatatatggctcagaagaaatccaatattggactagttccttcaaacttttctctgagcatgactaatgatctatttgagataaagattctatttgaggggaacctgttaattatctgacggaccatcaagaagatagttccatgcatgcttttggaagagtgtttttgccttggcgggttgttgcttcccattaacacatgattagaagtctttctataaccttaggaaagattgctaatgaaactgctacttcttcagcaaatcaaaaaaacctactaattcactagctaaggctgtactagaaaatcacattgctttatatattagctgaacagggatgtatatgtgtggtggcaaatattctttgttgtgtatacataaacacttcctatgaagtagaaactcatctatggaaaattagaaaagaagccacttaactatagcaaatctctaaagaagaaccagcatttaattttcttcctgatgttttagtttgctccatgaggaaatagtttccctttttctatttggcatataaattttcttgctgattataattcttatgtacattacatttttattatccaaattattaatgttatgtatttgtcatttcttttcattttctgagaaaactacattcatggttctccaaagaatagagattattcagcaagtgacaccagctgtatagatcagtgacttgacaggtctcattttttgccactctgtgataccatcccaatttggcttttgggtgcttttcaaaattccttgctgagatgtctcctttccttccctctacctagcatggaatgagattaccagggaatgtgctttcccaatgatgagggacatcttcacgctgggactttgaaagaactatccaggaatgagcttttccagcaatgagggacatcttgacacacagattttgatcatcaatgttttcaagaagaaacactttttatcaaaaaagagaaatgagtaaagaaaagaacttctatctgaggaatgtgagccctttcaaattatcaggcccagaaaggcattcaaatgaaataacaatcacatcctacttccccccatttggagctatgtatttatctataaaaactgcaaactcttgccacaggtagctacaaattaatctaataatgctacactggacacaatatccaacaccctataccataaaaatatatagccaatcaataatcaacgtaatttctgtaaaccagtgaaaattcctgacgaacaactttgtgatagcccactgcctgccattttttgccttcaaaaacctgcttgtaacacaggccaaatggagctcatatccaaggttacttgggtctgagtcttccaggcagctttccttactttggctcaggttaactctttcaatcatattttgtgctttagcctcttcttttgggattgacaccaggcagatgtatctgagacacagaaacaacgtctcatagaatctcatatctctgaaggtttgttacattttttacttatttcagtaaaattttcagaaagtttttggaggaaataattgaggagtttcactggaaaacaatgctttccccagagagcataaaataacatccagcaacatctggcagttttggctatatctcaatgagctttgctttggcatggcctcaaggaaaaacaaataaaaagcattgctgagacaactgcttaaggtcggagcattccaaatggcagaggaagccatgatctggccgctgtggaatgaagtatgatgggaagagagtgatgtgtgtgagctcaaggtgaactgtcagtataatggcatagatacactatcaaagtgtgccaaagatccattccaataaaaacattcactattgcctcaatacacctcaatgcaaacatccatgcctctttgtatcagtagcagaggcagaatttcctttctatttttcccacttttgtttaagacacagtaattccatgtctttaggcctgaatttgattccttcctcttcttcaactctcatatccaataaagtatattggaaatctctgatttaaaatactttgacttgtgctccctctcttgtggccaaaattccacttagattgcctaataactgtgctgatgttaaaaatgaagcccagataacttcttactctatcagttgcaatcactgacaagcctgtctgcagctaactactatagaaatgggagagagcaagagatcagggaagaagacattgtcttggaaactgcctctctccaaatatgtgtatatgtataaaattgcaaataacaattcaagcagaaatccctaattttgaattcagtccaaagattcttgaacaatgaattgctccaaggcattgtcattcccaatttcactggattcatatttaagtatcctcagttgatatacataatatttatctgaaagaaacataagcagcttttttacactaattgattttatgtatttaataatcatctgtaaatgaatatagatgttttatttaattttcatttctttttattatcaattttgatatttcattgtattaaatgggtttctaggaattttatgtcaaaatattacttcgtccttcgggaaataagcatctgagttaaggactgacttgaaatcattgtcaaagaaataactgaggcttaaattaggagacgtctctagtgtaaagaacctggaatgagccaggagatctggattccagttccttttgagaagctaaaacactgtgtgatcctggccatgtctcttaacagttttgggcctcaatttttctaagcataaaatgagcatttcgatagtattatttttaaagttcaggtggagtttttctcttttctacattcctcagtacttatttataacatgcattagcattcaagttattgctgtctctaagtgcttaaacttcctaactagaatataaattccctgaggcagaagatctgtacttccagaacaccttcagtgtttagcagtattggacatatagtatgtatggcatacaatcacccaagataagtgaaatttaactgggttggcttaactacacagctactgcttctctacttttgtcctcagttttgcactgtaaaaaaaaaaaaaaaaaaaaaaaacctttttgtgttttagttcaggctattatgatcaaactccaaatgtattcatgtatacccaatccacaaagctaatttaccaactggaatctcagtttattcttttaacatgaccattgtaagttccaagggaacattttctgcaaattacagcatacaacgggatgcttcctaaaaacagttggcacagcagaatacctgaatatcagagaacagcactaagcaataggggctgctagagcagcaggaaagaacttaagaaaaattattttgctgagagaaggtagttatcagagaacatataaaaattatttttcctctatggaaatcaaagaaatgtaagatgaaaaaagaatagtatatcctgttttagctggttgtgctaagtatagatgaagacatacacagcagaatttagtagaacttagactctctgacagttgagaacaacagtgaatttgacaatgttttctagaccaagtatatatttttgtactgatgaagaaattttctaaatcatattatgcaataatttaaaaacaactgccctgattatttgcaaacatggtcatattcaccttggcacatgcccatttgaggaatattccctaatttaaaaagagaaaaaaaccaaacaaatgtaatttgaattgactataaaaatatctagagagaaacagcagctacattaatattaattctaaatttaaaacaaactaaacattcaatccagatttcattagtggtgagtggcttttaatctgagtattacttttgggtatctatatcataaatgtcttcaggaacatttaatcaatgcctcaattccaaaaagataaagcttctttctattttttttatgaaaaaaatgcattacaatacagtttattatattagcagttaatagaaaatctggtatagttgccaatagcttgaaagactttaaagataaaactaaggggacaaggagccttttaaaaacagtatcaaccattctggacagtcaagaaaaaaaggtagtattttttatgtatacaagacaaaggtaagaaaagaaccttttcaaaacagcaggaccttacctgggagcaaaggaaagcatataatattagataggaacttttgctcatgctaacacttttcagtcggtatctgtgggggcacagaagctttcttcttccatttgcctttctctacagtctctttccaaaacaactcattttctagcaaatttcagctgaattttcttccatacctgaaataattaaagacactgatattgtaacttaatatgtggtaactaaagacatggatattgacattggcaaatcctgcaatgattctgctctacgttgatttaagcaataaatcgtggctcccataatgaccttcattactccatcatgttattccataagatccatgtaactcagaatgatggaatgaagagaagaaaggataggaaaaaatacaatgaaatactaggtacttttgctttgttcgccattagccttagtgctgccactaggctttaattaagagtaataagggaaacgttcttaagtctgcattactctcacttagtaggagtgcttacagtaataacctaaaaagtttactctgtaaaagatgttatgctactacattggtctcttctcaacaatattttctttctgcctcatgaatactaccaaggatgtatggtcaaatttcaccttgtttaatgggaatcttcctcatatcatctgattcctttataaatcctctttaaggtgcatatgcttccattacatatcaggaaacagctgccaattctagctcaaaggaatccatttagagttatgtgaaaacaaaatgtatgaagattaagtttcctctgtattaaatcttgagtgaacaaaagcaaatatactctattttgctaacactcgctatccctaagttccagactcccaaagaagagatagagaattttagaaggaaacacaccatcacacacttttaatcctaaatgttggcacagtaggtggaaaacaaggagaatgtgtatccagaacctccagcccctgggtcatctgtttccctgcatgagagggcaagggcccccctagctggagtacagcagccacacaccactgcaatcaggacacaaggctctgttaaagtgactgccccattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgaccagcattttttcatgtgttttttggctgcataaatgtcttcttttgagaagtgtctgttcatgtccttcgcccactttttgatggggttgtttgtttttttcttgtcaatttgtttgagttcattgtagattctggatattagccctttgtcagatgagtaggttgagaaaattttctcccactttgtaggttgcctgttcactctgtcggtagtttctggaatactatgcagccataaaaaatgatgagttcatgtcctttgtagggacatggatgaaattcaaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataataataatattaataacaaaaaaataaaaaataaaaaaaaaataaagtgactgccccaattttaactgaagcacagtggcagcttacatttcatcatttaggaagagatgtagaccaagggaagcagggagccaacaacttttacatattttcggtgctcatgttaacagtaaattcaagtactttaaaacatccctatgtctacagctcccagcatgagcaacgcagaagatgggtgatttctgcatttccatctgaggtaccgggttcatctcactagggagtgccagacagtgggtgcaggacagcgggtgcagcacaccatgcgcgagcagaggcagggtgaggcattgcctccactcgggaagtgcaaggggtcagggagttccctttcctactcaaagaaaggggtgacagagggcacctggaaaatcgggtcacccccaccctaatacagtgcttttccgacgggcttaaaaaacggcgcaccaggagattctatcctgcacctggctcggagggtcctatgcccacggagtctcgctgattgctagcacagcagtctgagatcaaactgcaaggcggcagtgaggctgggggaggggcgcccgccattgcccaggcttgcttaggtaaacaaagcaggcaggaagctgcaactgggtggagcccaccacagctcaaggaggcctgcctgcctctgtaggctccacctctgggggcagggcacagacaaacaaaaagacagcagtaacctctgcagacttaaatgtccctgtctgacagctttgaagacagcagtggttctcccagcaagcagctggagatctgagaatgggcagactgcctcctcaagtgggaccctgacccctgacccctgagcagcctaactgggaggcaccccccagtaggggcagactgacacctcacgcggccgggtactcctctgagacaaaacatccagaggaacgatcagacagcagcattagcagttcacgaaaatccgctgttctgcagccactgctgctggtacccaggcaaacagggtctggagtggacctctagcaaactccaacagacctgcagctgagggtcctgtctgttagaaggaaaactaacaaagagaaaggacatccacaccaaaaacccatctgtacaccaccatcatcaaagaccaaaagtagataaaaccacacagatgggaaaaaacagagcagaaaaactggaaactctaaaaatcagagtacctctcctcctccaaaggaacgcagctcctcaccagtaacggaacaaagctggacggagaatgactttgacgagttgagagaagaaggcttcagacgatcaaactactctgagctacaggaggaaattcaaaccaaacgcaaataagctgaaaactttgaaaaaaatttagacaaaagtataacaagaataaccaatacagagaagtgcttaaaggagctgatggagctgaaagccaaggctcgagaactacctgaagaatgcagaagcctcaggagccaatgcaatcaactggaagaaagggtatcagtgatggaagatcaaatgaatgaaatgaagcaagaagggaagtttagacaaaaaagaataaaaagaaaagaacagagcctctaagaaatatgggactatgtgaaaagaccaaatctacgtctgattggtgtacctgaaagtgacggagagaatggaatcaagctggaaaacactctgcaggatagtatccaggagaacttcctcaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagacaaaggtcgggttacccacaaagggaagcccatcagactaacagaggatctctcagcagaaactctacaagccagaagagagtgggggccaatattcaacattcttaaagaaaagaattttaaacccagaattgcatatccagccaaactaagcttcataagtgaaggagaaataaaatcctttacagacaagcaaatgctgagagatttttgtcaccaccaggcctgccctaaaagacctcctgaaggaagcactaaacatagaaaggaacgactggtaccagccactgcaaaatcatgccaaattgtaaagaccatcgaggctaggaagaaacttcatcaactaacgagcaaaataaccagctaacatcataatgacaggatcaaattcacacataacaatattaactttaaatgtaaatggaataaatgctccaactaaaagacacagactggcaaattggataaagagtcaagacccatcagtgtgctgtattcaggaaacccatctcacctgcagagacacacataggctcaaaataaaaggatggaggaagatctaccaagcaaatggaaaacaaaaaaaggcagggattgcaatcctagtctctgatgaaacagactttaaaccaacaaagatcaaaagagacaaacaaggccattacataatggtaaagggatcaattcaacaagaagagctaactatcctaaatatatatgcacccaatacaggagcacccagattcataaagcaagtccttagtgacctacaaagagacttagactcccacacattaataatgggagactttaacaccccactgtcaacattagacagatcaatgaggcagaaagttaacaaggatacccaggaattgaactcagctctgcaccaagtggacctaatagacatctacagaactctccattgcaaatcaacagaatatacatttttttcagcaccacaccacacctattccaaaattgaccacataggtggaagtaaatctctcctcagcaaatgtaaaagaacagaaattataacaaactgtctctcagaccacagtgaaatcaaactagaactcaggattaagaaactcactcaaaaccactcaactacatggaaactgaacaacctgctcctgaatgactactgggtacataacgaaatgacggcagaaataaagatgttccttgaaaccaacaagaacaaagacacaacataccagaatctctgggacacgttcaaagcagtgtgtagagggaaatttatagcactaaatgcccacaagagaaagcaggaaagatccaaaattgacaccctaacatcacaattaaaagaactagaaaagcaagagcaaacacattcaaaacctagcagaaggcaagaaataagtaaaatcagagcagaactgaaggaaatagagacacaaaaaactcttcaaaaaattaatgaatccaggagctggttttttgaaagcatcaacaaaattgatagaccgctagcaagactaataaagaagaaaagagagaagaatcaaatagacacaataaaaaatgataaaggggatatcaccactgatcccacagaaatacaaactaccatcagagaatactacaaacacctctacacaaataaactagaaaatctagaagaaatgaataaattcctcgacacatacaccctcccaagactaaaccaggaagaagttgaatctctgaatagaacaataacaggctctgaaattgtggcaataatcaatagcttaccaaccaaaaagagtccaggaccagatggattcacagccgaattctaccagaggtacaaggaggaactggtaccattccttctgaaactattctaatcaatagaaaaagagggaatcctccctaactcattttatgaggccagcatcatcctgataacaaagccgggcagagacacaaccaaaaaagagaattttagaccaatatccttgatgaacattgatgcaaaaatcctcaataaaatactggcaaaccgaatccagcagcatatcaaaaagcttatccaccatgatcaagtgggcttcatccctgggatgcaaggctgtttcaatatacgcaaatcaataaacgtaatccagcatataaacagaaccaaagacaaaaaccacatgattatctcaatagatgaagaaaaggccttagacaaaattcaacagcccttcatgctaaaaactctcaataaattaggtattgatgggacgtatctcaaaataataagagctatctatgacaaacccacagccaatatcatactcaatgggcaaaaactggaagcattccctttgaaaacaggcacaagacaggaatgccctctctcaccactcttattcaacatagtgttggaagttctggccagggcaatcaggcaggggaaggaaataaagggtattcaattaggaaaagaggaagtcaaattgtccctgtttgcagatgacatgattgcatatctaggaaaaccccatcgtctcagtccaaaatctccttaagctgataagcaacttcagcaaagtctcaggatacaaaatcaatgtacaaaaatcacaagcattcttatacaccaacaacagacaaacagagagccaaatcatgagtgacctcccagtcacaattgcttcaaagagaataaaatacctaggaatccaacttacaagggacgtgaaggacctcttcaaggagaactacaaatcactgctcaatgaaataaaagaggacacaaagaaatggaacaacattccctgctcatgggtaggaagaatcaacatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggacgcatcacgctacctgacttcaaactatactatgaggctacagtaaccaaaacagcatggtactggtaccaaaacagagatatagaccaatggaacagaacagagacctcagaaataacgccgcatatctacaactatctgatctttgacaaacctgacaaaaacaagcaatggggaaaggattccctatttaataaatggtgctgggaaaactggctagccatatgtagaaagctgaaactggatcccttcattacaccttatactaaaattaattcaagatggattaaagatttaaatgttagaactaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaataaactaccatcagagtgaacaggaaacctacagaatgggagaaaatttttgcagtctactcatctgacaaagggctagtatacagaatctacaatgaactccaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaactgcactgagataccatctcacaccagttagaatggtgatcattaaaaactcaggaaaccacaggtgttggagcggatgtggagaaataggaacatttttacactgttggtgggactgtaaactagttccaccattgtggaagtcagtgtggcgattcctcagggatctagaactagaaataccatttgacccagccatcccattactgggtatatacccaaaagattataaatcatcctgctataacgacacatgcacacgtatgtttattgcggcactattcccgatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccgcatgttctcactcatagatgggaattgaacaatgagaacacatggacacaggaaggggaacatcatacactggggcctgttgtggggtgtggggagtggggagggatagcattaggagatatacctaatgttaattgacaagttaatgggtgcagcacaccaacatggcacatgtatatatatgtaacaaacccgcacgttgtgcacatgtaccctaaaacttaaagtatattaaaaaaaaaaaaccataactaccgttaaaataaaaaaaaaaagagaaagtcacttagcttctctggttacattttttcacatccgcaaaattagtagagtaaaattagatagtaattttatgggacttcgtagttttaataatctgtgacgctcagaccagtttttcctagaccaaatcacaagaatgctcataaaagcctttcgttgcctggagttttgttggtaggccaggctataatttaaaagtttaatctgcttaataatttaagcaattaaagtgcatgaacatgtagtgcttggggcaggaacacctgcactctctgacactcacaactctgtgaccatagctgagaaacggaaattaaatgacaaagaaaacctctgtgaaaccaaatagctccagcgttaagacccacagaatgtactcaaaagagagctcttagactagtcataaaaactggagttaatcatgcttaacgagttctactaattaggtaactgctgcctgaaacacagagcagtgttaagaagaaattttgagatcttaagtggactctatgagaatagaaactatgataaattgtcattgtttgccatggacaagagcagacctatggtagcaaatgtgctctatatctttacatggaacttagtcttaattcacaaataattctagcaagtttaatgatttaatctgttagcatgtagcagaatagaaaccataatttagaaagttgggagaggggttgctaaagtgggctcactaaaagctgtgaaaggctgcagcacaaagcaaggatacaaacatgataatttgttttttcctttaagttgtaggatacatgtgcagaatgtgcaggtttgttacataggttatgtgtgtcatggtggtttgctgcacttatcaacctgtcatctaggctttaagccctgcatgcattagctatttgtcctaatggtctccctctcctgagccaccaccctccttacaggccccagtgtgtgttgttcccctccttgtgtccatgtgttctcattgttcaacttccacttatgagtgaaaacatgaggtgtttgtttttttgttcctgtgttagtttgctgagggtgatggcttccagcttcatccatgttcctgcaaaggacatgatctcattcctttttatggctgcatagtattcaatggtgtatatgtaccacaatttctttatctagtctatcattgatgagcatttggattggttccatgtctttgctattgtaaatagtgctgcaataaacatacatgtgcaaaacatagtaattattatagtc

SEQ ID NO: 831 - DNA, 4750 bp, Homo sapiens
acccaaacaagattgttaaagaagtcttcataggcattatggcatcttgttcttcctaaccttaactgatgagggttaggaggagaaggctcagaataaggataacagttcataatttcttcatctctgctctaactgttcccttagttggtgaataacaaccagctccatcctaaaaacaacagaacataagcagcagcaaggaatcatccttgagcaggaatgcagtcctgttacctgaacagagacagaacacaatctagtattaactgctgcaaggtaggcacttaaactcactatggcaggtcctagtgcttagtagaaatgacctcgttttttcccctatgttttaggaaatactaaaaaccaaaagaaaagctaaaacatatgcaaaccaaacagctgtacggcctctaggctagactgcctttagaagcatggctgaataatctgctggtaccatagcacagaagcaatataatcaattcttgtttggtgtggtggtgcacaactgtagtcccagctactcaggaggctgaggcggaaggatcccttaagcccaggagtctgaattcagcctgggcaacataacaagaccccatttctaaattaataataataattcccaaattgacaaagagaaagtctcatggtcgagtggggtctttaagtctactacatttttatactggccttttctacatgactacaaactgtgagcatattttaagtagcaaagaaggtacagataaatataactgattcaacataaggcaactgaagggacaaaaacgtgcacagtttcatccaatctgcagtctggatggtgaatccaaggtttgtgggccacgccaatggctctcctcacttcttcagaaaacgctgcaactgttcctgtagggaaatgagctgtagggagaggtagaaagacatgaaaaattcatttgaaatttgaggtcccattacttgatctagaatttacttaaatgaaccaaaaagaactactgttatttggcatttataaggttatcttagtcttgcaatgttccagagaatactggccacagtcaagaatgcatgcatactgctgtggccatgatgatgtcctttattatgcccaatttatgaagagaagctttgtattagtcagttttcacactgctgataaagatatacctgagtttgggaagaaaaagaggtttaatggacttacagttccacatagctggaggcctcacaatcatggtggaaggcaaggaggagcaagtcatatcttacatggatggcagcaggcaaagagaggagaacttatgcagggaaactcccctttttaaaaccatcagatctcgtgagacttattcactatcacgagaacagcatgggaaagacctgcccccatgattcaattacctcccaccaggtgcctcccacaacacgtgggaattaaagatgagatttgggtggggacacagacaaaccatatcaagctttaaaattgaataggctttaaaaaaaaacaatatttttgctgttaagaatttgtgcttctgtgaagaatatacagaggtcacagctcactgtaggggcaaaggagatgggatctctgtagccatattctaagagtcagatgataaaacagttgggacactctcttgtcccaatgaacacaatgggtcttagactgagtcttaccagctgcttcttaccacattaggagatacttagaaactgagccagagccctgaccaatcaggagcctgatgatgttctacttaatgctttctaagttagaagccctgaacattttgtggtataggatttacttttttttaacttgaaatggtaaagtgaccaataacattcagagatgtatgccatctttacaacaaaggttgtttttgaatattattcatttcaggacactccataccagaatgaatttttagtctgtgaaatgaaaggaacattataaaacaatcctatgctgcacatcacctaccaagccacaataattgctgtccgcagtaacttagaggctcttctcactcagttgctgagtgacccctgattgaccatgattacaaccactgactgatccagttctttctcctttgcaggctctttctcttcccaccaccccctatagataggtttttccttaggttcagacttcttgctgaacaatcaaccaggctaactcaactagccccacagcttcaatgatcatttctgtgtatgggcctctctccaatttcccattttcaaaagcacttctccacatacccctccaaatccactttttgttatcctattttcagttaatggcacatcatttcccagtttcccaggctttggactcatctttgttcccctttttgccctgtaaatccaatcaattgttaagctctgtttgcttctaccacttgcacctttgaagctccaggctgtccccactccaatttctcctatatacttctggcagaaaaatcttcctgagttattccccaggtaaaaaggctttgaaggttcattatgacctacaccaaaaatctaaactgttcaccctggcatcaccacctctgagccagtgtgcatgctgctttctcatggaatgcactcctttccctatctccttattaaaaccctacctatattttaaggccccagtcaaacaccatcttctccatgaagtcttctttaatatccatggacaatctgtcattcctttaagtccctacccctcttgccaatttctccccaaatgaagacagagactacatcataagcatatcatagctccctgtagagcctagcttaaagtagacacctactaaatctaatttggataaatgaactaacataagggactctgagtaaataaagtttacagctacatttctatgctgctcctcaatactaaatatagtcatgtgttacttaacaatggggatatgttctaagaaatgcatccttaggcaattttgtcatgacgcgaacatgatagaacatacttacaccaacctagatagtatagcttactacacacctaggctacatagtatagtctatcgttcctaggttacaaacctgtacagcatattactgtactgaatactgtaggcaattgtagcacaatgttaagtatttgtgtatctaaacatagaaaaggtaaactaaaaatacaatataaaaaattaaaaatggtacacttatatagggcacttactatgaatagagcttgcaggactagaagttgctgtgggtgagtcagtgagtgagtggtgagtgaatgtgaaggcctaggacattactatgcactactgaagactatataaacactatatacttaggctatagtaaaataatttaaaaattaagtaattctgctgctatgttatgatggccacagtgtcaccaggtgacaggaatttcttagctccattataatcttatgggactaccatcatatatgcagtctgtcattggccaaaatgttgttatgcagcatacaactgtacttacattgatgaaaacaaagatgtttggtgggtactaaaacaatcctggcattaactgttcatctgattgttttaaagcagtattaagcagtacttggataagtgatttgctgagaggaagggaatatatagaacataaaaattccgctagccttgtggggatgggggtggggagtagtgcctgtacttcaagagcaccatgctaagcccatcctcataataccaactccagtctctttaaaattgtaaccctcaacagtataaggttagagtcagcacacattttctatacagctgcttgaccctcatttagcctatattgccttcttctctcttcgccctgtacactctcttgtggctttgaaaaatacagttgtcgttcaagttagaaatacatacatccttaatgattccttctccttcaacacccagtaattgacccaactcctgtcaattctacctttaaagtatattctctaatatatcaatattcattgcagcattattcataatagccaaaagtgaaagcaacccaaatgtccatcagcagatgaatgaataaacaaaatgtggtatattgatccaatggagtattagtcagttttaaatggaaaaaagtactgatacatgccataacatggatgaaccctgaaaatatgctaaatgagaggagcccgactcaaaacaccatgtattatatgatttcacttgtatgaaataactagaataggcagtagattagtagaaactagatgagtggttgcctagtgctgggcaggggagaggttctggagaagtggggagtgactactaatggatacagggtttctttttggagtgatgaaactattctaaaattgactgcagtggtggttgtacaactctgaatatgctaaaagccactgaattgtatagtttaaatgggtgacttgtcgggggtggggaggacggggtttgaggcagtctcactctgtcacccaggctggagtgcagtggtgggatctctgctcactgcaacctctgcctcccaggctcaagcaatcctcccacctcagcctcccgagcagctgggactacaggcatacaccaccatgcctggctaatttttggagagacggggtttcaccatgttgcccaggctggtctcgaactcctgggctgaagccatctgcccactttggcctcccaaagcgctaggattacaggcacgcaccaccgcacccagcctaaat

SEQ ID NO: 832 - DNA, 49744 bp, Homo sapiens
agatttttcttcgagaagggaaacaactctcccaatcacatttattaaattattcatccttttttcactcctttgcaaaatcacttctttcatataacaatttactatatgtgccttttctaattttgtaatcaatgtttcaaattccacaaaaattggcctgttaatattttgattggaataatattggatttatggattaatttgagaagaattaccaatttgctcacttaaagtctccccacatacaaatggagtattgttgggaaagacaacccatcatggtccctaagcattcacacatgttctttctgagtatgccaaaaatgtaaggcactgaagactcttcaccttggccattctcagggccatgtttgcagtgagaaaccctgaaggatgaggaaacatcacaaagagccggcttatttccattttctataaaagcagtggatcctccaaatgtattgtttctttcctgtaatgcaacccactgtgcagctatccatcattggtcctttgcattgcccttgtgggatctggggggcattgggaacgaacacaagccaacaggaagttctagctactgctttttctgagtaataaagtcctttgcctctcacccaagattctcatgtcttctgacagaatacatgaaactgtgtgtgtcaggctaatttgtaagtttgtaaatagggtcaaattccagactttttgtagttcctgacaagtatattcctccactttccgatttttattaaatttcctttagtacagtctcatacttttctgcataatggtttatacatctttgttagctatcttcctagctgccttacagattttgggaatatcatgaatgggtaatttttcctattgcattttcgaattgattgctgaattccacacacctatgcatgtcattagtatagcttctcacatggaataatgtactgtttcccttgatagaatgttggcttctcttgagagcagaaaccatgccttattcatgtctatattctcctaatgaaacatttaattcaactaatatttattgagcattgttatgatttgaatatggtttgtgcccaccaaaactcatattgagacttggtccccaatgtaacagtgttgagagggggtggaatatttaacaggcttctgggtcattagggattcactctcatgaagggattaaagcagtctggtgggagtgagtcagttcttactctttgtgggactggattggttatgcaagtgcaagttgttgtaaagtgaggttgcgtctcgtgtttggtgttttactctctttgcagggacctggtttcccttccatttctctgccatgttttgccacagtacaaggccctcatcagaagctaccagaggcagctgcccaatcttaaacttcccagcctgcagaacaatgagctaaataaacctcttttctttgtaaattgcccagtttcaggtattcacttatagcaacacaaaatggactaagacaagcatctactatgtatcagttgctaaataaaaagaggtatacaatcataaataaagtgcctgctctcaaggaatttataaaatgtgaaggagacaaacggagccacaaaatatttctgttaagaaagtcatattggccaggcatggtggctcacgcctgtaatcctagcactttgggaggccgaggctgatggatcacctgaggtcaggagttcaagaacagcctggccaacatagtaaaacctcgtctttactaaaaatacaaaaactagctgggcatggtggtgcacacctgtagtcccagctacttggaggctgaggtgggagaatcacatatcacatggacccagggaaggcgagttcacgccactgcaccccagcctgggtaacagagcgaggctccgtcaaaaaaaaaaaaaaaaagtaaaaaagaaaaaagaaagtgatattatgtatcataacaaaggtatgaacaaagtgctgtgggagtagaggcaattcatcgtgacttggaagattctggaagtcttcaaacagtaagtagtgtttgagttgggcctcagacagtgatctagactgtgcagatggagagctagggaagggaggtaacttctgataccatgcctggcattcaaagtcttccacaatatagtcccaaactatcttcccaaacctagctgctatgtcctccaggaaataaaagttagtctttcatgccaaattcatccatcaatcacattctaaactctaaatctttgagttcccaccttgttgttttgcactatagcacaatgactaagagcaaagtatctagagccaaaggaatttggattctggtccagattctacaacttactggctatgaagtattgggcaagtaaagctagaaatgctgcttatcttataggactgtgtgatcaatcaggtaatttttgtaaaactttggcatggtacctggtacagagtacaatactatgaatgctacctctactttatccatccctgtgatctcaagtcaattaaaacatacttactgtatatccactatgtgcaatagattgtattaagtattatgaagaacacaaagatgaatgagaccctatttctgcccagcgacatgtcaggtagagaataaaaagtatatacacaaataggtcaggtgcagtggctcaagcctgtaatcccagcactttgtgaagctgaggcaggaggatcacttgaggtcaggagttggaaacaagcctggccaacatggcaaaaccccgtctctactaaaaatacaaaatttgctaggcgtggtggcacgcgcctgtattcctagatactcgggaggctgaggcacgaaaattgctttaatccaggaagtggaggttgcagtgagccgagataatgccactgcactccagccttggcaacagagtgagactctgtctcaaaaaatatatatatgtgtatatatatatatgtacacaaataatcatgaggcaaggcaaatcaaaagaactggcttcttctagctctggcccttgatatcatgcaaaagtcagaccacatgatcatcaagaccacttctaagtctaataattctatgacatctatgattttaaatgttacatcaaggttaataagtaccaggggaaagtggaaaagaaagaaatctaattccacctgagggagtccaagaagcctgcatagaggaaatgacatttgaattggacctttaaaaatggatagcatttgttgaaggaagaaatgggtgcaatggaattacaggaagaggggaaaagaacaaagagaaatgtagggcacacttgggaaacatccagtagtcttatgtggttgggacatcgagattcataatatttaagcagaggaaaatcaggtgaaaaaagtaggctggtgtcagattatggaggaccttgaatgtcacgctgagtggtttggattttatcttgtaagttattcacattggacggtgacaagaaaatccactgaaaagagttgtggcagttgttcaggtataaaataagaagagactgaattaaggctgtgggtctaataattgaaaattaaggacaagtcttttggcggtttttcatatactactctgtgtatattgttgaatgatttttaatcaaacatgtttggagggcaggacccattcattcattcattctacaaatatctattgagcacttactatgtgcatgacagtctgggcactggaaatagagtgatgagtgagagagtcaagttccctataccttagtaccctttgtgctaaaagtaccagaaaatgatgataccattggaagtgggaagactagggacacattggtagggagaataaagagtttaatcttgacatattaagttttggaatgcctatatctcagtgaaaatatcaaataggcagttagatacagatatcttgagattttatgtactctatctcagagttgaccttttttgtactccatctccattatcataataaattttttaaggtttgctgtttactttttgaaaacctaaggaattagtggcatctttatagataataacatagtacattatgttaatatgttatactgaatatgtcaacatgaggcatcaacacatataaattgatttcttaacagatatatattttttctcttaaaatagaaggacattatatgtaagaaactcataataatcccatttgtgataatctgctttactgttagtaattgtttaacaaagcaacaaataaaaatcccaaaaaggatatattgaacactatgaaggatattatgaaacttggagaaacattaaaattcgaatttcaaccattatttttgtttacattaaaactcaacagttggctgggcacggtggcccacgcctgcaatctcagcactttgggaggctgaggctggtggatcacgaggtcaggagttcaagaccagcctggccaacatagtgaaaccccatctctactaaaaatacaaaaattaggtgggtatggtagtgcctgcctgtagtcccagctactcaggagtctgatgcaggaaaatcgcttgaacctaggaggtggaggttgcagtgagctgagatcgcgccaccgcactccagcttgggcaacagagtgagacttcgtctcaaaaacaaacaaacaaacaaaaaaaccctcaacagttaagttttgctgaaattaaaatctcaacagtaattttgtgaaaagaaaatctcagcatctatttctgtacatattaataagaatagttaagaaactcttgaggaataagaatgaagtgggaagactttccctatcagatatcaagacatttattattattactgttacaggtaataaggcaatgctgtactggcacaaggttagataaataaactgatggaatagaacagacaggtcagaaatagtcccaataatatatgaaaacttgatatttgacagagttggcattgtaactgaatgggagaaggaaagacttttcaacaaatgatattagggtattggatattcataaggaaaaaaattagacctctattctcatacgctacacgaaaattaattccaagtatattaaaaacccaaatatgaaagtcaaaaccataaaattgtaaatgttattatagtataaaggaatatcttcatgatattggagtatagaaagattcctttgaaaagacacaaaagcacttaccgtaaaaaaggattgataacttcgatatctatcttataattagaacttatgcttatcaaaagaaatcactaaaatggaaaaataagtggcaaggtggggagagatgtatggaacacatataaaagaggaagaactaaaattaaaacaaataacttctacaaattaatttgaaaaagtcatacaactcaacaggaaaacatgacaaatgtctagaataaatgcttcacaaaagaggaaatcctaatgttcaataggcaagtgaaaagatgctcaacattattagtcatcaggaaaatcaaattaagagatgccatttacaccaactagataggcaaaaattaagaagtctgataataccaagtgttggccagcaggtggagcaatgggaattgttaaacctggctagtaagagcgtgaattggtacatgccatgaggaagttaggcatcatccaattaaattgaaggtgctcgtattccataaaccagtaattccattcttacataagtgccctagagatacctgtgtttatacacactaccaagaacattgatagtagcaccgttttgtaacagtcaaaaattaggtttcatctcaccccagttaaaatggccattatcagaaagacaaaacagaatctggcaaggatgtggagaaaggggaactctcatacactgttattgggaatgtaagatggtacagccattatggaaaacggtatgggtgtccctcaaaaaactaaaaatagcactaccattatgattcagcaatcttgctgctgggtatatatccaaaaaaatttttttaacagtatattgaaaagatatctgcactcctatgtttattgcggcactatttacaagatccaagttatggaatcaacctaagtgtccatcaataaataaatggataaagaaaatgtgatatatgtacacgatttaatagtattcagctataaaaaaaataatgcaatcctgtcatttgtggcaacatagatgagcttggaggattttttgtgaagtgaaatgtgaagtgaaataagccaggctcagaaagacaaatatcacatgtcctcactcatatgtgggagctaaaaaagttgatctcaaggaggtggagagtagaactgtggttaccagaggctgggaagggtactgcagaggagtgaatgaagagagattggttaatgggtgcaaaaatacagttagagagaaggaataagatctagtgttcaataccacaacagagtgaccacagtattcaatttattgtgtatttcaaaatagctagaagagaagatttggaatgttcccaatgcaaagaaatgataaatgtttgagctgatggatatcccaattaccttgatttaatcattacacattgtacacatgtatcaaaatatcacatataccccataaacatatacaattattatacatcaataaaactaatgaactgtaaaaataaaacctgcaaacaaccagaatgttcctcaaagttatcatgaataaatcatggtatatttatacaatggtaaactgtacaacaataaaaatggatcaactacagctatctgcaatatcaatgagtctcacaagcaatgtggagtgaaacaagatagtcacaattccaagtctaaaaagcatttaatgtttgaacatctgtaaaacaaaactgttgtttagagatgcttataaggaagaaaacttataaacaaaagcaaagaaattattattacaaaagtcagcatgggggctacacctaagatggagggagcggtgtcatcagtggtggggggagaagagtaggttattaaagggctctatttcttgctctggctggttattacatgggtgatggctttgtaaatgttctttaaactggcagttctcttctgaatgtatctgttttcttaatgaaatagaaagtagggtcactagttggaaatgatgagggagggagtattaaaagatttgaggaaaggaagatgatatgaaagaaccagagacactggagagtgaacagactagagaaatacaatatttttatcttttctgaaagctttttatattgtttctgatttattatgctttttctctcatatgcaacgtcattttattaactttaatatactacactatatatagttatcccagtaaaattataatgctatttagtgtttaaaaataaattgtaaatgcaaaattaagtcagaatataccatataatgatttgtcataaaacgttattatttcaacttgagctttataaaagctgatgtagtttatatttagagaaaaatatatatcacgcatatattgtgttgtatgatggctttttattcttttttttgactttttataccaagtaattttagtgttaaattgtatattttatgtgtttaaacagatatagatatttattacctccttattttattggtctcaactcctaaaactcatttttaatatcagaaaacatagctccattaacatcactaaactaaatattaacattgacatttaaaattacttgaaaacgactatgcccttaaattttgctcacaacttttaagtggaaaaagttgacaggtctgtataattttacaatattgcctaggatttcatatgaaccgatttgaaaaactcaattatttaaattataacatgctttagttgtaaatccatgtttatattataattgcatagcttcaagcttcaacatacataaagtttttataaaggcaaatatagtaaatttaagcaattattagcaatttagctttaaaatatactccgaggggaaaatacccaaactttttgcattgctcttacaccacggcaatcagcacagaatatttccatgtccagatgtgtggagttttcccacacactaagtgagcaatcagttctgcagcgaacaccagctgggtgtactccaattccattctgacacaatctacctggagatagcgtcatatcccacaagctgaggactaggtttcacaagactgttcccaggcccttcagacaccagtcgcaaatccaagcctccagaacttctgacagatgggcttcaagtttgagttcacatgaccccttctttgggtttaatttgccagaaagggtcacagaacttggggaaatacttaacgtttaccactttattataaaggatatatcaaaggatagagatgaagagatgcatagggtgaggtactgcggaaggggctcagagcttctgtgccctccctgggtcaccaccctccaggaacctccacatgttcagctatctggaagctctccaaacccagtgctttggggtttttatggaagcttcattgcgtaggcatgattgattaaatcattggccactggtgatcaacttaaccttccatccctctcccctccctggaggtcgggaatgaggctgttaagtcccaaccctctaatggtgccttggtcttcctggtgactagttcccatcctgaagcaaccagaggctgccagccatcagtcaattattagcatacaaaaagatatcactttggaaattctaaggattttaggagttgtatgccaagaaacaggatcaaagaccaagtatatatttcacaatatcacatatattgtgtgagttttcattttattatattctgtaataactgtcccattgtcagagataaaacacggtctcttaaaaaataatttggatctacaaacattgaatctaggaatattgaaaactgatgtatgcaactctcagatagttcagggaaaaaatatcctgtgtgtgtatagacagagtgcacacttaaataataaagcaaatggggagaaacattaataataggggaattagggtaaaggggacatgggtgttctttaagctttatttatgcttgcaacatttttaaatgtttgaaattatttttaaataagaagttaaaatgaagaaagggacatggatggacagaatgacataagtggaaatcaccagtgtacttgggagatgaatgcatctttttcctttccttatgcagactctgtgttcatacttccttgaatccacaagttgagtactgtcccaacacatcccgatctgcagatgtggaagctcatcttcagctctcctggaccagccattttctgccaaccttggtggcaaatgctctctgacatcatacctccaacaaccatgtctttaatttctgtggcattcagtgagaagttctcactgctaaatctacaaccaagtaagacaaatacaggacaaatttggttcagtaaggagatgcaagaggagggcattactaagatatctgtagggggaaactataacacatgtcatcttggaaatcctcaaaattccagagttgaaacaaatggtacagttgtacagtgtgattctgtttgtgaaatttcagttcctgaactggtgctaatagcaaacatgccatcagtaatataaactcatcaaatgtgccagttgaaagtaatttttattattgttattattattatcagtagcagcatcattatcattagcacaaaactaaatcaattattaaaagaaagcaaaaacacagcccaaaggcacgtgtcttgctgacagtgagtcaataactttatcgtcatgtacaagggacagcaccctgaggatataccatatcacagcttgataatcaactcagtaatttgaccaacgttattgagcacctaggcacaatggaagattttaaaatgcatacaaaaatccctgctttcaatgagttttacagtctagtaggaggtattgaagaatacaagaacaaagggtcacatgagattagtgacataatggaatcagtaccctgtatgaagtgctgttagaaaggggcatcacagaggctgggcgcggtggctcacgcctgtaatcccagcactttgggagaccgaggtgggtggatcacctgatgaggttgggagttcgagaccagcctgaccaacatggagagaccccatctctactaaaaatacaaaattagccaggcatggtggtgggcgcctgtaattccagctactcgggaggctgaggcaggagaatcacttgaatccgggaggtggaggttgcagtgagctgagatcacaccattggcactccagcctgggcaacaagagcgaaactccgtctcaaaaaaaaaaaaaagaaaggggcatcacagagactaatgtcacattcagttggggaaaatcaagaactccatagagaaggtgacctctgagctgggcttcaaggaactggaaggattttggtagactggcatgtgaagaaggagcactgcaggtggaaagaatagtgtgggccagagtatggccatgggaaagttcatggaatgtctggggagagaacaatagttcattatggctagtgtttggggtttatgtaagtggagtgacaatatgttgaaagttatatgatgaccatattttgaatggctctgaatgacaggctaagatttctgatctttatgtcatagtaactacatttaaccacatcaacaaaatatgcaattttctgtgaagagatatggtcacttcacttccaggtttcttagggaaactcaaacggtttctaggcaatgttatcaccttgctctcagaaatgtcctagcagataacaccaagcagactatagcaaatgtttctattttgcatgtaattaaatcttttctttcaaagtttttattctttccatccatgggccacgctcttctcactcccatctccagccccactagttcttgtggcacctgacgagttcatgcaagcctaatttaggatttccagccacagctgctaccctgaaagtaggacccacagccttgagaagtgagaggtggtggtagaggcagtgaacaatatcatgaaaatgtagccatctgagaagttttatggaattcccatcctaagagtcaagcatagttctttgaaattggagttccactcagtttggtctggaggacacctagaggggtcccagagctcagagtgcctaagtaaggtcatctttttaagtttctgtttattgccaaggaattccttaaaggaatgacacttaatctgggttacatgttatttaaaggcctcctggctctgaggctactgaaactgtggagagactggggtgaacgtttctttttgactaaggaatacttttgggctttgtccttgctcaacaggttggtagttgggaacttctcccatgcaatgagtttatagatgctaaaggatggctgtattaggcaacctagccaaagaagtaagctatatagaaccaaccagggaagatttagaataacaaagctgccatgccacactttctgcagctagtcagtcttcagctctttcctggagtgcgacttcctctgcaggaagtcatggattgccgtagtgaggccccatgtcacactggaccttaggatgactagggagcctccacggtagatcaggagcagctttcggccccgagtgttccatacatcctgggcagaggcccacaggcttggcatgttctgccatccaatatgggactgcatattagcaaccagcacaatcagaggatacagaactaggcaggtgattgttccattgacactaccagacaccaaggcaggaacccagtggggcaggccttgctctgccaggccatcctggatggggtccttgaaagaaaaatatagagcactccccaggctgttcctggccaggacaggccagaaaccacgatagtagcccagtgacagccgcccccaaagcccataagaattgaattccttgagaatgctgaaggtgctggggaagcgagcttgcttgcgaccatcctggagcacattttgcaccctttcaaaggggctgagtgccacggcctccaccacgccagacatgagcccggcagcccagcggtgtcccagggtgtgtggcccaacaggagagagaaagcacagcaggctatcataagtcccaaacagaagagtcccttgcaacgtcttggagagaagaggagggtagattccccggtagaagtattgaggaccttcatgccaaagctgtctcacagcctctgacactgccatggcatggatctgttgccggaacacaaccttatagataggaaaggtcagaaaagtagacataaagttggaaacggccccaagggcataggcctgggaatgccagcttttctttcctggagcctctgctcgcgtcctgtgctgaagctccttcccgggagagtggttctgctcccccatgctgaagacaactgggtgcagatggaagaaactggcaagggtggaaaaaaagagattagactgaccaattaattctgttggcaagcattttcattgcttaattagaaatgaaccctaagaaactcaggtcgacggaaacaagcaactctttgagccagtttctgatatataagcacacccttaagaaattaagaattaattaactttaaattaaaagaaaggcaatcagtttttctggacagagccaccactacagtattttgctgacacagcaaatattccaatattcaaaggattacgactgaaaaacatgaaatagaggaggggaagactccaaaacttaatgcatcaactttcacgacatgaaactgtgcattttataaactacttgaataatacattgctattctgtttaaaaaaatctggcactatcttgtagaggcagaaaggcatttaacagttgaagtgcaatgctttctctaaaagttggtattaaatttggggagggggaatctcccctcgcctttctctccatagattcctgcccaagttgtagctgtttcatggcaacgcccagcccccctccagcaagtgaggaaaggaaagagcagctgcttctggaagttcagtgcctaaaggctcagcacctggcaacttctaagcctaacctttaagacctgtagctatataatagagcagggtttcttaacctcagtgctattgacattttgggcaggataattttttattcttggcgcctgtcctctgcactcgagaatgttcagaggctccctggcttcggctcactgcgtgccagtagcaccagtagtgacttacacagtgtgatgaccaaaaatatcttgagaccttgccaaatgtcccctgggaggcaaaactgctcccggcttagaaccactgtactagatagaataggcagtgcaaggaccccaaactattgctccttaccccagaaaggccaggaagcagatggctagtatgagaagcaacttggaagccaggacatatgaaggaattttgggatctaaagaaaaaaaatgaatgctcagtgcagatctgagggagtttgccagagaggaaagagggggtccctggctgacgagacagggtgtgcagaagccagagctgccacctcagggaaaggaacagagatgtgtgggtgtggggcaggaggacaggggagaggcggaggggcatgatggccaggacggagggcttccatctacagtgacagggacacaaagcttggcaggaactgcagacccacaagtttcacacagaaccctgggctatgtgatgggggcatgaaggttgggactctaattaagctagcaggccaatggggaaccagagagtccaagctgaggtccccagggaggagtagaagccacacactgcaagaagcccaatgcagccttcccgaggctgccaggccaagaatccgccttggtgtactactccttccaaaatcactcccatcagctctgctcttccctagccccttctccctgctccatccatctccccacaatcccattcctatccccactgctgcatccatatccccacaatctcattcctatccccactgctccatccatatccccacaatctcattgctccatcaatctccccgcaatcccattcctatccccattgctccatccatatccccacaatctcattctataccccctgctccatccatatccccacaatctcattcctatctccctgccccatccatatccccacgatctcattctatcccccctgctccatccatatcccacagtctcattcataccaccctgctccatccacatccccacaatctcattcataaccccaccctgttccatctatatccccacattctcatttctatcccctttgctccatccattttctcacaatctcactttaccaccacgcccctcccctggagccacactcaccttttggtggaggcagatggaggctcagcctcctgtactctgcccataaccacctccccctacccccacattccatgatggccttgagcctcagcctcctttaccctcatagccagtacactgggaggacccctctgcctctgaccctttagctgagaactgagcaggagtaaaaactcaagaggcccactctttgcatccctttgggccacctctggcccctggaagccccacttccatttctccagagccaaaggggactcctcccagatacccaggctgctaaatctacagaagcccccaacagtcctcagctctcctatcaaagatcttctttccaaagtcttaccttcacctaaataaggacaggtggtgaagtaaatatttgtcctttcttctacctcagagtgcaataatgttccatttcctccctaccatttataaacatgttcactgacaccatgaggcaggatgatttagcagaaagaaaactgggctaggatttggcagtgcaaggactcccaactatcgcacctaccccagaaaggccaggaagcaggtggggtagtatgagataccagcattctaagtgagttttattatcaacttgatgtgtgacctttagaaattcagtgacatcttggagccttacccatctgagctgtaaatggagcagaaagggcaaaataatttttagtcatctccatactgtatctgtcagaggggggtgatattgggcattcaggtcaatagttgatagaggaattgtacttttcaatccccaactccttctgccatttttgtaaatcattttgggggaataaaggtgaacaataattgagaaacatctaaccttaatatgtaatccattttataaatccaatcctttccattttatgggaggggagttcgtgtttctcccatgtattttctgttaagatgccaggctttggaaagggcagacagacccgagactgaattctgcctctgccacttagttgtgtgaccttggaaaagacatttcattcagtctcaggttcttcagctacaaaacaggggtattaagatccacctcaaaacgttgtggcagagattaataacataaaatgagacaaagtggttgagaatccataacatggtggccttgataagaaggatcaaaaaagatgcttctggacttcactatctgtctccacagaacgcatgctccttctggatgctctcgggacagccataaccagatacaggggcatttgggaacaaatcttctgttcccaagggaggcagggaagcccttacttccacaaataggaaggtgcaacataagcaatctaggagagcctggccccttcacatgaattcaaagtatagaccacagaatggacctagagttggccttaagcagatatcacctgtaccctatgacctgcctcctatgtttacagcctagtaaaatgagcccagaggattccagactctcccagccagtctagtccacatgggtagactgtgtgactgccccaggatccagccacaaatgaatgcatttgtctgttcattcagggcatctctcagccagtcctttggtctgctcacaaacatgtattgatcatccactaaatcattgtgggtaaaccaccatagagctagagtgaatagaacttggtgcctgccctcaagtgcttagaaatctagtcaactagcttgggagacaggtcaacagtgtgctaaactctacagaaagacaaaataaagggtacagtaatgaaggtggaagcaaaaagacaacagcaatttattccacctgagaaggggcatatgactcaatccttaattgagtagagtagaataggctgttgttaggtaggggagtgagggcaagcattctaggctgaggaagtggcctaaggcacataggcttaagagtgtgagttgtgcatggggctggcctaccccatgtggtgagaaggaaatagagctgtggttgacagagagaagcccatttaagatgaggaccacatttgtcttctccgctgcattgtgttgtagggcacagagatgggctctggatacaggcagccctgggtttgaatttcactctgtcacttcctagctttataaccttggccaagtttcatcatctcgctgatcctcagtatccttatatgtaaaatgattgtcatgaaggatgcatgagacaaagtatggaaagtgcttagcacagcacctggtatataagttgcttcataagttatattagcagtttcattttttaaaaatgagataataggaataaaggcaagataacaattaaattgttctaaaggctgcaattggtctaatgaactgggttatctacagaatgcattttggactgcttgtttggaaggcagcaaagaagagttttcatgggctttggagttcgacatccctggcctgcagtctcagtgcctccacttacaagttgtgaagcctgacacaagttacttaatgtccctgaaattcagtttccctttctgcaaaatgggatacaatagctgtctcaacagggttgataagaagcttaaaagagataacagacagaaagttcctggcacaaaggaggcaggcagccaaaggcagctattattgtttcaactgaaagctttatctccaaaccttcaagcttttaaggtttatttgttgaaattagaaaatgtggtctcattagaggcatcagttggaacacactcatacatgtgaggccagagataggatgtcctgtatccaattgaagccaggttgcaaatactacccccatccctgcatgaagagtccctcgctttgttctagtagcccaaccctggcacctttacacaatccatttcctgtcattatttttgtctgagctctgacacctattcttggtcctatgtgattccatccctaccaagtccagctgcaaatacctaatttggtgataaagccaatttaaacactgaacaagactcttctgggaggtaagggtcagatgtcacgggatgggggagcagaagcaaaagtctgaaggaaacctaagagcaactgccagcatcacccctaagtgtgtgaggtgagcaacttgccttctccatacatccacactttccagcctccaccaccactaccccactgttccatccacagaccatgatcctgagatggaaggtgcttatctccaaatttttattgtttactccaaggaactctagatcttggggttgtaaataagagggcggaaaggagcaagtgaagtaccttggcagactgaagatgaagccaacagcagcggaagggcatcagactgtttacttgcttctaaacatcaggagtcaagaacaagccccacagaagcctcctagccacactatacataaaggaagtaatacctgctctctaagtcagggaaaaatggagcaggttttccagccactgccttcatggccattcactttggacagccctgcatgccgtttccatggagttgctccttctctggggccagtgatgccaaatccagcaaaggagaagtaccctgaagagctcacagaagggcaacctagcaacctgtccttgagccaggaaatgaaagagccatatcagcaacagagagctgtggtttgggggttaggttaaatggggttttatttctcacacttcttcatcaagcatggcttgaagaaggaagacgttatgacagacccatttgaaaatctgcaaagctgtgggctcagaagaatgtacggagtccagattctttgcatacaattccaggaaggacctcgggtaggaacctgtgctctggagttacatttcatgacagatatgccatggacagatacactgatggcaggcccatttacttataaccttcagcatcacgtggtggtgtttagaaaagtggttcatgaatctctctacacctcagaatcaactacagggctggttaaaactacaaatcacactcttcacccctagtcctactacatcaaaatcccccaggggtaaggcccaataatctacatttataacaagctctccaaaatgattctgaggcagctcaccttgtactcacactttggttaatagcatgagttctggattcagagactcagttcaaattttggcttcaccttgtattttcagacaaatcattttacctctctgagcctggcctctttggggtcacaaagggctgtcgaaattatgttgcttttataaaacaggcagcttgttgtgtaaaaagaaaaaaaaagaagaaaagaaaaaaagattaataaaaaaaatgaaagaaagaaaagtaccaagaagagtttcctcttctgtacaatgggcaccataaaggttgccctcatcttccctcagccctctccccactacctcctcaccccctccctcagcactattatcacattgagactgctgttgagatggtttgagactacctgtgcaaaaatactctccaggcagcgctgcagggcaacgaattagcatctagagagcaacagacggtgctaggttggatgctgtaacttatttgctgcaggatacaggccaaaactagtaacctgtctctctctggctcagtttcttcatctgtgaaatggagataatggttcttgctcaccaattctatgcaatcccaagttggtcctcccatctggctttggtttttctccactatcccttaatctgacagaatagaggagtgctggcaaggggcagcctttgaagtcagacatggtgacttgggtgtgagctcttaactctgcacttcctaactgtactgcctgggtgcttcagtcctttcctgttaaatgggcacactactacctccttcacacggctgctgagaagaggaaaggagatgtccatgcaggcgcctctgcacacagaaagcactcagtaaacgctgtttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaacagttgtcgcccctcctggagtacaggcaggaggggatggatgtggctctgaaaaactacctactagcccagggacacctgctagctctggaatgttgtaattgccagtctcctgcagggtattgttaaggcactgggcagatataaaatgcactgcaaggctattcaggaagatagagaatgctactgcagactgcttccccacagcccactatcttattaaccttttttactttccttagaatccctactgaaatataaggcaggcacagcccaggaacgttgctttggagaatcctgcagataaggcttttccaaaaagcgcgagcatcttgttgtattcagataccctatcgtcgtcagtcatggctagcatcactgcgtgtgtgggtaacagcaggcagcagaatgcacctttgccgccttgggcccattccatgttgaggtctctggggaggagtctctgtcctttagtggtcaaaatggcagagagaaacatgaagttgttctcaggaagagtggtgccagcccaggggaaagaaacctttgaaaactggctgatccaagtcaatgaggtcctgccagattggagtatgtctgaggaggaaaaactcaagcgcttgatgaaaacacttaggggccctgcccgggaggtcatgcgtttgcttcaggcggccaaccccaacctaagtgtagcagatttcttgcgggcaatgaaattggtgtttggggagtctgaaagcagtgtgactgcccatggtaaattttttaacaccctgcaggcacaaggggagaaagcctccctttatgtgatccgtttagaggtgcagctccagaatgctattcaggcaggcatcctagctgagaaagatgcaaaccagactcgcttgcaacagcttcttttaggcgctgagctgaatagggacctgcgcttcaggcttaagcatcttctcaggatgtatgcaaataagcaggagcggcttcccaatttcctggagttaatcaagatgataagggaggaagaggattgggatgatgcttttattaaacggaagcggccgaaaaggtctgagccaataatggagagggcagccagccctgtggcatttcagggcgcccagccaatagcaatcagcagtgctgactgtaactgcaacgtgatagaaatagatgatacccttgatgactctgatgaggatgtgatcctggtggtgtctctgtacccttcactgacacctacaggtgcccctcccttcagaggaagagccagacctctggatcaagtgctggttattgattcccccaacaattctggggctcagtctctttctaccagtggtggttctgggtataagaatgatggtcctgggaatattcgtagagccaggaagcgaaaatacacaacccgctgttcatattgtggggaggagggccactcaaaagaaacctgtgacaatgagagcaacaaggcccaggtttttgagaatctgatcatcaccctgcaggagctgacacatacagaggagaggtcaaaagaggtccctggagaacacagtgatgcttctgagccacagtaaggatctagtccagccctaaatgagtccttgactgtattcagagtctggtaatgggaataacaggagaggggggtgggtttctaactgcatgaattaatccacaaagcagttttcctttgggaaggagaagaggtcttgcataccagcacagtggatggggaatggtgtgacctctgtccctgctctcttctctgctggcttaagggtctattctccatgtgtctatttctttgatgactttatactttttatgaaaggagcatcttttcattaaaccttcaaaaataaaggaagatacaaaaactaaagtacaaattacctgaaactcagcacccttttgtaaccattgtcagccctttggtgaatgtccttccagatatctccctgtacctgtgtacccagatagatatatgtatagataagagtgaccaaatataagtgctgttctatactgtgtatttttcaccaaataatgtatctcgtggacttctatgtcgatgaatatatataaatatctaacttcatgtctctgtgtgatgttacttttagaaagataaagaaaaatgaaactaaatatagaagctataagggggggtcataccatgaggaggggtttttatcgacctcatttataggaaaggagaaaggaagctgaaatggactgaatatctcccatacaaccccttaacacaactgacctgtctcctaggtcatagagccaacccctgcacccatgagttaataatgttccaatgttttcttcttgaacatatcatgagacatcagatggggaacgggggggggacaaaaattgaaaatgggtattccagaggctccattcctgtttgtattgggaagggacaactactcctgcccgatctcttgacctcagattagagggtgataaaagatgacatgtgacctctatccctgagggtcccaagtttctggtaggtacagtagtccctatcttcacgaagaggtcaaaactggcaaggagcaggggggaatgatttcatttaaggcaaggagtggagtgaaatgaatgcagacctgaggacctgagggagtttgcctgggaggaaagagggggtccctgggctgacaagacagggtgtgcagcagccagagctggcacctcagggaaaggagcacagagctatgtaggtggaggacaggaggacaggggagagggggaggggtatgatggccaagctggtgggctcccatctacagtgacagggacaggaggcctggcagaaactgcagacccacaggtttcacacagaaccctgggctatgttgtagggggagtggaggttaggactctaattaggctagcaggctgatggggacaaaagggtctaggctgaggcccccagggaggagtagaagccacacactgcaaggagcccaatgcagccttcccggggctgccaggcccagaatccaccttggagtgctctccttccagaatcacctccaactctgctcttccctgggccctttcccttgcttcatccacatccccataatcccattcctatccccactgctccatccatatccccacaatctcattcctatcacccctgctccatccatatacctacaattacattcctatcccctctgctcaatctatatcctcacagtctcattcatacccccctgctccatccatatccccacaatcccattcagttcccccctgctccatgcacatccccacaatctcattcagatccttcctgctccatctgtatcctcagtctcattcctatccgccctgctccatccatatccccacaatctcattcagatccccactgccccatccatatccccacaatctcattcatatcccccctgctccatccatatccccacaatctcattcagatcccccctgcttcatccatatccccgcaatctcattcctatcccccttgctccatccattttatcacagtctcactttaccaccactccccttccctggagccacactcacctcttggtggagggagatggaggctcagcttcatgtgctctgcccatcaccacctccccctcctccgcattccatgatggccttaagcctcagcctccttaatgctcatggccagtagactgggagggcccctctgcctctgaccttttagctgagaactgagcaggagtaaaggtccaagagacccactttttgcatccctctggggcacctctggctcctggcagccacctccatctcaccacaggcaaagaggaccccaccacccacgcaggaggcagcttcatcaagcccccaaagccacagggtcccccaacactacctggctcttacagccccctattcctccctacctctcccaaagtctatccttggaggggatttgcccactcatctctccaagattagaatatagttccccttgctgctcaccttttctcaaattcactctataaatgctattgaatgatttacctagatatgctgtcataatttctttctgaaaccaggtagagtgaaaagaggaataaatgctacacctacccccatcctccttttcactggagttagcttggaggttcaagatcattactttgaaaccctgctgtgtaattcatcccctttccttcccccccatcctgtcctctgttgtgtaaacctgaaactgtctaaatttttacttcaccaaaatgatgcaaaagtgagactttttatttcattttgtgtcacactggctttcctttattcaagaagtatgtattttccctaattggaagacaaagaagacttggagtgattacagggttaagtgaaagaaggcttttaaaaaattttgtgtttgatacccttcatttataattattgtttttcctttcctttctcccttcattctcattagtcgccaagagatgaaaattgctcttttgtcttgtcaggagaaaccagcctttgaatgacctccttttgcaatatctccctccttcttgatactattttcccttgtttccatgacatccatctcatggtttccctctcccagatctttttgatgcctacttctcagtgtcttttgccgaatattctttcccttcctgatccttccacaatagcaataaaaattaaaatcactgcaagtgcgatttattccaagcttattacatgccaggcacccagtgccaagcctttaaaatgcattattagcttttcatagcaactcccttaagataagcatgactttctatttctaacttgctattaatttaattactattaattgacacatatttcagatgatgaaacaggctgggaagttaggaaacgtacttagggtcatgtaattatttagtggtacagtcaaggataagacactggactgactgatcccaaagtctgtgttccttacttgagttagccatcatgtgcacagcaccccatgaggtaggtgttactattatataaagatgatacatgaggaaagcaaggtcaacagacataattagccaaatatcatagcagcaagtggcttgtgcgccatacacaaggatgcagcctttaaggaatacttgtgtgacacaggccacctttctttcacatcctcttgttgcagctatccttcctgctgcctggcaaccatcccctcccccttcagagttgcattatcacattcagttcaggtatcaagtttccagtctatgcttttggtgcaaatggttttgaatttgatgtatgcaagaggagacagctgcaacaatgagtggaggagagataaattgttcaattcatggtgctggggggaacttcattacctgattggaaaaaaggtcagtttcctttctcccatgacactaaatatgaatcccagatacatttgagcagtaaatgtagattttatgcaattatgtattaattcttctttaatcgtatattttgttataaaatgaataaaaagaatcaaatgttcaaaagcaaccccttttaaagctgcaacacaatacatgttaaacctctgggttggagagaactttctatggttaagagtaatgaaagaaagtataaaagaaaagactgataactcagaagacagcattaacagaaataaaataccaacagtaagctgagaaacattggcaacaaatatcatggaaagggggcagggctggcaacaaataagagaagcaataataacagcaaatctgtattgtgtttagatagttaacatttattaaggtcttacaaagtgccaggcatattctacaagctctacatggctttatacttcatttcattcttacaacaagccctgagatagatcttatcttaaaatttccacattctaaaacactctttaagcggggggcggggggagcagaggaaagtgcataaaatataaatttacagcttaacaaattattataaagcaaatcaccataaagatcaagaaacagaacagatcagaactccagaaattcccataagtccttgcccaatcacaacctctttcctctctccaaaacaaaacaaaacactctcatgacagttttagctgttgctttcttactttcctttatagctttaccactcaaatatagatgcccaaacactactgtttctggagctttatataaatagaactataatgcatatatccttctatatccagctcatggcccttacaattatgcttctgagattcaacctggttgcatgcggcatcagttcatcattctcagtattgtgttacagctttccattctacgactttacaagaaattatccttttactgtcggtggacatttggactgtttccagttggggacaattatgaaaaatgttgctaagaacatgtttttaatgtctcctggtacatatgtgcacacacaaggtatatatgtaggagaggaattgctggctcatagattgtgtatattttcaacttcactagataccaccaaactgtatatcaaagttgtaccaattcccacttccaccatcaatgtttgagagttcctgttgctccacatcctcacaaacacttgacattgtcaacaaagcttcataacttttgcttgaggttttgtacgtctattattacatttagttcaaggtaattgtgtatactactataaattaaatattggtttaaatttcattttctaagggcttgttgatggtatatagaaatataactggtcttttgatgttgatattgtacactgactttgctaatctcttaataattttaatctgtagcttccttagaattttctgcatacacaagcatgtcatctgtgaatgatggtagttttatttcttctttcccaatccatatacatttctttttcttaccttactgcatcgactgggacctagagtacaactagtgagaagagacattcttgtcctattcctgaactcaagggaccactttgagcaattcaacattaagtggatgcttgctgcaggtttttagtaaataccacttatcagtttaaaaatgtttccttccattcctaatttaccataagtttttaaaataatcaatggatgctgaattttatgaaatgctttttctgtatctattatatatgcttttttctcatttattagttaaaatgctaaattacattatttgggtttctaataataaaccaaccaggcattcctgaaataaacaagatttggtcctgatttattacaattgttatatattgctggattcaatttgctaatattttgtttaggatttttagatctatgtctgtaagagagattcacctgtaattttcctttctgtataatgtctttgtgagattttggtatcaaaggtttgctggcctcctaaaactagttgaggaatacaattcttctttggctttcttcatttaaaaaccaggcaactgaggtccaaggtgtttagattatttttcataactgcattaaatccaattatttacttgtatccatgatttattaaaccagcctctttagagccattcattaccttgtttccttgtttcactgttataaacccactgagaaaagcatccttattcacatacaggtttgcacatgtgaacgattatttcctgaggatacattcctagaggtgacgttactggaacaagcactatgtttcacaggaaccagagcagaaagagaggtggcctgtggcacatcctactttagtagctctggctcacattcagggcccttcctcatctcttaaacttgctgggaataccctttaactctgagctactagagactttaatacttaataatatttaaaggtcaactcagctctaagaaactccccaaattaagttttcaaatgatttggcaggaggagcgggttgtttttaacattttcaatggaactttccaaacccacatgaaattatagaaaatgaatgatgaatccccatgtactcatcattcagcttcaagaattatcaatatgttgcataatttgtctcatcccccacattttgatgaagtattttaaagcaattactagacatcacatcaaatggtatgattcatatatatatatatatatatatatatatatatatatatatatatatatatatgaacatatatatttggtagagatggcaatcgcactctgttgcccaggctggtctcaaattcctggcctcaagtgatcctcccgccttagtctcccaaagtgctgggattacaggtgtgaaccatcatccctggcctgattcttctgtattctacccatagttctatcccccctttttgttccaaaattttcattgtggtaaaagttacaaaaaattcaccattttgaccattttaaagtgtacaattcagtggcatttagtacgcattccaaatattttttatttgtatatgtctttattctgagtccatttttccagaggtttattagttttttgtacatatttagatgtctgatttcttttttttgttttttttttttgttttttttttgagacagagtctcgctctgttgcccaggctagagtgcagtggtgtgatttcttctcagcaggtgcagacacttctctgaagaccaacagcagaactgagtctcaggatgggtaaaggcttctgtaaacctccagatccacagccccaactactttcccttcaccctggctgaataccacatcttgaggcaatcaattactaaaaggctgctcacactctctttttccgtaatgagactacttcagcccccttttatttggctactctaaattctccttttatagggatacaacagccctcaatgacttcttgaggaaaaagaagataatcacaaattcagtttcaacaagcaggacattttgctatactgtaccaactaagccatgttcctcaatccagcttttgggagtctgagaagaaatacctctcagagcagggagtcaaggagatatatttttattccaatctgaatactgtactttgtataaaggtggctgatcaggttgcctgtggagaggttgggtggttggacaagaagagggatgtgatttgggcattcctgaacctttggctccttatcctcaaaggaggaaaggaacttgggcaaagtagttaacttctctgcttcagcttcctcaccagtaaaacggagacaataacaggaagtccctcacagggttgtggtaagaattaaatgaatgaacacttgagaagtctttaaaagagtgcctggtgcactgtaactactgtgccatagaatgccatcataacgacaccaatcgcttcgctccaaactctctgagcacccttgtagatggattacctaaaccgtccctcccagactcttcacagagaatttcattaaagtcagtagacttcagctactctctctcatgtgcaggggaaaacaatataatccctttatgagctaaccaaataaattctctcaggaactgcccttgcatgaagaacatacctccagggatgcttgcttagttggggaggtgagtgaggctctctggacctagctgagatggcctggacctaaaggaagagagtagctcaaattccccacagaataactcagaaactttgaaggatgggagctggtaagccaaagaggtgagggagctctagggtcaggcaggaagctcaatggaagagaaatttgagagaaattgttctaatattcttctgtgtagtttgctgatttgtttattttttttttttactttttttccctttttttaaaattatactttaagttctgggatacatgtgcagaacgtgcaggttacataggtatacacgtgccatggtggtttgctgcatccatcgacctgtcatctacattaggtatttctgctaatgctatccctcctctagccccctacccctcaacaggccccgttgtgtgatgttcccctccctgtgtccatgtgttctcattgttcaattcccacttataagtgagaatatgtggtgtttggttttctgttcctgtgttagtttgctgataacaatggtttccagcttcatccatgtccctgcaaaggacatgaactcatctttttttatatatttatagtattccatggtgtatatgtgccacattttctttatccagtctatcactgatgagcatttgggtcagttccaagtctttgctattgtgaatagtgctgcaataaacatacatgtgcatgtgtctttatagcagaatgatgtataatcctttgggtatatacacagtaatgggattgctaggtcaaatggtatttctgattctagatccttgaggaatcgccacactgtcttccacaatggctgcactaatttacactcccaccaacagtgtaaaagcgttcctatttctccacagcctcgccagcatgtgttgtttcctgactttttaatgattgccattctaactggcatgagatggtatctcattgtggttttgatttgcatttctctaatgaccagtgatgatgagatttttttcatatgttttttggccgcataaatgtcttcttttgagaagtgtctgttcgtatcttttgcccactttttgatggggctgtttttctcttgtaaattggttaatgttttactggttagcctttcaaaacaatttctggccaggcacagtggctcatgcctgtaatcccaacactttgggaggctctggaggaggattgcttgaggccaagagttcaagaccaacctgggcaacacagcaagaccccatctctacaaaaaataaaaatgaaaaaattagccaggcgtagtggcacatgcctgtagtcctagctgcttggggagctgaggcaggagggtcacttgagcccaggaagttgaggctgcagtgagctatgatcatgccactacactccagcctgggcgacaaagcaagaccttgtctcaaaaaaaaaatacattcaatttaaaaatgtattgtaacattgtttagtgtagcacacgctcaactaaaaagaaataacttttttcctttttttttttttttttttttttgagacaaagtctcactgtcgcccaggctggagtgcaatggcgtgatcttggctcactgcaacccccatctcctggtttcaagcgattctcttgcctcagccttcctagtagctgggattacaggcacacaccaccatgcccagataatttttgtatttttagtagaaacatggggtttcgccatgttggccaggctggtctcaaactcctgacctcaagtgatctgcccgcctcagcctcccaaagtgctgggattacaggtgtgagccaccacgccgggccaaaaaacaactttcaaacacagaaaggggaataagtagaagtgaaagttccccagcttcccacagtctggtctggggtgttcttcggcttttacacaaacacaaacatatctattcttgttctttttctataaaagttgggtcatagcaggtacgtggttctgatactctctttcatattgtctgctgtgctaaaataaaccctctccactgtcccaaaccttcagcaacatcctgctacttgccttgtgctgtttatgctctttggaccagctgcttgagagttttctgtcagtgaaaggaagaaattatagtttcacctcactacaatcatatcgtaataacagctactgcttatggtacccctactgtgtctggcagtctctttggtgctttacttgaattctcatacccattcctcacaacaaccccttggaagtcagtcccactattatcctatgtgggttcacagatgaaaactcaaggcccaaaaggtaatgagtgggaagttaaggagaaaagcacatatactggaggcaggacttgggcattcagcatctccttaaatctttacaatgaccttaagagggagctgtcaccacaaatgaggacactgaggctgcagagttcacagagcaagcagcattcctgttctctgccaggatgaagccactgagagttcgtaagtacatccatccctttccgtaaaacttgatgaaagaaagctagcaaagatctgaaaacatggagatacacgcagtgctcagtgactgcaaaactcaatataataaagatgtcaattttccccacagttatctatggatttaacataattactatcaaaatcccagagggatttttcatagatacacacaagctggcccagcatggtggctcatgcctgtaatcccagcactttgggaggttgaggcgagaggatcacttgaggccaggagtttgagaccagcctaggtaacattacaagacccagtctctatacaaaaaaattaaaaattagccaggtatggtggcacatgcctgcagtcttagctacttgggaggctgaggtgggaggatcgttttagcccaggagttcgaggctgcagtgagctacgatcacatcactgcactccagtctgggcaaaagcacttgttaggaggagatagaaaaggaaaagaaactctcaaaattcaacagtaaaaaagacataaatattccattagaaggcctggcacagtggctcacacctgtattcccagcactttgggaggctaaggtgagagcatcacttgaggccaggggtttgagataagcctgggcaacatagtgagaccccatctctaaaaaaaattaaaacattagtcaggtatggtggtgcacatctgtggtcctgggtactcaggaggctgaggcaggaggattacttgagtccacatcaaagcttcagtgagacatgattgtgccactgcactccaatctgggtgacagagtgagaccctgtctccaaaaaaaaagtaaaaaatagattccattagaaaatgagcatgaacatgaatagaatttcaccaaaaagaatacgcagatggcaaagaacatgaaaaacatgttcaacatcattagtcactaaggaaatgcaaattaaaaccacaataagctaagctatcattgtacacctataagaatggctaaaataaaaaacagtaataccaaatgttcacaaggatgtagaaaaaatggatctctcatacaatgatgttaggaatataaaatggtaaggctctggaaatcattctggcaatttcctatgagactaaacatgtacttatcatatgaccctgcaagtgcattcctgggcatttatcccagagaaatgaaaacttatagtcacacaaaaacctgcatgctgatgttcacagcaactttatctgtaattgcaaaacgaggaaacaacccaaatgtccttcaactagtaattggataaagaaattctggtctatccacccaagggaatactactcagttggaacaaattactgatacacacaacaacccagatatgactcaaaaggattacatttggtgaagaacgtcaatcccaaaagactacattgtataggactctatttatgtaacattctcgaaattagaaaattttagagatacagaacagattaatcattgccagggagcaaggatggggcagggtgggtatgattatgaaggggaagcacaagggaggtcctattgaacagttttatatcatgactgtggtggttgttaaacaaatctatacatgggataagaccacacagaaaaacacacacacataaaaatgcatgtaaaatggtggaaattaggtctatattctagttaacaatcttgtaataatttcctggatttgatattgtactataataacgtaaggtgccaccgttagaggaagcgtggtttcaggtacatgggactctgtacttttgcaacttccttgtgagtctataattaccttaaaataatttttaaaaataactagcgtggggctgggtgtggtggctcacgcctgtaatcccagcactttaggaggccaaggtgggcagataacttgaggtcaggagttcgagaccagcctggccaatatggtgaaaccgagtctttactaaaaatacaaaaattagcttggcatggtggcacatgcctgtaatcccagctactcaggaggctgaggctcaagaatggcttgaactggtgaggtggagattgcagtgagctgagatcacgccactgcactccagcctgggtgatagagctagactctgtctcaaaaaaaacaaaaaaacaaacaaaaaaaaaactagtgtgggattccagggtggcagaaagtagccttggcgaatttctttgctagacttgtttttcctgtgttagctgtcttccgtgcacagctggggtagtttaaaaattcctcctccttttgacaagttttacaaacagtgctaaaaagaagtgtatcagtgcttctttgtaaaaagcattattatgttttctaaagtgacagttattttaataatatatttacaaataaaaattatatacagatggtgaaaatattagtacttttagaccctaaagagcttttgctaatgtaggttacagatctatcaatatttattatattagaaatcaaaactgaaaaattttaaaatttgtattaatgtatttaaaataaatccactgattatcgtaaataaaattttattaaaataattgcattttcagaaacaaagaatttaggaatgttttacgtttctgaaaatctcttaaatgtctgcctcagtacaagacagctagattcccatatttgcttctgcatttaatgttgtaacatgctgttttggataaagtatatgaagacaaatccaacctcatggagatatgtagttggaaaaaggatttcccagtcacctgaaagggtctgtctcaggtgtctccaggactcctcacactacactttaagaaccaatatgttagagagacataatgaaacattttcagataaaatgttaagatgtcagcaatttgcactaaagtactccaaaacacacacacacataaacagacacagacacacacacgtacacacacacacacacacacccatgtatgtatagttgattcattatttgtggtagttatattctataaagtcacctcaagcaatgaattaccaaataccaagccactgctcctagtggaaatacaggtttagattcctgggagcctctggttgcattccttaaaatgatcaatacacaaccttgttttatgtatgcttctgtctaaagacaccttctttaatatatatttcttaaaataataaattatatgcagtattttatagtaaaacattagccaagaagggtttaacattttcctgatcctgggttaacataaccataaatttctttggttttcaaaagcctcacaaccatgctgtccactatgctttttctaatcagtagttatgaatccacaaattttgctgcttttccatttattccataccttcatcacacactaaagatgttattttagcaccatacagagcgtcttcacatatagactggcaagcctttcctattcctttttctggatgtactgtgttgctgatttattaacattgaactcacagcagacagcgttataactcatgcctgatggaagcctatctaacacatgtattttcctctacagggcacatcactgccttctggctcttagaaacactaggcagtacttcagcactatgattgggggacattttaaacagcaaaatcaccaaaaaagccacaaaaatatggcactagatcgactacgaaaagaacacttgcttacagtatgagagcagaaacaagaacattgccttttctaacctcagctgggaacactgagtgcctgacaactaaattgttttgccactctgtgcaggtctatgaatgactattgaaagcactgcaagtatcgatttggggttatagataagtctgaagtaagtgaacttgcaaatatgaaatctgtgaataataataataaactttttatatatgtatatatatataactacatttatatatataagaatcaactatatatataaatatatatgtagttttatttatatatataaaactacaaacacatatatatccacacaaatgtatgtgtgtgtgtgtgtgtgtgtgtgtgtgtgtgtgccattcaaatgatgagcagacactgtaattgttgaagctggatgataagtatatggggattcattttactagtctaactttgtgtatgtttgtgattttccataagacaaagttttgtaaagtagtttatcttggactgcattgcatttccactttctttaattccttatcagcacgcggaagtctgcagctgtcaaaggtgaagttcaagtgacgttttggtacaaactgccatccaccaccaatccaactgaccatacatccttctggggagtactaatccagtacgcactccctgctataacagggacagtgacaggcagaattgtaacatcaacagctctttctcttggagagaacctctgggtcagaggtaatggaaccctgtattattttgagagcccattgagcccagacaagctgactctgtggaagtgtggttttaatgtgtatgtatggctttagcagaaggtaacttggattctggtccgagggtgtggattccaatcacttaactccagcctgggttgagtcagcaatccagagaaagggcttcagtcaaacaattcttaggagatccagtactgtccaactaaccttcatatattctctcgactctagtacatggatatgcttgacatttttaaagaacaggaggtgggcagacacttcctgttttacaaggcgaagcatcccactatccttgtaagcaagatcagtctgtccagcagaattttgcatctcatcccttcccttaccttctcataaacctcatgcatcagccatctcctctctcccctatcttcaacattctctttctcctaactcttccccatcagcatatgcacactcccaagtctctgtcatcttcataaaaattctcccttgatcttatgtgatcctcccactccatcagatctttccctttccaagtttaacggaaatataacgtgcatgtatggtttccactacttcagtgcccaatgttccagttatatactgctgtgtaataaaccaccccaaaacttggggcttaaaacaataatcatttaattatactcatgactgtgtgggtaaggaatgtgggcaaagctcactagagaattctcctgtcccacgtggcatctactgaggtcactcagtggtatccagctggctggctaggttgttttggagggaccaaaatgacttccgtcatatgtgtggcgcattggtggggataactggaaagctgggctcagctgggctgtgcgttctctctccatgttgtctcttgacctctccatttgatttctccagcagggcagtcagacttcttacatggttcctgagggatccaaaagaccaaggcaaaagttacaggattcttacaacctatccttggaagtcaagcagcattaattccctgcattctttcagttaaacttttgtacagggcccaccagattgagcagtagggggactacacagaggtacagttacttggaggcttggttgataggagccacatgttacagactaccgcccccatgtactcctcaaaccactgcattcctcatcactccattgaaattgtaatctttgaggtaaagacagacctcttagttgttaaatccaatagatgcctgtcagtacttgttttgcttgttttttgtttttgtttttggaattggaccctattgaccactaaattccttcttgaaattctcctcccctagcttctgtatatcacctttccttgtcttttcttcagtctcctaaagtgacttatttcttaggctctccccttatctactgggttttgctatcagttctcttctcactctgtatatgctacctagttatatcaactacacctatagcctcatctatcacttatctactggtgattcctcaatatatatcgccatcccagacttctctccagtgatccagaatctcatgtactcacctagatgtccagcgggtacttcaaacagccaaagcttaattcgtcttccttacacgtgctctcttccttgtgttttctctcctgtatttaccacccgcctagatgcacaaggctgaaacttggacgtcatccttaactctaccatctctcctattatactgaatacaatctgtcactgatccccgaccattcaacttgctaaaaagcttgtcaatttatctattcctctccatcctaaatactaggtctctggcagaggactagatgggggtctcagttcatcattctgatctgtaaaccatatagaaattaacatttactataatacactcaaacacatttttttgtaaagcagaggtgatccagagatatcaggataggagatatttaatgagttaaactccacatggggagaggcactcaagttggtagcaatggcatgttgcctttcggtaacctctagggtgaggttacttcagttcctgggaagccccaactgggggcttactggctaatcaagctccttatgcccctgaacatgccgtcctgaaacatcaattgcatttagtgtgattataaaaactgcctttatcaagcctcatcatctggatctcacatccagattgtgtataatttcttaatacattgccagcacatcgtggctacacacaccacaggttacatcacagtgaccagacagattctggcttctagtaaatgaccaaatagctcctatcaaatccatcctccttcagatgtaacaactatacaccctggacaaaatttttttttaattacctgcaagtattgacaagcaacccaaggcaggcagaaactggaggagaatctacatttaaaagaagagatcagaactaaatgagattcccatttttaagactttgaaccacagggtaggccccaatcaattccctgatgggtgaaccttactgacttgaagacaagaggacagagttcagagtttccacagcagctgaaaactgtggggataaaatcttggaatggagagagccagataggcagagccctgaattctgtgtataaactctaccaaatcactggctgacctctgaattatgcattcatgggacagtctccaaacagtctgtataaggctaaaagaactgactagagacttcagttgctgcctgccatgagggagacagagcatggaatttgagtttagtcaagttaaatgctgctgaaacaaaaatgtcaatacttttcagagggatataatggaatccagattctctagaacatgtcctctgcaatagccaggagacaagtcaaaatgactgaacattgttttgagaaaagtcaaaatgattgaacacgtttcctatgggaaacagaaaaatgtaacctataccaaagaaaaaaggcaatcaatgaagactgaccctgagatgactgacatgttagaattagcagacaggaatttttaaccagctattataatgattcccaaggacacagaggaaaatatgctcataatgaatagttaccagctgtactgcaaccatgtaaagatgagcaccctatagaggtgggtggctggttcacagtctagaaggtagaagagactgggagtggcaagcctggccaggacctacagcacccaccgacactgtcttagttcagattcttattgtttttcatgtagaccattaaaacagtctcaaaaattgcctccctgcttctggttactatttactatgacccccagcacacacagaaaccctaaacacatctgcattgattccagaattacctatttgaacacagatttaattaggactttactgattccaagtaatagaaacaccatttgggccacagagtcaatttacccgaagtttcacataatcataagtagatgagcctcaaggacaagtacaatcagagactcgaacatgaacaggaatctttcaattgctcctcctgtaagttcacttcattctctgaaacaagtttcctccccgtggctgtaaaaagggccaccagcagcttctggccacacatctcctagctgtgccacaaaaccaagaggcaatattttccctcaattaaatttttaaaaattgaagaaaaacattctgattgtcctgacctagaccacatgccacacctcaaccaatcgaatcaactgtggccagggagacaggtactatgattggaagctctcatgagcactgaatggctagacaggagaggagcagcacaccagagtcacagaggggttcatttccaaggcaaaggaaggattctgggaaaagaaactgtcaaatgataaaggtctaacaggtttcctgtggttgccacttcaatgtgtggcaatatcatcctccacgcaaatgtcagtgtcctgggatttctcttacagcagagacttctgttgttccccaacatctgttctccccttccccctacccagtattttactgcttgaaacataaatgcaatgaccagaggacaagtgtcacacggtggagacgataggacagaaagtccataagttattttggatggctaataactcacagctgaacctgatgctaactgacaaccccctcactccccacatctaatcaaggcaaaacaacactgaagttaagagtgtgggttagagccaaaccacctgagtttgaatctaggctctgccacttactagttctgttcagcatattactttatctctctgttcctgtttccttaggcataaaatgatgttaatgtacctcataggtgggttgtgagaattaagatcattcacgtaagcacttagaacagtgctcaatgagtgttaactaccattttcaaggcgtctcaattttacctactaaagatcttggaagactgtgccttctttcacagcccaaaagccactttccatcacttcaatgagtcactgcctcctccacagcgtcctccacattgcctcagcctgacctttctgaaacaccttgatctgaccatgttactcctattggaaacccttcaatgattcttcctttcctacaaaataaagccttaactccttagcctggtgaccaaggttccttgcataagagcccgaatggactttctgggctcatctcctgccactcctccatgatgccccaaagcccagccacactgaattactctctaccttcaacttcctacctgcctctaaagtactaaccactcccgtgttccctccctcctgaactctttcctcccttggctgctgtggcaccacaccctcctggtttgcttccaatctccctggctattctttttccatctttctcatgggtttctcattcttcagcccatctgtgtcaaggttcccaggttccatccttagcccacttcctgtttcactgcatgtcctgcccctgagtgatggcatcccctggcaagcttctaagctccaccgacagcttcatgatccccagattttcactcctaacctctttcctgagttttggtttcacacatcctgatatatcacaccccctgaatagacacctcaacctcagcatgtccaaaaccgaactcgtgtttcccaccccaaacccacttcccctctttactctgaacctgttgctggcaccaccatcacccaagcctggaattcttcgatctccacatctaagaaacgaccaaatcctaattcatgtcctcaataactctccaacctgtcttctctccatactcactgccattgccctcgttctggcctaaatcccctctagcacagactctgccacagtcacctccctgcctgcctccactcactgctccaatccaatgggcaacctgttacccacctccagcgaaaaactcatcatgtcactgccctgcttgaaactcttcactagttcccactgctcaatcagacacaattattctgtgcctcacagtagttaaatatctactatgtactggagcctatgctaagtatgaggaatgcttgaaatggctgctgccttttaaggaatttaccatctatctgagaagacagacatataaataaccactaataacatgatgcaataagtcctgtgatagacacacccacagagtattacaggagcacaagacttaggggtaggaaccacatcttcctaatctttgtatctccaatatctgataccaactttgattaactagagaattttatttgaatactgaaaagatgcccttctctgagcctcagcttcccactatataaaatggctcacaactcacatatcaaaatatataattatgtatttatgttacatataacacacacattatatatgtatacaatatgcatacacattatatatgtatataatatgcatacatattatatatgtatatatgtctgacatagtgccggaagtctcaaaagatgtcagttttgcttctcccctcacccctttaactccatcatgggaggcatagcagaggaaacggcaggtcagtgatgtaagaattagaagcccaacaactgaagaactggaaacagcatcatttctgtcctctgtctggtaatgacagaatggctggagcactaggcagctccaaaacagccttgggcaggaacggcagtgctccaagaccatcagaacaaagggaaagaaatcacagcttgaactttcgtggacaggagaaaaaatctgacgtggacaggaacatggactcctggctggaagagggctgctcctttcctccgctacttgaatccttctgcaatatcgccacctggtggctatctagcatccctttacttaattccccagtgcagtttgctctgacagcccactgcactgtgaaaattctagaagggaacagcctcgctcagtgaactgtttcggaactgctcaaagttaatcatatccttctccatgtcctgcaaagtgtcttgtactcaagctctattatagcacctctcattgtattataaatgtttacctgtacgcattcattcatgcacccaacaaatttgtaagtgtcgtacctagaacagacaggcagaggagaaacaatgatgaacaaaaccagttgaccatgtaaagaattaaacatgtacacagagaattaaaatagccatatttccaaccactataaaataattattataatatttaatatttgttgagcactgaatactgtatctgtattatcccatttaatgctcacaactcagtgaggtagataatatgattatcctcgtgttacagatgaagcaaaagaggaacagaaaggttgggtaaattgtccatagtcacacagccaggaaatgctagagctcagattcaagcctgccctgggtccagaactcatgcaatagttaaaaacaagcaaacaaacaaacaaactactgtaacccccgcctcaatgcatgtttgatgattcaataaataaaaaccttgtacctcccaaattcaaggagataaaagttcaggtagtagaatctcctagtaggaggtttagctgatcaggaacttgactccatccctctgaatctcacctaacccctggagatacgctctgcttgatccctgcctctactgtagccctgcaccccccaagccccaaagtgagtgctcctcctttcatgtgtgaacaaacataaacctgaaaaagccaatccttcaagatggatcttgagcagctcactgggcctaaatgtaaaataaagccaacgagccatttgccgactaggggtcacacacatactctgagttccctgaaaacctgcactcttttatctttcagactttcagtgcttccctgaaccaaccaatcagagctcatcttcctcagccaatcagagctcagctgtgttgaccaatcagggctatgctatatggaccaaccagaactcagctgcattgaccaatcagaactaaccatgcttcaatccttcgttataaatgtacttttgttttacactggaggctgtgactcctgggtttgcaactgttcactggaagtctctttcttccagtctccttttcagagaccttttgttcacagatgttctgtctcaaatatagaccaaaaaaaacaaaacactccatatgattcttcctaacatgatggagacaagttggcattttcaagatgctaccaaattctaaaagtgaacagaacagaaataaatttcagaacgcattcaaaaagtttctattttgaccacactcacacggtttttaggctttgtgcatttgatatttggatttatggctagactcagagatttaacatgtggctgcccaccagccagcatagtggttcacgcctgtaatcccagcactttgggaggctgaggcaggaagattgcttgaggccaggagtttgagaccagcctgagtaacagggagacggcgtctctacaaaaaaaaaacaaaatttagccaggcatggtgacgtgcccgtacttccagttactggggaggctgagatgttaggatcacttaagcccaggaggcagaggttgtgaaaaaggaaaagttctctcgtaccccttgcagggtgtgcaatggggggtgtagctcacttcttcagtgccccactgctcaaacctctatgggagcatacagatgggctgggagccccacggcagtgtctaggggtgaatgtttacagctgaagccccagtgggcgtgtgttacagggtgttcttttagtttagctgcctgtaggcagcttgtgttagctcaattcgacccctgccttattgcaaggacagagagctttctgtatcctggagttcttgccttggtgtactggaggaatcagatcacacgtgggcttggagaatgagttcaagattttattaagtggaagtagctctcagtagacgggggaaccagaagggagatggttttcctctggagtcaggctgcttgcggcccaggttttttctgactgccctagccaaactccgtgtcgttctgccgctcaatggcctgccggcgtgctggtaactgtcgatgcgttcctctccacatccagccacctgtgtgttcctccactgatgtgctcctctcaatgcccagccacatgtgtgtctgcctgctagcgtctcggggtttttataggcacaggatggtggtatggcaggccagggtggtcttgggaaatgcaacatttgggcaggaaaacaaaaatgcctgtcctcacccaggtccatgggcataggcccgggggtagaggcctagccagggaccacactcttccctccttccatatcatttaaagggatcatgctcttcccttcccagtacttccctttccccttccctatcagttgcagtgagctgaaatggtaccactgcactccagcctggctgacagagtaagaccctgtctcaaaaataaaaattggctaggcgcagtggctcacgcctgtaatcccagcactctgggagactgagcccagtgaatcacttgaggccaggagttcaacaccagcctgtccaacatggtgaaaccctgtctctactaaaactacaaaattagctgggcgtggtggcacatgcctgtaatcccagctacttgcgaggctgaggtaggagaattgctagaacctgggaggtggaggttgcagtgagccaagattgcaccactgcactccagcctagacaacagagtgagaaactccatctcaaaaaaataaagataggctgggtgcagtggctcatgcctgtaatcccagcactttgagaggccaaggcgggcagatcacaaggtcaagagatcgagaccatcctggccaacatggcaaaaccccatctctactaaaaatacaaaaattagctgggtgtggtggtgtgtgcctgtactcccagctactagggagactgaggcaggagaactgcttgaacccaggaggcggaggttgcagtgagccgagattgtgccactgcactccagcctggcgacagagcaagactctgtctcaataaataaataaatacataaataaacagataaataaaataaaaataaataaaataaaatgtggcttttagtaaacactctatgcaagacattgtgctttgcactattgatgcattctctcatttaaacttctcaccaaacctgtgaagcaggtagatattcccattttacaaatataataggaccaaagagataaagtaagtttcccagggtcacacagccaataagcagaagatctggcatttgaacttaagttgtctgacatcaggtcttgaattttttatgactatgatatacagcctcccctccttatttatttatttattttgagacagagtctcactctgttccccaggctggagtgtagtagtgggatcaaggctcagtgccacctggacctcccaagctcaagaagcaatcttcccacctcagcctcccaagcagctgggactacaggcatgtgccaccacaccctgataatttttgtcttttttgtagagacaggattccgtgtgtgtgtgtgtgtgtgtgtgtgtgtatcacagcatagtttctggctttctcccagggataagcctggcttttattcttgcattggttcagtgaggggatttaattacatataatctccatggcttgtgttaaattgaactacttcttaccacctattttcttcaactaatcacctcttgctcactctgtagaactaggttaaaactcatagctcctgcaagaagccttccctggtctctccaattaccccctttaacattggtctctcccaaattcattctaaaggagaggtccaagtctaacaaattttctggggaataccataaacagtagaggaaattggaagtccatctctggggaaaaaaatgagctcaaacgtatctccagatgttttcatatgtctatgagcacagaaacagtctggcagggacaaaaatgacatggtctcactggctgcccatagttctcacccactggcctgcttgtgaacacagcccagcctccacccaggacagtcttttagagtcctgaagagacaggagaaggccaccttaagcattttttttggtcagtccaaatcctgcccaccgctaagaagttctgacccaaatatacacatatatcaaaattattatttcatacggagatctgattatgccccaggcaaaacagaaacttatgagtaggcattttcagaatggcagagtaagaacctccaaaaaatctgctcctcaaatcagcaaagagaatattggcaaaaattgttaaaatcaagtttttcaatattctggaaattacccaaaagcttgcagcgatctaaggagcatttattcaagaaaacaactgaatcttagcaagaacactgatctttgtggccttttaacttgccctattcacatccccctctcttttgctcagtgatagccttgaaaaccagaagcctcgcaatcgcagtaagctgtgaaatccagctgctgggacaactggatatgcgcctggaaaacaaagctgggctcctactttacaccacatgccaaacttacctgaaaacaaaacaaaggcataggaaagaaaaatgtaaaactcctagaaaacacaggtgtaaatcttcaaaaccttagacattcacatgaatttttacaataaaacaagtgactcagacattttgtaccttggcccataaccatgtggtcagttggtagccatactcaacatttataaccaatatctctgaatgctcactgattaaacaattccaacagtacaaggacttctactactctttttttccagatagagtctcactctgtcacccaggctggagtgatcatagctcactgcagtctccaccgcctcagctcaagcgatcctcccacctcagcctcccgagtagctgggaccacaggcatgcaccaccacgcctggctaatttttgaattttctgtagagacagggtttcaccatgttgcccaggctggtctccaactactgggctcaagcgacccacctgccttggcctcccaaattgctgggattacaggtgtgagccaccacacccagtcctaggacttccattcttacctacagatagaataggttacccagcaaaaactattgatgtatataaaatctaaaatgtggccacatatggagactttaaaagtgaaccagccttctcactactatgcttgactagtcttttaaaagaaaaaggttcaggatcagcctgggcaacatggttaaaccctgtctgtacaaaaaacacaaaaattagctgggcatggtggcagtctcctgtagtcccagctatttgggaggctgaggtgggaggattgtttgagcctgggagttgaggctgcagtgagccatgatctcactgttgcactccaactgtcaacacagtgagaccctgtttcaaaaaaaactgaaccagtttctgccagattaaaagaatgaaacttccatacatgtcattggaaataacactgtgttttcctctcacacaatgagacagagatgagcaaatgtcttttcaatctctgataactaagtactattaccaaggaagattgaacagctaaacgtcttcacagtttcaacactaacgctagccacgtgtcatatgttaaacacctcaaataagatatactgaggcaaacattcacataaccaaag

SEQ ID NO: 833 - DNA, 264828 bp, Homo sapiens
cagtgagtaagcctaattccaaaacagtgatcctaacgttggatctgttttcacatatttatgaaaatatgtttttatgaatacatctatatatttataaaatctcttcatttcctgtgtagttttaatgtttcccaagcctatactttaaattactaaattttttatagggttgattatgttccttattgtttcctattgattttagagttattttttagtttctccacttgttaaatatctgtggtcacttttgttcttcagccactactgcagaacctggcaacaaatactacttagctagttgtctttgcttgctgtattcctgttctcttcccttctatgttatagagcattttacatattggtgctatgctgttattatttgtttttcttctcgtttattttgaattggggccatggattgtccccactgccaaaaatagatgaatacgttttccttgatatctctgttctaggaaaatctttgacttaaccctctctctccactttgaacagtggttctcaaacatggatgtgaaaaagtacagagcatcaatcacccctccagacctactaaagaaatcttccagttgcagcttcagaatctgtcttttttagcccaacttccagaactggtctgcatatttttttggaccaatgccttgaaacatgcaccgaacaatttgcacatttattgtttttattctttgttcagtcatttagctcctttatgggaacagggggcttgggggacagtgaggagatatctggggctgtgagtagttgcagtcaggaagtttttttcttagttgttggtttgtttcttagttgctcagtttgattttttggctcctatgcactggcatcagcagcaccgtgttgggggcatgctctcatctgttggtgaagaatggcctttttgtgtttcagtttactccctctcaaagtgagaaattcattttcataaaaagtccagggttgttgaggtttttgttttgtttgaccctatgtatttttctgtgcagaaggctgtggctatgattctcaagagattgcttctacttctctctgatattctgtctgtttagaaggaagataaactacaggttggcaggtagttagggaggcaatcacatcggttgtatggctttgcatcttgtccagcatttagtttctcaggaatgcttatttgcagtggagaaacaagctccacacagtgcagcctacacttcctccagatctgctcaagtctaatttccttgcttcttcaaattggaatatctggaccaaggtagtgataggggttatatattgatttttgagtcttctttcaatctgggccaaattatactggatctgaatcatacctcaagaattatattgattaagactcagttttgtttcaagtttcagcattgatgaatcctttctgttcattttggttagtcacagggtgagaggttttataagccaacactatttccgcttgctttcccatagcttattcagtatattgaaaaattttcaggaaacaacagcaaaatcctacataatattccttgttgaatatcaaatttctgtttttgactttccattggaataagtcaggaatgtctacgtaagacaatgcttgagggtaaaagatgagtgaatgcggagatctttgtgagattgagatggctggcatcagctctgaagccatgcgatcattaatagtaagtttctgctctgccatttacagatgctgtaatctgaatcgatctttcaatttgttcaaaattcagttttcttttaactttgtaaaataaaaataactcttgttactacatgttgggacatttttaacagattaaatgtgataatataaatctgaagtattgagcactgtacctggcatagaatgagctcattataatatcagtctccttattctttcccttgtctaaccatcagtggtgagaaacagctgttgatttgccaaaatatatgcataattttataaatgaaaacatccaaaatctctttgggtggcctattaaggaatgagctacagggtttttcacctttattactattgacattttgagacagatagttctgtgggcttttttgagggggtgtcatcttgctgaatttagaatgattagcagcattcctagtttctattcaatagatgccgatagcaccaagagccatcccagttgtgacaaccaaaaatatttccagactgcaaaatgtcttcttgggatggggtgcaaaatcacccccaatctgagcactactgagctagaggaatgaaaaggacattgtgttggaagagggtagggacttaagctttgaaatgttgttcatagcttggaagaggcccaccttagccgtttctgccattgggtgaactaggctttttgtgcctaggtgttagtgaatggatgtcagagcagaaggtaggagacaggagaagagtcttctctatttagagggaatggaaaagatgcagggcagtgtcagaaggtttcagatctctcatgagcaaatgcaaaacttctgtgttctcaagaccggaaacacatttctcagccaagggaagaggctaattgagaggagtgatcgtggctcttcttcattttcttagtaagctcctgaaggtggcaagaccgcagaaaagcaatgcatttaatacctcagggacttgttagtgcctgaaattgaacatggaggcattgggatgatttcattgtgcctcagaagttattaaactgagtcaggcaagtctgcactctggctccccatgtgcaggtgcaagcagtggccccagtggggatccgagggcagttccctggctggtggggtaatgttccaggcaggaacacagctgcctctgctgcacaaaaaatctgcctgaaaagtgggaggcagcaggttgtaataagccccactcagctcccacacacttggcaagtcagttttcatacccacagtgttctgctagcagcagcagctaactgggtttcaagtggcccgtgctcagaatttaaaaccatcccaggccataagctttccctatggacacagaaaccatatctttcaggctgcatcctttccagtccacctgtgaagcagggccatgcagctcatgtgccttgttgccgtagcacacttctcacttgcccctcggttctggccaatcagctttgtccttactaaggattatatcacaaatcccagttgggctcttctctcaaactgtgactgcagcctgagttagacttctgcaacgtcccgtgaggtgggatcaggaatggcttccctccattcttgctggaatctgggtctgcacacaaagcatgtcccgatgctgctccttcttatatattccttacttttcactgaatcacctctagagctgagtaggtttgaagtcctccctcatgacttgtattgcctggctcgcctgtgggagtatatgtcatgacagcaatctatccctctctcatgctctggggactaatggttttccatctgttttatgatgtagtctgttgcctgccacttcattcaaagggtctgtggtttctttcagtttttctgttaagttcttacattgtttcttcgaataaattttacagcatgaatctctacatgccattttgtcttaccaagtgggataagtatgcttataatgcttccaatctgccatcttggaaaaaaagaaaaaaaaaactttaaatattttgtctgtaatgtgctatggaagagaccttttcacattgtatctgtttaggaattgatgggcctcctgtatctcaatgtctaagtgtcttgctcgacttaggaagtgtcatctattatttcaataaataggtctttgaaaacatgttttctctctttgccttctgggctatcagtgatttttatatttggtcactttatgttgttagatagattccaaaggtttattttattattttctttttttctttatttttgtctgacagcgttatttcaaaaaaaactgtcttcaagcaaaatgtgatcttaacataagtcagttatgattgagtatattgttgaagctttcatgtgtattttttagtttattcactgcattctttggctccagaatttctgttcgttccttttttatggtctctatctctttggtaaagacagggtggcagtggccatgctgctgccctgccactgggtgttggatgccaccttcagtgatggcagtctaggccagtgggtgaaaaacacatgtgccacatatgccttatccccagtggtgctcccacctcagccccaggtgtggtagcccatgaatgctcatgtctaagccccaggttaacagccagctcttcttttgcatctcagcctcagtgttgcttggctccaagacagtgtgcagtctgttgggggtgaggctctaagatgctatcttgcccagccttgatgttcatgtctttcccttggttgcagtagcctgtggtcgctcatgtctgaatctccagggaaacatcagacatttagtttgcacctaggcctcaatgccactgggctccaggacagtatgtagttcatcgggggtgaggctctgcagtggtgcctcatttgtgcctcagtcctaaaagcagcagcccacgccttcgtcccacctctgcaccagatgctgtagtctgtagtcactgatgcctatgtccctggggcagcagttcgtgcttctcttgcacctcagccctgggctactgggctccaggacagtgctcagtctgttgagggcagggctctaaaatggtactttgttgtagctgcttaagtctcaagaagtgtgagggacccagcgggagctttctccctgaagcagtgccatcatacaatctcctggcagctttctatgttagtttcggggcccatgatggttgaagggatctcctgtggctgggattataggagtctatagtgagaatgtaaactactgaggctctctcacctatcctttctctgtatttggagtctctcagctcacagctgatcctggatgagcaggctgccttgattccctctccatctctgctttaagtattgcctatcacttttctaatggattccagtgatttcctttgaattatatattcaaagtgtgattatcgactcaccgtttggttatttttaatggagaaagtgagtacaaaatgcctctagtctgccatattcatggtttccaagaaataatttttaaaggtttttaaatattttatgtaattataatgattatgggcataagaaggattatggagaagaacggagcaaaataaaagcttcattcactctgctgtcatatttgattatatcttgaggtcaaattgatctttgctattgtcttggctgccggctctggctacagctaatcctgggcaggctttgcagctcctaccacttccaggcccacagctgcaatcccaagcttgctcaccaaaacaagtgtttattcattatatcttcagtagattttattttataaatatgaattgtttatatgcatttctaatatgtcaaatgctttactagctttttaatatctttatatccattttccctggatcattacttactgttcttaactcagtggttcttaactggaagagattttgccacttaggggatacttgccaatatctagaaatattgttggttgtcataattggtggcagcagggaatgctactggtatttaataagcagagacagagatgcttctaagcgtcttattggacaaaggacgacctcacacaagaaagaattatactgcctaaaatgtgatggtgctgacagtgagaaaccctgagtttaacataatttgctcagaactctaaaaatgattcactttccaaaaatttgctgcattttttcttctggtcagaatgtgcacaatggaaattcttcctgaaggatttgtgtgaggagacctattctatagctgttaaatgattggcagggaggttgatagatggaggtgaagtcagccaaaacttaactgatatttaacagccaggaaatacccaacctggaaagtattcattcatagcatcacaaaccactaaagaaaagtgatattttacctctgagaaagttaacagcaaaagtatagtctttctaattagtttttagcttgcaatctaaataaatgacaagtagagaatatcaggtcataaaatatcatttaattttaagaaatattttcataagaatattgacataaaagtgatttaagaaagtgaaagttacatttagcacaagattttgcatttttcaaaagtatatgatattggaaaaacatataattacatattattttgaatttgttctatgtagcaaactttgttcagacctctttaagaacatttcataaatttggcatcattactaacatctccatgttaagaagattttcacagaagcaatattttcttgtgtctctaaatgggagagagtgcctctcctcactaaattgccatattaaagtggactgttcagcatttattttcttcaaccattctgtctaaaattcagcctgatgtattagcattagcatgagtcctcctgcaaaattggtcagtgggtagttatgcttttgtgtgtttttcacatcaaaaaaaaaaaccccacaagaacaaaaacaaaacaaacacaaaaatgctcagtaaatagttaatgaataaattgttctattcaaggggattgagaatggaccttgctccactgcttctttttttttctgtattttcaacatctgcctttctactggctaattaactatagtttataaatatgtttaatattaaataaaaatttaagtaagaggaagcatcaggaaccactttaaaggtgaattgtaaaaaataatgtgataataacttcactctgcttttccttctcacttcttttcttctttcttcttttctttccacttaagcctcacaagagtgaagcttcttgtctgtctcttcttacttaccagtcactctttcttcaacctggtgctctctgactcctgtctctaccactcaaataaagctgtactttgcaagaccatcaaagccattttaattatcaaatccaaagactccttttggatatttcaggtctccaaacaaattgcatcttcttaaagaggaatttcctgaccacctgagttaaatctcatgacattcgcaaacatattgccgtattttacattcttgatagtccctagtacttgatcaaaaagctatctatagttattatacatattacctgggtgatgaaataatctgtacaccaaacccccatgacacagagtttacctatataacaaacctgcacatatatccttgaacctaaaagtcaaaaaataagaaatcaactgtagatatttgtttatgtgtttattttctttctgcccccactagcataaaatattattgagggaagggactcagccttgtccaccagatcctaaatgagacttagtagacacatattaagcattcaagtaatatctgtttactgactgggactgatcaatttgcctcttacctgacctctctggaacatttgtcaatgatgaccgtttgcttctagatgccccttcacggcttttgaaatagtacccttccttttcagtctattttgctaactttccaatatgatgtgatctgtttgagaaaagggactgctattagcatatttgctggcacatgaaggactcgcagaacactcataaaacatccttctatttgggcttcagtatgaaagatcttaaccgaactgtgtgtttaaaatgatgtgtattgaaagaagtattatttttgggccacgaaaatgcctaaatatttctagtgtgataattaggtattgagaaagttggaagtgtatgaatatttaaattgcttaatagtatgaactgtagtgttttggtacttggttcatacaattacttgactgaatgctgtgcagccattaaaattatattacaaattataatattaagataaacttaaattatttgttataaattaacaaggcacgacacaacattatgcataaaatataagtacaactttataagatgtatgcaacaatgaaaactagcaaggaatgaaacttgctcattttttgtttcaatgattttgttgcattgtttcaatgaaacaatgaaaattataacagactgtagtagcagctgagtgattttatggaatttcagatgtctgttcttacttttccagattctctgtagccttttaactatcgtatattttaaaaacaattcaaagctgaatacactttaagcatcctgtataacttggaatgaacttgtgatgaaatgtcagaagaggttagtggtaggtgttgtcacgtttgttcaagaaggagaggttagtggtagtggtggcatctttgttcaagaaagaaatacatccccttttattcatggcctttgtgattttctttgtgtttaatgtattccacaagtagattctcctctcaaggtatcgcaccctggaaatataaataaagacttaaattactcccatgaaagtgacttcttctagcccacacagtgaatcactggcagacccgggaatgaaacctctcaatttacactcttagacttcataaacatccctaaaacacttcatctctcctacattgttagctatataacattgttagctcctacattgttagttctacatttattagactataagtcttatgttttccctttgattgctattgctctaggtggcaacaaaagtcattctaacttcacttataagagccaggtttgtttgacacacacattgtggagttcattaaattattgcttcttctctgtcatttataattttgagaataaatctacgttcttgaaatttattgcacctgcatttgcagaggcatagagaaatgtggcaatttattcataaaacgctttatcatgtaaatgaatgatggccagtctctagttcacaagatgattagagtaacagaaaacacacaaattccagctttatacatacaacagcttcaaggctatgtagttagaaaaatatgattggagggttgatctgagtttaatgtatgaattcacagcctctgcaggctgtcccttactctacaggagtaaggccatcaacctgtgttatagaagctactaggccggagtacatctttttgtctctgcgcacaagaatgacttgctatcagctaatttagacaacccatatactcccttattagtggctagctacatatttttgtattgtttctgacttgaataagtttattgtgcatacattgtccaattatagcaaccttgagctggagagaaagctcatcttctctaaagaatacgtgtgagggaaaaataaacttccttcaaactatatatcaccccatgaacagaatgctcctcaagcaggtatacaactccagaagaaatatcagacattctcttaagaaattgaatgactcaagagcaaaaactttgataccatttagatgattgccagcataatccctacccagataatcaaaggcaaatccctctgattagtaagccttgcccacataccaagcgtgcccccatagggtttttgatgttagtttgttttcattttaaatattcaaaagagtatatataagtgcaatgtaaacaagcagacagacaccttcagaagtcttaagaaatataatattaccattaaattaaaaagctttccatgtgctctcctcaagcgcatcccttatccagggattgccaccacgttgaactttgtagtacttattccctttctcttctctttggagtgtatgatgttaatatccctcaacaatatattttgcagttgtccctgattttgaagcttatacgtatcatgtcatactgtgtaagttattctgacacttttccgtccgatatcatgtttttgaaattcaatcctgtggatatgtgcaattatagttcacttagttttactgatgtacagcattccattttatgaatacactaaaatctatgtattaatattcttccagtgggcacttacattgcttggtggcaaattttcaaactttctattgtctgaatatgtcattgtttcaccctcacatttgaaaaatatttaaatttggcgtatgagtttagcttggtgggcctaatcccttctcattcccttgctgaaaagtcagctctcagtgtagttgcaatatgtgaattatcttttccctctgaattcttttaatatcttctgtgtgcctttggtattctgctgtttcactgttatgtgtttaggtgtgcatttgttttcatttatttcacttaaaatttgttggtctttctgtatttgaagtttaatgtcttcaaaaattgtggaaaaacatcaattatctctttgactatttccttgactcctattttctagagtctattgagattttagttacatatatgtgagaccttctcactcaatacaccacatcttttaatttattttttataatttaatctctgtttttattaggcagtattccagataatttcttcagattattttcctttccaatttaaaatatctgtatagtatttgcattaacgagaaatttttatttagaagtaataaaaaccaatgccaacattaccaaacatatgattcagccttctaggaaagttttggaaataccctctagtgtaattgaacattttttttctcattagctcacaagacattttatttctcaaaagtaattggtaatttttttttaagcgctaacgttttcagccattctaggatatagtatatgtttactgatacaatattttcttcattgatatttcctttgctagttcttctgcatcagcattttgagtaatataaaaaggtagtctgaggcactttttcgtacttggtttaatttaggtatgaataatgtaaagtgatgatttgtaggaaatctcaaaaataatttcccaagttttgcagttagtgccaaggacattttgcaaatgtacttataatttcatttagatacaaataaagaactaaattaaaagagaggtaaaatgcttattttctttggagtgcaaaacttgcatacagatattgattgcgtacaactctgtttatagtgataaatgagaatagtctttatgatggtagaaaaaaatttccacacataacagcaaaacttttcataaggctttggtaagaaatatatgataaattatctttaaagtcttatatgccaatattaagctttaagttttgccgaataaaagtcgtaaatatcatcatttcagctccagtcgtatttttaacaaagggatttatatggtgacaaaacagaagttatgcttgaggtgtaaatgtattaagtgaatatatctctactgacattcaacttctatgagctagctaacctttaaatgctaacaaatttgccagtagacacctgactcccatttatttaatgttttattatagttgttatgttgtatgttgtattattttagagaaactaatagaattagttactatttaagagttacttattttgttgtggttgtattaattaagctcttataggggagaaaaagctctgtaaagtagaatagtttcgttgaaaaaggatttatgggcaactgtttatgaccaaatcctggcacttgcattcattagctgtatgactaggaatcttttctgcacttaagtgccctcatttgtaaagtggatattataatacatatgaatacatatgtgatagaggtatagtgaaagtaagttaaataataaattttaagcatctaaaacagggtctaacatcatatattgaaaatgtattatgttttagttgtgataccagatgctaagatacggagaggacagacagctcctagcacataataggtaagttcatttccaccaatttagtggttcttggtctttattccgtttcagattcagatctgcactgcttactcaacagccagttcccatgtgtttttaaattcttgttgcttcctcaccagtgtttttttttttttttaaataaatgtgttccagttactttccactccttttccaactgataggataatgtacttatgcattcagaaatctacagttgctttctattacaattgattacacctctaaacttgctggcctaagagggggagtgggtgatgagatttaacaacaggcgagttgctacaatatacaaatctctatgattggcagtttactgtgagtactgagactcccaccttttctaatagtcttgcctccttaagggatcctaacaggacaatgagatgaaaatatttaatagtacagacaaagacgctacctatgttttcagaaggcttgtaattctctcttaactcacaaactcattttaattatttattgtgccttctctttctcaagtccccccaagatggtaacaaaactaattatatctcatcatttacttttacagtatgttaattctactctggttcaacaatatctcaacaacacaatatcttcattacctagaagagtaagaatgtaactatgtgcatccaagtttttgcactgactttatatataatttgacagttgttgtcatttaatgagctccattgttaaattatgataaactactgttgttgctaactttagttcttctggaataggtcatattactctcattttatgggaagctgtagtttacttccactggacaaattcttgagtctcatttttctcattcataagataatgataatggtacctgtttcattgggcttatagaattaagtacaataaaataaaagcaattaccccagtgcattatttactatacactaaatagatggtaatttcacatgaatgagaatatctgaataaaatcccattcacctatattatgtattagatgaactttagaatcatagaatttagaaatagggcagtatgttgggaattctgtactctagtgatttccaactgtgttgtaggacacattgggtttctgaggctgttgcatgagaggagaacaagcacttgttaccctctttcacgttattcaaccaaaagagttgtagatttcattcacatcataatttcattaccttatagagcacttattgggcagatttacctcattcaattcatgatacaccacataatctgaaataaccaaccatcccaacatagcaccttctgaagatgttcataggtcattatggatggatttcttaatcactgccacagtccagtcatagttatagatatcaaatgcttcagagaagactgaatattccaaaagaaagtatgtgtaatattgataagtatgttctccaaaacaatgaagttcaattagaaatcaacaaagaaataaatttgtgaaatacacaaacaattgaaaaattaaactacacatttcaaataacccataggctaacaaataaatcgtacagataattagaagaatgtctttagctgaataaaaataaaaccaaatatcagaatttatggggtctggctaaagcagtgtttagagggaaatgtatagctatgatgcttatattagaaaagaagaaagatcttaagtaaattaatctcaacttctaccttcagaaatagaaaaagaagagcaaattaaatccaaagcatacagaaaaagtaaatataaagattaaagcagaaattaataaaagaaaaaacaaagtaaatacagaaaatccatgcagctaaatgttgattctttgaaaatgaaaacaaaattgacagccttgtacctagactgaacaagaaattaggagagtggatattgcatagtcaggattatccagagaaacaggaccatcaacagggtatgcatgtgtgtatgtgtatgtatacatatgtgtgtgtagtatgtatgtataaatatatatacacgcatctatatgtatacatatgtatacacatacatgtgtatctaaagaggcagctatatagagagatatttattttaatgaatggttcacttattattctcagaactggaataagacaaggatacccactctcacaactcctattcaacatattaccgaaagtcttagccagaacaatcagaaaggagaaaaaaaaatgaaagatgtagaaacagaaaaataagaagtcaacctatctatcttcactgacaatatgattctataaataggaaaccctgaagactccaccaaaaggcttctagaactaataaacgactttagtaaagtttcaggatacaaaatcaatgtacaaaaattagtagcatttctatacacaaataacatccaggctgagagtcaaacgaagaacacagtttcatttaaaatagccaaacgaaagtgaaatacctagaaatatatctaagcaagtaggtgaaagatctctacaaggagaactacaaagcatagagaaaagaaatcagtgacaacacaaataaatgaaaaaaaattacttgtttatggattgaaagaattaatattgttaagatggtcatactgcccaaagcgatttatagattcaatgttatccctatcaaactgccaacatcattctttacagaagtagaagaaactattctaaaattcatatggaatccaaaaagagcctgaatagccaaagcaatactaaggaaaggacaaatacctgaggtgatgtataccccatttactttgatgtaattatcatgcattgcatgtctgtatcgaaatatctcatgtaccccataaatggatacacctaatatgtactcacaaaaattaaaataaatacatttatagaaagaacaaagtcagaggcctcacattacccagttacaaactatactataaggctacaataaccaaaaaaacatggtagtggtataaaaacagacacacagaccaatgtgtctcttacagaaaagaaaactcagaaataaagtcacacacctccaatcatctgatatttgacgaggccaacgaaaacaagcagtggggaaaggaccccttgttcaataaatagtgctgggatacctggctagccatatgcggaagaatgaaactgaaccactaccattcattaaatatatagaaattaactcaagatgaattaaaaatttaaatggaagacctcagactataaatatcctaaaagaaaacctaggaaacactttttttgacattgactttggcaaataatttatggctaagtccccaaaagcaacagcaataaaatcaaaaattgacaagtgggacctaattaaattaaagagccaaacagagtaaacagcctacagaatgggacaacatatttgtaaactatgcatctaacaaaggtctaatatccagaatctataaggaacttaataaggaaaaatcaaccctattaaaattagtaaaggacataagcagacacttctccaaaggagacatgaaagtagccaacaaacacgaaaaattgctcagcatcacaaatcatcagagaaatacaaatcaaaaccacaatgagataccacctcacaccagtcagaatggctactattaaaaggtcaaaaaataacacacgctggcaatgctgcagagaaaaaggaatgcctatacaccgttgttgggaatgaaaatttcttcagccacggtggaaaggagttggagatttatcaaagaacttaaaacagagcaatcccattacttgatatatactcaaaggaatagaaattattctaccaaaaagacacatgcactcatatgttcatcacagtgctattcacaatagcaaagacatgcaatcaacctaggtgcccatcaaaggttgactggattttttaaaatgtggtacatgtacatcatggaatactatgcagctataaaaatgataatatcatatcctttatggcaacatgaatggagctggaagccattatgctaagcgagttaatgtagaaacataaaactaaataccacatgttctcacttttaagtgggcgataaacactgtgcgcacatagacataaacatgtgaacaatagaaacagcaggctactagagcagggagggaggaagggaggcatgggtaggaaaaccacctattgggtactatgctcgctacttgggtgataggatctatactccaacctcagcactgtgcaatataccacgtaataagtctgcacctgtaccccttatatgtagaataaaagctgaaatttttaaaaaaaggttcacttgaatgtggaggtgtacgttcaaaatctgccagataggcaaataagctggagatgcaggaaagtgttatagtccaagttcaaagacaatcagctggcaaaattccttcttactcagaggaagtcaatatttattctattaaggcccttccatggttcaacaatacccccacacattatggagggtaatctgtttcactcaaagttcactaatttaagtattaatctcttccaaaaatcaacttcacaaaaatatccagaataatgtttaaccaaacatctgggcagtatgccccagacaaattgacatataaaatcaaccatcacagacaaatcaccgaagccagtgctgaaaagaagacatcactatagactttaaagaagataaaaagattataagagaatactatgaaaattttatgcccaaaattagaacatttagatgaaactgattaattccctagaaagactcaaaattgttgaatcagactcaagaagaaatagaaaatctgaatataactatcacaaaagattgaatttctaatgaaaaagccacacacacacaaagaccaagctcagattacttcagtaataaattttaccaagcttttttaagaaaaattaatattaattcaccacaaactcatccaacaaatagaagtaggattagtgattacaaattgagacttgacatactaactaaaaaacagtttgttttggttccaatccatgtgattcttcagttttccttttatttctccatcacttccaatttaaccattgtccctgtgacagttggcctgttggatattgggggtagtctcagtctgtccagatcactgaagcatctttgtcaacatggtaggtaaattgatgatgaaaatgattgtctttagagcttgaattcttactatgtgctacactccttgtttggcacttttaatatattatattaaatattattattttaagtactattaattgcatcagattgtgagggctgtgtttctgttaatgccaagattgaaatacaagtttgtcttatgtgggttgtgcttaatattttaaaaaattaggctgatgttcttattaagattttatttgtatatcataaaattaattattaaaagtatacagttcagtggttttgggtatattcacaagattgttcaactgtcaccactatttcgagaacattttaataacctgaaaggaaattttacacctgttagcaaccactctgcattttttccttgtcccagactctgacaatcactaatctattttttaatccctatgaatttgcctattgtgaactatcttaggacccttcttggcaatgaattgaccacaaatgtgtgaatttatttctgaactcttctattccattgatctgtatgtctatacttgtgtcagtatcatacagttttaattactgtaacattgcagtaaatttcaaaatcagaaagtatgacaattccaactttgttcttttttattaagattgtcatgggtattctgggtcccctgcatttccatatgaaattatgatcagcttattcatttctgcaaaaattgacagtttgaattttggtagggcttgcattgtttctacagatcaatgtgagcagtattgccatcttaacaatattaagtcctccaatccgtgaacatagaatgcctttccacttgtttaggtcttttttttttttttcaaatcactattatagttttcattgtgtaagcattgtaattctttacttaaatttaatcctaagtatttattttactgttgctattgtaaatggaattatcttaatttcattttcaagttttttactagttcacagaaatacaactgagtttttgtatattgagcttgtattctgaaaccttgctgagctcatttattatatctaataatagtatttttgtgtgtatgtgcggatcctttaggattttctatatatcaaatcacgcagtctgcaatagagagagttttatttctttctttccaatttggatgccttttcctccttttgcttgcctaattgcactaggttatactttcagctctatgttgaatagaaatggtcgttgtcttgtttttgatattaggagaacagattacagtctttcatctttgagtatcatgttagctgcaggggttttttatgcactctttgtcaagttgagggtgtttctctctattcctagtttgttgagttgttttcttttttcagtcatgaaagggtgtgttagatttggtgaaatttctttccacgtctattaagatgattgttctttattctatttgtttggtgtattacatcaatttctttttgaatgttaagctaatcttgatttcctgggatatatccgatttggtcttgtcatattactatttttgtattgctagattttgttagcatttttgaggatttttgaatatatagtcacatgagatattggtttgtagttttcttttcttgtaatttttaaaatctggtttggtattatagaatgagacaggtagcacttcatctgtttctactttacaaactattttctaaaagattcatggtaattctgtttttaaatctttagtgaaattcaccagtgaagtcactggacctgggcttttccttgtgggatttctttatgactaaataaatctctttatttattacaggtctattcagatttctatgtgttatttgtaattcgaaaggcaacccttgtggtatgtggtatgctgactacatccgccttttaaaaagagggaaacaaaggttaaatttcttgcccaagcctttgaaggtaataagtggcaaagctaggttcctggtcaatcgtgctccaagatgcatgtcagtttttgaatcacacgcacttccacagagactgattaaaattatgtattccctttgatatagcctgggtgctttgaagtaaatgtctactggaaaaccaaactccggggagtattttggtgcagattgtggacatcttgttaaaagatttaatttgagccatttttgtttatctctcctccatctggaagtaatattttggtaatgtttttatttgcatcttatctaatgatttatttttactttatatggaatggacaaactgaattcctcctgctaaagaaaattatatttttctgctaaatttatttctctttctgagacacttgtttttataagacagatttctggactttcactatgaagaatcgagagattaggtggcacataagaaaagtgttacagaaaaaaagagaaaagtaattttaaaaaatcatgcagggtaaggttttgtgggtgttttaaggtgatggtttgagaggtaagagctgaggaaaggcaaagcgatgaggaaaagtggttatgattaattgaaccccctcttatgtttcctgataaacagaagttaatgattctttttttgccaatagactaagtgtatttagttacaaggctagtccatgtttgaaccatgagggtcccaacttatattaccatcacactcttatcccacaataaggatgtatgtgactttgcttttgtacatgtgccaaccttatataaaaggtgatagtggacttgaatctagtttgcatgggactagattgatttaatcactcattaagttggcagattattttgagccaattttgttctaagccctgcgatagattatgggtgaataagatagtcatgatctctgtctttatgtaatttatagcccaggaagggagattgatatttaatggttattatatacgatagatatttagtggttgcacacacacagatgattacaatttatggtatgtcctatgaagagaaagaaaaaggaattatgggagataaacattctagatgtaagttaagtggatgggagtggtcaagaaaactacctgtgaggtagtgatttcaagctaagacctgaaatctgagtaggagtaactaaggtgattgaaatggtttggccctgtttccctgcctaaatctcatcttgaattgtattctcataattcctacatgttgtgggagggacccagtaggagataattgaattgtgggggtggtacccccatactgttctcatggtaatgaataagtctcaggagatctgatggtttgatcaggggtttctgctttttcgtcttcctcgttctccctttgcctgctgccatccatgtaggatgggacttgctcctccttgccttcttccatgattgtgaggcttccccagccacgtggaactgtaagtccaattaaaccttatcttttgtaaattgtccagtcttgagtatgtctttatcagcagccagaaaacggattaatatggtgatgaatgttccagtcaaaagattctgcatgtggacaagtccaaaattgggaaagagttggtctcttttgagtaattaaagtcaccatgtaaaaatatacaactgaagaggtaggcaagggtgagatcacacagatagtgttaataactttaaaaatatgttatcttgtgctcacatgggagttagtcataggtacatttgggaactaatttcttcatctttccctaactggaattttcagacattcaagagcaaaatataagtatttcagaagaccaagtttaagaacatctagattttgagagtgctcactctcaggagcatatgtacacatttgctaagtggtaagacaggtaacacggaaaaattcacattgtgtagttggctgtccactaatccaacagtgtgcaactgacactagccggacaaggttataggtctttggctagaagatagttgttttttttttctggatcagcatgttatctactgctgtgctctatgcattttcctcattcaattagaaattatatctagaattatatctagaaaatcctattcaatcaatattttaaaactactaatcatttattcactaaaactaataatgtattaataactaatagtcattaccttgttaatttttcccaaaacattattcaataagttagaaatacttgtgaactgagactacactcaagaacatctagacattttcatgtatctttcacagctataatctatatatatgatataacatgtgtagaaagaataaatgaaaagcatattttattttggtgaaagtttgaaaaatcaatacctaactgaaagctagaaaaatgcacagttcccaatatatcctgcgactcagaatcttaagaaggttccatttttaaccacgtgcaggttcaaaatgtaagtagcaacattaaacttatgcttttcatttcacgaaccatgtataaaacaggtagctaaattgaaaatagttaattttaggttttattgtatcatctaacatccatgcatggggaaaataaggctttggagtattatctttctttctattctcttgtttattggattacatatttttcagtaagcatatttgaaatagaactacaggagaaattgaaagaaacaaaaacagtgcatccaagttggcgactagaacatcaatggatggcttttaaacttctaagaaaccatctggagcaataacagtattgatcagtattcatcatagtacccaagaaaggctaaaggtgtccaggttgtgatatagatggacatcagacctaacccttgatctaatatttctgagacatgtacccatcatcttgtgaacatgtggctggatgaatccatctttgttagttggctttggtttttcataacttagaaagcgaaagacaagcctaagtaatatgcacaccgtgatgctagacaatggagcacatccttgtgagggagttgcattgcctgaagtaaggtggccatgaccacatgtgaggcgaatttagtgctacataatttaggagtccttcttaaaacatctcaaagtttttctaccagagctttaaaaagtttcctaacaggggaaaatttgccatatttgcaaaaaaggatggcccttttctatactttaattctggatccactgaatgctaccaactgagagagtcggctttttaaaatatttaatgattacttttaactgacacacaattatacatatttattgggtacagtgtgatatttcaatacatgtgtacaatgtgccataatcaaataaaggtatatatccaaaaaaaactatatcaatatgttgaaaaagattctcatgttcattgcagcattattcacgatagccaacatgtggaatcaacctaagtgttcatcaataggtgaatagataaagaaaatgaggtactgacacataatgttatactattcagccataaaaagaaggaagtcctgttattcacagcaacatggatgagcctggaggacgttatgttaagtgaaataaatcagacacagaaagataaatactgcatgttctcacacatatgtggaagggagcagttttaaagcaaaaattgtaccacaatttggctttcattacagggagagagaaaacaagtaattgcaaatgcaaacaccctgacaaagaagagaacttcagtggatctgtccagcatccctgaacgtttcggatgagaagttctttggagaatttcatgagagccatggactcacttgccagaaaaattcatgctgtagaggcagccattagtatattcagtaaaatctgcatgtaatttcaggggatcatcgacccttttatgtgcttaaataagcccttgtctcccaagttaagaactcttggactaaataattatcacattagaatgtaattgtgaaaaaaaaaaacaggctttcagaacttggcattgataaggaaactgggctccagaaatagatctgcttatctgtaagtagtggcccaaatccactgatttttgcctacaggtgcaaattgattagctaatcaaagctgcttttttactgtagattacctttagaattctttcccagcttccaggataactgggtcccttcagttctccacaaacctctatattttccacattttcgcatcaggtttctgtagcaccctgtcatgtttggaatataaaccaaactcctttcatgtcctagtagtgtctgcttcttctagttcttgtccgtttcctgtatcccctgctgtaactccctccttcctgcatgaagctttagttatggaaacgttgcacagcttcttgaacatgtcaggcttgttcctgcctaagaacttggatccttgctgatcttaatgcctggaatgttctttcctatactccagatgactccaccccactttactcaagtctctcctccaatgttaactactcacagagcctttccttgacacctgaaacacgcaccaccctcactccatgaatattttcctcaccttggtttttctttataatacttaaaactctctggtaactatctggctcatttgctaattgtattgcactccagtataatatgcagttcaaaagagtgagaaatattaactgctgtattttgagcacctcgaacagagtctatcacatcataggttcttaatgcctatatcttgaaaaaataagtgtatgatgaatgaatacatgcatagtaactactgtgatggccagcattaatttacataaattaatttgagggaggatactaatttcccatttaaggtgatagttacactttatataagttataactttatatacttataacttatgcatataagttagtctggatatttcattgaattattactcaatagagaataaagaacaatatcattaaagtttgttgttaccagaaaatgtcaggatgcatgcagctttttttggtaagattaaataatccacatttacaactcagatggattatctgatgcttcttcagcaaaggaagggtcaagtttgtcttgggctgaaaaatattcgtttaagtaattccaggtatcggttgtttgctcaaatccacatggaatttaatgatttaaggtcatggggaagcgcattttgttacacttctaatttaagtgagggaattatcttatatgggtgcctttctcatataatcaacaatctctaaaacctcgtttcttacaagtaatcgattttgttttatttttatgactttattttatttacatacataattttacataaatgcattatctgtgctcatattcacatattcattttttaaaattcttctttatgttgtttgatttccaattctcccaacttagcatctgcctggtaacccaaatatgtgtgtatgtatttgtgagatacatacacacacaccatggaagcccttgttaaaaaccgaatacatattactgcatatttatttctgctccccacacatatataaaactatatatatagtgtgtgtatgtttgtgtgtgtgtatgtatatatataacaacacacaacatacatacattcattcataaataatgagtgtggctgggttttttggggggtttatttttaaaaaatgaaatattatcctacacattttcctgcatttgtagtttctcagattagcctagcttgtggaaattcttccagtcaccttgtgtaactctaattcattattttaatagctatataatattccatagtatggtatattacaagtcatatgactaaccccaaatgaatgaccattcgctttgtttctgtcttttttttttttcaaattaacttccaagacatcctcgggaaccctagagcattttgtacctatgagacagattcctctgaattagtttgctaataagtgagggttgtatctttctatattaataagtgttatcagatagctttccaaaaagattttagtgaattgtgtatctattctatttgaaagtttccttttgatttgtatttccaccaagcgctgtcattactgattatttaattgtttgatgagtgtaaagtgatatccatattgctttaacttgcatatccctgactactaatgagtctgaacatgcttgcagactgtttagatttacttttttgtgaataccctatacatatctgctcactacatttttatctattgaattggtttttattagcatcagtaggagaccttggacattacagatattaatcttttgtccgttatctgtattttaaaaatatatattccaaaacacttctgatgctaccaaaatggcatagcaccatttatctcatatcctccaccttacaacttaaaaaccctgcacgtaacatttcaaacaaacatcaagtgactctaaaaggtggaataaagaaggtaaactacagagggatttaggacttaaggaacaacatgacagtgagttttgggggttttcttattgtctcccctatatcccagatagggcactgcagacatttccaacccagagctgtcaacaaaaaagacaaaattatcttccaaggaaaacctatttcccaaagccaaaagagaaggaacggcttggcctaatgacagaaaagctttttgcaatacgtgtcctattctagccaaacatgaaaagacaaagctcaataacctcttctgcccttccctcctaccacttagttttatcagggaggactgggaatatgatctcacatcccctctattgctgaaactgctggtattcagattcccttgtcagggtaatgctgtcaaggcttagcagggagttagccttccatctctacctggcaaaagcaggcaacagttttcctaaaggatggtgtagatgagcctagcagagagctgatcttccatcccccagttggcagaggtaggatgtgctctgattcccctaccagggtagtgtgagcaggatccaaaggcaagccaatccagttccatcacactgatgacactaatctagacagttcaaaacaagtatagttggcactttgctccctcttgattcgaataaatggaaagacagcttatgtttataaacataaaatgatacagtttatgtggaataaagtttaatggtttcacaaaaaattaaacataaaattgccatgtgatccagtaattctacttctgagtatatatctaaaagaagtgaaaatggcaactctaacagatatgtgtacacccacatatatagcaacattatttcccaaagcaaaaatgtggaaacaacccaaatgtctgctgaaagatgagtgaataaacaagatgtggtacagacaacccgtagaatattgttcctccttaaatatgaaggaaattctgacacactacaacatgaatgaacctggaagacattatgctaaattaaataaaccaatcataaaaggacaaatactttataatcctacttatgtgaggtatctagcatagacaaattaaggcagacagaaagtagaatggcaaatgacaagttgtaggagtggtggtggggaatgtggagttgtttaatggataaagagtgtcagtttggaatgcaaagtggttctggaagtggatggtggtgatggttgcataacaatgtgaatgtacttagtgccatggaactgtatacttagaaatcatagcattcgcagcaacctggattgagttggagaccatttgtaatagtaaaattgttattatatatatttcaccataattaaaatgtctttatttgtaaaagtacaaagataattttgaaactttatatttaaagaaggaatgtatggatgtgatctggccagatggatttaatgccttggatagatatgatgagcaaagatgtctattgattttggtatgtctaaggccatccgaggacgctagatacactgaattgaaagggtattaaaattatgtcattaaaatggaggtaaaagatctttacaagaaaaaagatctctacaaaacatgtcaaaaataattgcaaaggacacaaagaaatggaaagacatcccatgctcatgcaccagaagaattaatataattaaaataaccatacctgccaaagaaatctacagattcagtgcaatttccatcaaaatatcaatgccgtttttcacagaattagaaaaaaaatatgaaaatttgtatggagccaaaaaagagccacaataaccaaagtaatcctcagcaaaaagagaaaagctggaggcgtaacactacctgacttcaaaatattgtataagctatagtaaccaaaacagcatggcattgatataaaaagtagacacaatggaatgaaatgaaaaacccaaaaacaaatccatatatttacaaccatctgatcttcaacaaagccatcaagaacatacactggggaaagggcagcctcttcagtaatggtgctggaatatgtggataaccagatgcagaagaatgaaactggactcctactttttaccatatacaaaaatcaacttgagataagacaactgaagattttacttaaaggtaaaacctgaaagtataaaactactggaagagaataaggaaagctcttcagaacattggtccaggcaaagattgtatggctaagatttcaaaagcaaatgcaacaaacacaaaaataggcaaatgggactatattacactaaaaagtttctgctcagcaaaggaaccaataaacaaagtgaagagacaattcccttccttgaaaggaagaaaatatttgcaaatgatttatccaaccagggactactactgagcatatatcaggaagtcagacaactcaacaattttttaaaatcccattaaaaagtagacaaatgacacgaatacacatttatccaaaaaagacatactaatggccaacaagtatgggaaaaatgcttaatatctctaagcatcaggtaaatacagatcaaaaccccaatgagatattatcttaccataggtagaatgcctattatgaaaagacaaaaaaaaatcagatgctggtgaggatgtgggaaaaaggaaactcttatacactgttgtgagaatgtaaatcagtacaaatgcaatggaaaacagtattgctatttctcagaaaactgaaaaaaagaactatcatatgatccagcaaatccactactggctatttatccaaagggaaaggaatcaatatatcaaaggaatacctgcatattcatgtttactgaagcaccattcacaacagcaaagatacagattctacccagatgtccaccaagggagaatggataaggaaaatgtggtatatatccacaatggaatattattctgccatgaaaagaaagaagttttatttgcagcaacatggatggaactccaggtctttatgttaaatgatgtaaaccaggcacagaaagacaaatatcacatgttcttactcatatgtgtgagataaagtgttgatcacatggagataaaaagtggaatgacggacaccagagactggggagtgtgagtgaatggtttcagcaggggttggggtggtgaagagaggttggttagtgggtacaaacatacagttaggtagaattaatagtttctaatgttgactgcagagcagggtgattgtagtaacagcaatgtattgtaattttcaaaatagctagaagagagagcatgaaatgcaccagcacatagaaatgataaaaacttgggtcacagatatcccaaatacccagacttgtttattacacattctatacatgtaaccagatttcacatgtaccccataaataagtacatatatttttatagcaaaaaaacttaaaaatgattcttaaaaatcttgaaattgcagaatctgagaaatggatatacggagtttcactactaccttatctattttgtttattttaaaaaattatttataaaggtttttaaagtgtgaaaaaatcctacagagtatatcataccaaatctatgatattctagaacaagcaaaactatagagacaatgcaaggataagttgttgttggaggttcgttggaaggaggaagagggatgactagatgggacacaggggcattttaggacggtgaaacgattctatgtgatactgtaagagtggatacatgacattatatatttgtcaatatctacagaatgtaaaacaaagaatgaaccctagctaaattgtaaattttagttaataataatatattaacatacattcatcaattgcagtacgtgtaccacattacaagatgtaaacaatatggaaaactgtggggaggttagtggatatgtgagaactctgtattttcttatcaatttgttttggtaaaacataataatattctagaacataaagcctattcattttaaaatatgcaaggtatttgaaaatacacttcaataaaaaagatatacagatcacaaaattatatgaaaagatgctcagcataatttatccttggggaagtgcaaattaaaccacaataagattctactacatactaattagagtggctaaaaatcctaaaatatcagatataagagataatgtgaaacaaaaggaactactctcatttattgctggttggaaaaaatatatagcactcgttcgatgaaagcattgtattatctgatttatagacattccaaaaaaggtaaaaagatacgaaaaacagatcaccattactagggacttggaggaggctgttagttgactacaaaggtgaggcataggggattcaacccaaattgctgtgcatgtcaatagttgattcctccttgttggtctatagaattccattgtgtggatgcacctcaatttgttaatccattcacttacagaaagacatttcatatttttcagcttttggaagtatgaatagagctactataaacattcatgtataggtttctggcctgggcatggtggctcacgcttataatcccagtgctctgggtagctgaagcaggaggatctcttgagcccaggagttcaagaccagcctaggcaacatagtgagacctcatctctacaaaaaaaaaaaaaaaaaaattaaaatgaaaaaagataataaaaatgaatgtacaggtttttgtgagaacataaggtttgcaaatttatttcacacagtaatggtatttctgagtcatatggtaagtgtatgtttataatgagatcatgttctttgcaggaacatcgatggggctgtaggcgattatccttaggaaactaacgcaggaacagaaaacaaaatactgcatgttctcacttataagtaggagctaaattatgagaacacatagatgcacagagaagaacaacacacagagaagcctgttggaggttggaggatggcaggagggagaggatcaggaaaaataactaatgggtactaggtttaatacctggatgatgaaataatctgtacaacaaacccccacaacacaagtttacccatgtaacaaacctgcacatgtgctcctgaacttaaaataaatttaaaaaaaagaagtctgggggaaataaaagaaatttccagatagtgactgcacaattttacattcacacaggaaacacaatagtgttcaagatgctcttcatccttgctagcagttagtaatgtcagtggatttttcagcagtcctcaaaaatatgatgcatctaccttgattttaatttgtttttctgtaaaatctaatgatgtaggataatttttcaggtgcttatttaacatttgtatgtcaattttagaaaagtgtctattggtgtattttgcccattttgaaaatgttttctaatttttggattttgaaagccctttctgtattctggatacaggtgctttttggatatgtaatttataaattttttttcaacctgttgtttgactttttctgctctcaacagtgtctttctcaaaactaatttttaaaattattgaggatgtctgatatattgtttctttttgaattttggttttatttttgaggcatcttttcctaattccaagtcataagatttaccttatattttcttataaaattttatactttttaatttgacattttttttctctaattgctttcactcatcaagggaaagacactaaagaagaatagagtagatcttccatcacaggtagaggttgccccagcctagtcctgcccctgatatttgacctgagtagccccggaaaaaggccacagataaggactattctgcctttcatcttgggcatctgagggaggtgaggctttttctgaggggtggaacttcagatcagcgaatggatagtcttgtcctctgccccacatacttcaaggtaaggactctaaggaaagactgaggggacctcctgccacagatatagggagttttagccctgccctccctgtgctgttagccctgggtggcccaaggcaggtttccccagttttgatgtccgtagacttcatttttggggcctgagggaggtgaggcttcctcaccttagactcaagtcagcagagagagaagttccagctccagcatgcattaaggtgagaatgcagagaaaggacaaagatagccttcctctatagatggactgagcttcaaagaaccttcctcttcgtgtgaatcctgagaggtcccatgcatgggtatcaggtagcaacaactctccctatcccctgacatccttttagaggatttcatggaggtgatatccttggtgtgaggaagccagcctcaagtcagcagaagggccggggtgaagaccctgatcaagagtaaatatgattaccttgagaaattgagaagtacacagggacctcacagaatccagtccgtttccactcttagccctgggaagaaaagatttttaaaattgaggaagtctaatatatcattttcttaaatgaatcatgatttagtttcaggtattacatctcttcgcctaagtccagttcaaaagatttcctcctatgttttctcataagttttatagcttctaatttaattataatccatggagctgtaatccatgttaaaaaaatttttatattaagtatgcaattcaggtaaattttattttatatttttgcatgtggatgtccagttgaactcatagcactgattaaaataccactttacacacatttaattgtcaaaaagtagaaaaacaaacaatatcaagtgctgatgacaatgtgaaaaaacaaaaacactcttgtagtgctaatagaaatgcaagctagtgcaacctttttggaaagcaatcaagcctacagcgcttgtactctacaactttgtaatttccttcctggatataggcccacagaaactcatataaatgcacaacgaaacatgtaaatgaatattaattgagcataatttcaaagagtaaaaagtaaccactaggggatttcataagtaaaatgaagtaacacataaaaaaggaatttatccaggtatctgataaataaaccaaatctatatgctgcaatgaaaatgaagctcaaataaggcttaccttcaaaataagaaatgaagcaagatttctgaccaaatactacttctgtacatttaacacacacacacaataatattacatactttcacgtatgcgtaaattaatatatgaatagtgaaatagacattcacaaaacaagcaagaatgggtgcctttgagtgaaggacaatagccaagggaggttagatgaagaagagagaaagtgatgaaataaaatataaacaaaagaaaggttttcagaaaaaaaaaaaccaccactaattttctcaattcagttgtcttgagacatttgtaaacactgaatggacctcactggggccttcctttggattatctcttctgttccattaaaaaaaaatctatcctttaaccaatgccatactttctttgttattactgtagccttacagttgtaagaatcaaagaaagaagaaagaaacaggaaaggtggcttgacagctaaagacagatttattaacttcaccttcatacagtgggccccagtaaaacaatgggccttaataagcacattcctttcccttcaggtgcactaagagaagttaaaagcagactcagggagtatgcctgcagctgcaggaagatgtatgggaacagacccaaaattctccctcccagataagcacaacaaagaaacacagaggcagtccaagtctctgataaactctcccgccctaaatccttaaaaactcttagtctgtaaaaacaaaacaaaacaaacaaacgaaaagagtgcctctaacctaacttgcccaaaaacccctctcgggtgtatttttctaaaataaaactggaaaggcctatgcattattttttgttagtaactgttactgctgctatgaggataataattgagcaaaatgttatagtaactgagattttctgtctgatattttaccttgagggtgttacagtatatagtcctcctgcaaatagtagagtgagtaaagcaattcctgcaagggttgcatagtaaataatttttattaaaaatgttttaatatttggcttaaaaggagaggtagaggctgggcatggtggctcacgcctgtaattccagcactttgggaggccaaggcgggcggatcatgaggtcaggagatccagaccatcctggctaacacggtgaaaccaaatctctactaaaaatacaaaaaaattagccaggagtggtggtgggcgcctgtagtcccagctacttgggaggctgaggcagcagaatggtgtgaacccgggaggcggagcttgcagtgagccgagatggcgccagtgcactccagcctgggcgacagagcgagactccgccttcaaaaaaaaaaggagaggtagaaatgaaaaaaagtatttggtgaggtaggggtgagattgagtaaaatgggtaatttttactccattacttattttttatgattttcagcttaagattttttatttatttacattaatatttaggactttttctgggctgttaggggttgctttcttagctttttaggctttgatttgagtgtgatgtatccaggagttaatttctgtaacagatatagtttaaactgtagcaaataataaaaattgaaaaacattaggccagactagaatttaacaacaggtgagctacagtttttgaaacataattttcctttttcagtttcccatttttattaaaagacaaattatggtaggattgatttgctttattatacttggcttaattatttatatacagtgcagcaagaatttgctactagaccttttaaattggctttgatggaactttgtttcatggaaggaatttgagataagacttttaaaagccaagcctagccatggatttgtaccattaaatacctatgagttgggcaaattttttttcttgaggttctaagatcacttgggattcctggcctgttagaaagtgacattctttacttaccatagattagaaactctgtacagggactgtgtacacaaaatacgaggtcgatttttcaagggttttattggctatataagttctttgattttttttaaaatttttattttatttatttatttatttatttatttatttttatttttatttttgacatggagtctcgctctttcacccaggcgggagtgcagtggtgctatctcggctcactgcaagctccgcctctcgggttcacgccattctcctgcctcagcctcccgagtagctgcgactacaggtgcccgccaccccacctggctaatttttttttgcatttttagtagagatcgggtttcaccgtgttagccaggatggtctcgatctcctgatctcgtaatccacctgcctcggtctcccaaagtgctgggattacaggcgtgagccaccgcgcccggccagttctttgattttttaaaggagagcataccattccagttaaagccttggtaaaataaccagttttttttttaattgtgttctgttacaaaagaaaacaggttcttattgtgcttatgcaaacaactatattgttgtaatgtaagaatacttacaactagtttttaaattttagaggaactaggcagaaagaaacaaacaacctttaaattcactttacaggagtatactttgcttagttgttaaaggctgtagctagcttaagacaagttttcttgactttgaaaagtaaaataaggattagcagtgttttaagcaaaaggtaaaacttgtttctgttttttattagtttagtccattttattaacttttgttttgcttgatatttataaacattttagctgttcatgagttctgtacattttttgttgttgttgttgtgagaaacctccatttgagagcacttgctaaggcgacacagcttgattataaatcatgttttgaagagaattaaaagaaaataacgattgtctgtaaataacaaaatgtctagtttggatacaattagaaacacaactgacaaagaaatttggttatttctgtggtttacaataacctaacataacaactttaattatgattaatagcacatatttggacacgagaactttagacataccatacagttttggaacatatattattattccctaaaatataacctattagacatcatttttgcaattgtatctacctaagcatgttaaataattctgtttacctcttttccagatgcttcaggggccctgtgcagtacccaaaagccaggggttaggaaagacaaccttgacactaaagtttgattttgggaagcgtattaaatatgtttaaaatttaaaacacttgacattatgaaatagaattttagatcaccctaagttggtttttgttagtttgttttgttttgccaaaatgatgagttaaaaatttggaaaagcaaaacccatttattagcctttttattacatgaaaatcctgtttaagagagaaagttaaattttacccttgcattagtttgctagtaacgttaacctgaattttaatgaaaccttatagacaatcctgtttaattttaaccagtttgaccatgaagtgcgatttttatatacctgttaagacccttgacaagttttgctaaagagtagattagcattttaagaaaactttgtggtgctttaattttagtgtttaatttacagaaaaaaaacccatataatacccttttgagtttagttaatatgtttacacaggttttttttgcaagattaatttttacaatgtttttataatttgctgaaaccattcactttattttatttaattttaagacttttttattcttaagaaaaatgtgtatttttatgccttcttataatttttaactaaaaacactttttactgtttttatacaccttgcacccaaatccatgtttagtagctttaattacatgttataatggtaacttttagcaatttttaactttcatgtataacctgttaagttttttaaattatgtgctagatgcagatgaagttggactttttccagcatagttaggggcatggttacttccatacctgtctggccttaccaattgtgacacaggcaagttgacagtttttaaaggccaaagaagcaggttacaaccttgaaacatttagcaaacctaatatctgacctgcataatgtagaccacatttttacaccttgaagacattagtattttaccaataattcctaagactgtttttatttttaaatattaaagttaggtgaactaaaaggtaccacaacttttatttttgccttaaagatgtttgatttaagcacttatttttcttaggccaattaattaaagctttttttaaatagacattgcacacataacacatatataaccacacgggcaacagaagaagatctagtagttataagattttttatttggtaatttcccaattggattattggccttcaggtgaggccctttaagaacagagctaggaatacagtttccagggcctaataaacaagcatagattgaagacaaagacagatttcgagaggtacttatttacgtctaattccagggattccataaggaaaacagagattttttttccaaaatgggatttgtgatgccttttctgttttcccaaggagtcccaggccaccagaagtcattttagggtttcttatgcatgcaccaagagtgtggcaagacagagtggagagaagtaattcagatggctgagggaaaacgttttccaggaaaacaagatttatgaagagataaaggtcttttgaatataattatagcttggatatccattttaattaagctgagcactcttttttaacaggcggaggttagaattatataaatgttatgccaagttaaattaaaggattaggttatgtgcaggaattccctgtgaaaaggagagggattttcagagaaagaatccagatgctgtttgatttgtgacagattagacatggagaaagggacatgattgtgagcaatgcctttaaatctagccacttcccagagagggagaatggcaggggttgtctgactggctggagtagtttttgaatgggtaacaggtggagaagtaggaggggcaaggttaggggctaaaggcttggggacaggaggggctgctggggcagagggttcacacgggcaatgagcgggtgcagggggttgagaatacagaaggggttcatctgcagggttgaaaggaattttggagaaaggggttttaggggaaggagagacctggggaggatttttattaagaagaaggattttatgaggggtgaaagcttgacatagggagggtcaggatttaaggtaaaaataaaaaaggctgaaaatagagaacctcttgccatttgccattcctcgttatgaagttggtaaggtccctgatagtatgaacattaaaggtttcatttttgggccattggctgtcgttatctaatctgtattggggccaagccattttacagtagaaaattaaacgctttggctttagggtctccgtaaaccaagtttggtgaggttgcaaagaagacagcccagagggaaggacgtaggaatgtgggattgtttgtgacccatgtgagctggtgagaggaggccgagggtgtctgttttgttctaggcatccccagacagaagacagagacccagaatcctctttctgaaagaggacagttaatctgagaagaaactgcacatccccaagatttcctctagcttagtcccactggttctctgaggaccaggatggcaggccagactttctcaggtaccaggagaaagccaggagaaggcaaattttaccagccggctgaattagtgtccgatgttggatgttccagttggaattggtaaagggcctcctagactggagccacatgaggaggagagagagagagagaaagacggaggaagaaggaagagggagcaagggttagggagtgaaatatccactgcaggtcattggtggtggaatcttgagacctgagggttttgagagtccactggggagtagccccggcctgagcctcacagtccccttcaggttagttgtcctcctcacgcaaatcacttgaaaagtgaagtgagagaaaagatggggtgggtggctagagaccctcaggatccaggagttaactcaggatgaactgccattgcccactgcttcttgggttgcaagagagcctttgcccccaacacccatcctgggttttggcaccaaatgtaagaattaaaggaaaaggaaagaaacacaaaaggtggcttgacagtcaaggcacatttattttagggaaaacaaacctgagaggagcttctggccgagttaggtgagaggcactctttcttacagactaagagcttttaaggatttagggtgggagaggttatcagaggcttggactgcttttgtgtttctttgttgtgcttatctgggagggacagttttgtatctgttcccatacctcttcctgcagctgcaggcatactccctgagtctgcttttagcttcccaatcttagtgcacctgaagggaaaggaatgtgcttattaaggcgcactgttttactggggcccattgtatgagggtgaagtttggcagttacctaagatactcccacctcctccaccaccaccccaacacccatacccaagctgttttatctgtgttttactgtctgctctttctggctgcttgttgtcaaaagagaagtgatttccttgaaatgcatgaggctagaaagggagctggaacttaaagtggcgatgtttgtccaagatgacagtgctcctgctctgtcaatagtaaataatataattgggttgtgtgattcctccaacttcactgtctttttaaaaattgttttagaaacctaacacagtaggcacaaggtctgtataaagaaaactataagactctaatgaatggaatgaagggatattcaattttcaaggatagaaagactcattattgtcaagatgtcaattctaacttgatctatagattgcctaaaatcccagtcaaaatcctagcatgttgttttgtggataccaacaaacttattttaaggactaaaatatgttttatgtggaaaggcaaaagactaagattagccaacacaatattaaagaagaagacagtgggaagactaacacttcccaacttcaggtcttactataaagttacgataattaagacagtgtgatattaaagaaataatagacaaaaaagtcaaagaaatgcaatagacatcccagaaatagacctacagaaatatagtcaaccaacttttgacaaggaatcagaggcatttaaattaagaataatcttttcagctaattataccagaacaagtggacatccacatggagaaaatgaagttaggcacagaccttaaactcttcacaaaagctcacataaattcaatcacagacctaaatgtgaaaataaaattttaaaaaacctatgaaacacatagaagataccacaggggaaaacctaagtaactatggttcgagaaaacttcttagatacaacccaaaaaggaacatctgtgaaagaaaaaattgataagtttggcttcataaaaatgaaaaaattctgttaagagaacaaaaaggaaaaacgagaaacgaggataaaagttttgcaaaaaaaatctgactgaagatgtgtatcaaaaatatattcagaaccctcaactcaataacaagaaagcaatccaataaaaatggacaaaagatctgagtagatacacactacaccaaagaatatatacacattgcaaataatcatgtaaaaagatgattagcatcttatgtcactagggaattacaaagtaaaacaggataccactacacatcttttagagtggctaaaatcaaaatgcctgaaaatttcaaacactcaacaggaggctgaagaacaggtaccctcagtcattgctgattttaatttgaaaaaaaaatacactcactctagaaacagaattgtattattctatgcattttaaatctggaaatggtaaaaaaaaaaaaagtagataaagaaaacacactaaacacactgtttttgctgtgatttgggtagggggtggtggttgactatcaaggtgaagcaagagaaattttaggctaaaagaagggatctctatgacattttagtggtagatgtaagactctatatttgctatgataaataaaaatgttcattatagtgaacgctgatctatacaaagttttaaaaatcagccatgcattgggttttcaaaaggatgctgagaaaagaatggattttacaggactgaatgtgaaaggagaggcaccagcaaaagagggtttgtcttagtctaggtgagagatgaaccacagaggtagtaatggagatcaattgaagtggagggacttcacatgggttttagaggttggggtaacaaatgctgctgttggatttgataaaaattgagagaaagggaggcatcaagtatatcaaaacatgtgccacctatagcaaaaaagtcacattgagctattattttttaataagttgtcagccctcatgtttattttataacttctctgaaccacacacaaatgctccttcttccttgaactcagggaatgccctcccctcccccaaacctgtgcgcaaaacatctatattcatggcaactatggtaaatcttcggtgacagaggcagcatgttctttgaaggctgaatctacgtgagaataaggaactgaaggtgagtcatttggggcatgtttggaaaatggttgtgttcactcctttaaaaggtccctgacactccccattgattgaatcccaagaacgttagtccctctctcttctggacaggagacttatttccaataccaggaggtaaaagaataggtttccattttctttttatcatccataagaaatgctcccttcttgggacctcagaagaacaactccatgaagataattcccgagggcatgggaccagagctggaatttacccaccagctgcctcccagtctaggagaagagcttccttgtctgtgggtttccaccttgagcgctgaggtttggtccaccaatcctggctatgagcagagtcccactgccccgggacactgagccaaagctgaagaaggaagtcagctcatgaacggctgagttgatcctggccatagtcaatgaagagggccccaaccctcagggaagtctctggcaaagccacaagtcagccttttttggaatctcagggttcctgaatcctgctgagggtcctgtcaggagtaagaacagctgaaaggaagtatgtgaatctcctatctatgtggagaggaaaataaacctctattcccatcacatttgggcaaactggcactgcctcttaagtcagtaaagtatttgtggacctggtcaggtttctgtcatcaacacaacatcccccattcatgactttctggagtagaactgctcacattatatttcttggacccccagagttccagaggtcagcaggaggactggccaagtaagagggaattaatgcaaagttgtcccaggtagccttcccccagccactattgagatttcaagtcctgctctcaggaagcaaaggttcatgaaagcagtcaggccttttatggctgagacaagggggcagaagtagctgctatttcctgtgctcctctttgactcttatcttacttctccctggtactgaagtgaccaaagaccccagcctctttcagtgctttcaaatccagccttacagatgctctaatttactcatactgcgaacttgcttaaagataatttatacaaagacttattattctaagaatgtctgtgtatttctgaggttttttataataaacatattttaaggtaggttttgaatttccctgtaattgttttttctgtttaatatgaaaaagggttccacttacattagggtttttgtatggatattctgttgttccactgacacttatttcaagaagactgtctcctgttctaaagctgcaagttttaaaaatcagttaagcacatgtttatacatgttttgttggttttgtttttcagaactctccattcagttcctttggtctatctgtcaatctctgcacccaaatctcaaactcttcattatagtagctttgtaattcttactgtctggtagactaatgactctttttcaagtgtatattgactatgcttgtccatttgcatgtctttatattttagaatcaggtgattcacacatgccttcatgtccaaagccctttggcagttttgatttaggattgcagtcgatctgtagattcctttttgggaagaatcaacatatttaaaatattgaatcttcatgcccatgaatttattttattttatgttcaggtaggtctttgttaatatgcctcaacagcattttaatatttttgtctgtaaaaattttttggttaagcttttttaaccaaaaaatattttaaccagccatcagctgcctcccagtcttatttggttaaaatgtttttggttaaattattttcctaagatacttgatattttggtactataggttaaaattatatagtctttactttcattttcatactctttccctgacaaaaaacgaagttgatattcttttgaatattgaccttatactagcaaactgatatactattatatattgaataaattatctttagttgttttggattcttttcatgcacagtctaatcatgcatgaatcacaaacgctttgtttccaactggccaatcctcattccttcatttactgctctttggattactacactggctactacctctagtataaaaagtaatagaagtacttgtagcagaaactctaggttaggtctcaagttcaaactagaggcttccaacatttccttaaaagatgtatctgttgtaggtttttcatgcatatccttttatctagtttggtaacatttttcatatttgataaactttatgtttaaataattttagatttacaagaaaattataacaatagtaagaaagttctcatatgttccacactcaatgcctcctgttattaacaccttaccttggtaaggtttcctaaaactaatgagccagtatttgtacattgtttttaacaaacattctttatttattattgaacatacttcagtcacattttcttacttttcacgaaattctattttctatgccaggatcccctaaggatactccattacatttagttatcatgttccttcgatgccctttggctgtaccggttgattgagacatttctcgattttgaaaacattgacagttttgacagtttcgtatggttaggtattttgtaaaattgactttgactgggatttatgtgatttttttctgtcatgatttgatgtaggtaatgtttcctggaaggatgaacagagaggtgaagtgccgttcttatcataccgacagcacatagtaccaacaaaatttgtcactgatgatgttaacttgattaccatggcatcatcgtgctttttagctttattcagggtaaaattacattattttttgccgtatgttatactgtcatcatgagaagaacagggagacccaggaccagccagtagtcacatgaagcctctgagagataactgcaagactccctgcccacaaagagaaggatccacagaatccagctccactgctgctgtcagccctgggaggccctggggcatggtggcccactgtggtgtccccctgacattttagagggtagaaagaggagaaggctctgcctaggtgagtctcacttcagatcatgagaggtgaagggactcaggcccttccaggcatccccaggatgacacagaggaaggactggtgagacacccctcccaagaaacagaaggacacacaaatccaggccctgttttcacccctgggaggccttgggcagggccctcagtcagagatgctagcgcttttcacttcgtcttggggggcgtctcatggaaatggggaccttgatctgaagaacatagtctctggacagcaggggaagggctcccaggccatgtcaggaataataactgcaggaaaacagagagtcctgcccaccccattttagaaaaaggacaccagagtcctgccttgggcctgggaggccccaccccactgtgggtggatgtgattctccctctcttgcaccttgcaggtctcagggatgggaggggcttattcggaggtgaaagactcagttgcacagaggcaggaaggccaggcggtttccaggagtccaggcacagcctctcgggaaggcaggaagggaacacccatgactggtagtgcccctcccctgtccctgtgcctgctgccagctctggaggaccctatcagggtccccaggtttacaactttctgacttgcattttgggagtcagccggaggggaagttttctctgaggagggcagtttcagttaagcagagggaggaaccccaggactggccactcaacgagaagagaactctgtggaaggacagtgaccttccaacatggaggagaggcacaggctacaccctttcccttcctgccgtcagccctggaaaaaggttgtggggggagaaagcggggaggtgggcagggaaatatggacgagggctttgaagtgaggaggaaaaggtggagggataccgagaggtgggcaggaaggggtggaaagggtcggggaggtaggcaggaaggggtggagggggcccaggagatgggcaggaaggggtggagaagggccgggaggtggtcaggaaagtgtgggaaagaggtagagaggtgaggggtggttcctccatagagaggagacctagccccactgggagtctgaagtatttgaggcattttgtgagaaggcttaattgagatcagcagacagaagactcttagaactggccgatcctcaaggtaagggccctaagggagaactgagggacctcccaccacagaaagaagaagctcttgcctgccctctacctgctgtgagattgtaggtcgcagacaggaagagggtaaccgagggctgagggacacgtcttcatgacagaagaagggaggaggtgccagctctctagggaataaataggaagactttgagaaggacaaggggaaacgccacctcagaggacagactcccagagattcccagcatgctcctccatatcagccctcgtagagctccccagtcagctcaggctgagcggcagccctctcattgctgggtgagaggtgcagggaaagggaaggccttggtctgagggtcccgtggcaaatcagcacagggagctgcctccagttggcagagggaagattcccaggccctgctggggataagagtgaggactgaggagtcacatgtgcatcagaacagatgtgaggccagcccaactgcccccgtggtagagtgctgggaggtggctgccacctcactacctcccactgctctcagggatgtggagtttgccctgagttttggctagaagagtggtagggacatggccctgtctgagaaaaggtgaggatgctaattaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggtgagtgcacgccctgactgtgtaccaagggccctacccccacaaacagagcagacctggcagcacctggccatagccacctactgccattcctggtgcctcaggctctgcctgccagctgtgccccgaggtgctttctcacatcctcctacaggttcccaggggacaaaccccctaggatggcaggtgacccgtgaggccctagagcaccaccttaagagaagaagagctgtaagccggcctttgtcagaaccaccatgggtgagtttctcagctgaggccacttgcagtgtccctctctccctcaggcctgttggatgccatcatccacatccctgctcacacatttacctcctgctcctaaggaagacgttatgcctgtgttttgaaatgttcctagcggcaactttgagaaagacttccagaaccaaactgtgatagagaacttggcagatgcacaggattccacagaggaggaagaggagaaaacctcctccatttcctcttcctctttctacttattattcccctcctcttccttctcttcttcctccttctcctcctctttctcctcttcctcctcctcctcctcctcatcctctactctgattcttggtgctcatgaggaggaggaggagtagctgtctgctgggatgctgcctcttccccagaatcctcctgagagtcctccccagggtcctctccagggttccctgtcctgctcctcctccactttatgaagcccattcaatgaagagcctagcagccaataagatgaagatacaagtacctggcacagcttgccagagagcgagcccttgttcacttatacactggatgaaaaggtggacaagttggtgcagtttcttctcctcaaatatcaagcaaaagagcctctcacaagagcagagatgcagatgaatgtcatcaacacatacacgggctactttcctatgatcttcaggaaagcccgtgagttcatagagattctttttggcatttccctgacagaagtggaccccgaccatttctatgtctttgtaaacacattagacctcacctgtgaggggagtctgagtgatgagcagggcatgccccagaaccgcctcctgattcttattctgagtgtgatcttcataaagggcaactgtgcatctgaggaggtcatctgggaagtgctgaatgcaataggggtgtgtgctcagagggagcatttcgtctatcgggagcccagggagcttgtcactaaagtttgagtgcagggacattacctggagtagcgacatgtgcccagtagtgctcctccacgttatgaattcctgtggggtcctagagcccattcagaaactagcaagaggaaagtagtgagattttggtcatgtgaaacaataccgtctctagttcctttccaatctcttccaaggatgctttgaaagatgtggaagacagagcccaggccataattgacaccaaaaatgatgctactgccatggccagtgcaaggttccgtgtcatctccagaaacttctcctgtcctgagtgaagtatagggccgtttcttacgtctgtgtttgaagagggcagtcagggtcctaggtagtggagggcccgggtggggcttgagggaacaatacagtgttctttgcatttctgttccatatgggagagatagatttacctcgtttccttttgtgtactttttgaatgattttccttttaatagtaggttgaattagcttcagaatattattttataaatattagtcacacatatattgctgtttatctagtttaagagtaacagtttgatattttgtaaaaaaaaatggaaaaagcttgtctcttattttgtgatctataacaggataacatggtattgtactaggaattttctttaaattatgtaagaactcagcagttaaatagtggaacgaaataaaggatggtgaatagttacatttccttatcccgtttatactgttgttcttgaaaattaaagaaatagacctggctttgcttagctcattcaagaaagtagcagaaattaaatgttaataaataaaagcatctctgacggctttatttgcctaacattctgtgagcatttgcttgcggaggggactcttaatagtggggatacagtgaaaagcaagagttatgccttacctataaaacaatagagtctaggagcagaagccatgtcaagaaggtggtaagatgctctctacaatcataagtttcaaaaaagtggggaggtgagactccagatggagtcttcaagtataaagtccctgagctaaggtagtgtggggcttcgggaaactgcaggtgcttctgtgggagctgattgttatgaagctgggtggtggcaggggccagactctcagaaggtgagagaaaagcctgcaatggaaaactgctctgagcagttccttctgggtggatgatgagggagagaggagtctccatgtggggaagtaatggaagctgtcttgcagctctctaactggtgagcttgaacacagtgcaaggactaggtgattgatacccatcatttgcaagtgtttcctgagaaataaggcgataattccttgaaatgctgcccagaagcttctaggctggcactcattttcctagcctgggagagccagagtccattccattgaaaggtcatttaattaggttattttaaatgtaatgtgggcaactgtaagcaagggctagatttttagtggaggataaatagaaatagttgtttggatggatgagcaaaggggaaggtgaaaaggagttggtccttgattcaaattcagcactttgatgtaaattttcagtttggatagtgacaattccatatctatcctgggcatcttcaaacactctcaaaatactcccacatagggtggtgagtagaatctgatttgccacataatatactggttctagggatgtaatcttagggtaagagatagagtttttgagatcatcctaatatttgatatttgtattgggattttaatatatgatatttgtagtaacattgtttgaagcaggccactgaagagatacacagatgaatgagctataccaggtggtcaaaaagcaaagcttccttcataaacttggtatatgagataaaattttggaaatcactttgtaaataaattacaaggagctgaatttctaaaaacagaacaataacaaaatccttaatactgcttagaaggtgacaagtgttccttgacagacaggctagctctgatgagaaaagaaaattatggttaaccatccttccattgtctcttttctgtgtacctgccccacaggaaaatcttggtttgcagtgtgccacaggcacatgtacagctgttcaggaatgttcagtcatgtagagggtattagaatctctcatggtaggatatttaccgtataccaaaagcagtgagagaattctcagtctaaagagattgtattgtgtgatggttaatactgagtgtcaacttgattggattgaaggatgcaagtattgttcctgggtttgtctgtgagggtgttgccaaaggaggttaacatttgagtcagtgggctgggaaaggcaggtccacccttaatctgcatgggcacaatctaatcagctgccagtaggaccagaataaaaagcaggcagaagaatgtaaaaaggctagactggcttagcctcccagcctacacttttttttcctgtgctggatgcttcctgccctctaacatcagactccaagttcttcagcattgggactcggactggcttccttgctcctcagcttgcagatggcctattgtgggacctcacgatcatgggagttaataaactccataatacactcccctttatatatacctctatcctattagttctgtccctctagagaaccctgagtaatacagatttttgtaccaggagtggttctagagaaacagaatattaaggatggaggtctttcattggttttggggtttctggagttggatgcttaatgtgattagacccaaaaatgctaaggactctaattctaatggcgtggagaacaccgatagcctttggcgtgaactgtttagagaattatgcaaaataaatgcatttgacactcctgattaactgcttgtgagaaaaaagtttagtgaccctatatttaatacctttgaccatatgtggagaatcaaggaacataatgaagttggttggttgctcctaaatgcactggacaaagggatgaaagaaaatgatgaactcagggattctgactcctggctccagaagcagatactgagcctcaaatctgctaggattgccctgagtgagagtcttatctcctgtagagaaagacctgaaatttccacctttgtctgaggagataaaccctgtgctgcctgagtcaacagtgatggcctcctctgaggcagttgccaggcaagatagtgttgcttcttctcaggacccacccccaaaatccctgttgttttctagacctataactagactaaagtcctggcgggcgcctagaggtgaagttcagagtatgaccccgtgaggaggtgcattacactcgaaaagaactgcttgagttttttaatttatataagcagaaatctggagaacaggcatgggaatggatattaagggtgtgggataatggtggaaggaacacagagtttaatcagactgaatttattgatttgggtccactaagtagggattctgcatttaatgttgcagcttggggagttaaaaaaggttctaaggccgggcgcagtggctcatgcatgtaatcccagcactttgggaggctgaggcgggtggatcatgaggtcaggagttcaagactagcctggccaagatagtgaaaccccgtctctactaaaaatacaaaaattagctgggcatcgtggtgcgcgcctgtaatcccagctactcaagaggctgaggcagagaattgcttgaacccgggaggcagaggttgcagtgagccaagatcgtgccactgcactccagcctgggtgacagagtgagacttcgtctcaaaaaaaaaaaaaaaaaaaaaaaaagttctaatagtgtacttgcttggctagctgaaatatggattaaaagatggcccactgtgagtaatctggaaatgcctgatttcttgccttggtttaatgtagaggaagggatccaaatgcttagggaaattgggaggctggagtggattagtcattttagacctactcatcccagctgagagggtccagaagatacacccttgaccaatcctttgtgaaacagatttgtgagggcagcacctgcatctttgaagagatctgcagggattggtcttctctgtatgccagatctaacagtgggaattgtagtcactcaactaaaaaatttaaatgcaatgggaataattgtatcccgaggtgcaggggtcaagtggcagcactcgaccatcaaaggcaaggcgggtatagctaccataatggacagcagaggcaaagcagcaatcagaatagtttgactcctgtagagctctggcattggctgattaatcacagtatttctagaagtgaaattgataggaagcctactgcattcctacttaatttatacaagcagaaaacttccatgttaagtggacaaaaaactgattcaaattataaaaacagagaataacggcccctcaatttccagacttgagccagtttgcagacccagaaccccctgaatgaaggggaggctgggtccccttgaggaaggactccactacactatcaacaatttatgctgttaatctttctcccatccttccccaaggacacctctggccttctactagggtaactgtgcactggggaaagggaaataattggacatttcgggactactggacactggctctgagctgacattgattccaggggacccaaaatgacattttggtcctccagttaaagtaggggcttttggaggtgagatagttaataaatatttagctcagcttggacttacagatgatccagtgggtccccggactcatcctgtggccattttcccagtgccagaatgtataattggcatagacatacttagcagcttgcagaacccccacattggctccctgactgggagggtgagggctattatgaagggaaaggctattatgaagggctattatgaagggaagggaaaggccaagtggaagatattagagctgcctctacctagaaaaataataaatcaaaaacaatatcgcatccctggagggattgtggagatgagtgccaccatcgaggaactgaaatacgcaggggtggtgattcccaccacatcccccttcaactctcccatttggcctgtgcagaagacagttggatcttggagaatgacagtggattatcgtaagcttacccaagtggtgactccaattgcagctgctgtaccagatgtggtttcattgtttgagcaaattaacacatctcctgatacctgggatgcagccattgatttggcaaatgcctttttctccattcctgtccataagtcccaccagaagcaaattgccttcagctggcaaggccagcaatatacctttaccgtcatacctcaggggtacatccactctcctgctttgtgtcataatcttattaggagagaccttgatcgattttcccttacacaagatcactggtcgactacattgatgacattatgccgattggatccagtgagcgagaagtggcaaacacactggacttattggtgagacatttgcattccagaggatgggaaataatctgactaaaattcagggaccttctacctcagtcaaatttctaggggtgtagtggtgtgggggcagttgagatattccttataaggtgaaggataagttgctgcatgaggcccctccaagaaagaggcacaatgcctagagggcctatttggattatgaaagcaacacattcctcatttgggtgtgttactctggttcacttatcgagtgacccaaaaggctgccagttttgagtgaggttcagaagaggagaaggctctgcaacaggtccaggctgctgtgcaagctgccctgccacttgggccatatgatccagcagatccaatgctgcttgaggtatcagtggcggatagggatgctgtttaaaccttttggcaggcccccattggtgaatcacagcagggggctctaggattttggagcaaggcccttcaatcttctgcagataacaactctccttttgagagacagctcttggcctgttactgggctttcatggaaactgaatatttgactgtaggtcatcaaatcaccatgcaacctgaactgcctatcatgaactgggtgctttctgtcccatctagccataaaatgggtcatgcacagcagcattccatcatcaaatggaaatagtgtatatgtgattgggcttgagcaggtcctgaagacacaagtaagttacatgaggaagtggcacaaatgcccagggtctccacccctgccaccctgccttctctcccccagcctgcactgatggccccgtggacagttccctatgatcagttgatggaggaagagaaagctagggcacgatatgcaggcaccatccaaaagtggacagctgcagcactacagcccctttctaggacatccctgaaggacagtggtgaagggacttctaagtgggcagaacttcgagcagtgcacctggttttgcactttgcatggaaggagaagtggccagatgtgcgatgatatacttatgcatgggctgtagccaatggtttggctggaaggtcagggacttggaagaagcatgattggaaaattggtgacaaagaaatttggtgaaaaggtatgcagatggacctttctgagtggtcaaaaactgtgaagatatttgtatgccatgtgagtgctcaccaatgggtgacctcagcagaggagcatgttaataatcaagtggatagtatgagccgttctgtggacaccactcagcctctttccccagccatccctgtcatcttccaataggcccatgaacaaagtggccatagtggcatggatggaggttatgcatgggctctgcaacatggacttgcactcaccaacactgacctagccatgaccactactgagtgcccaacttgccagcagcagagaccaacactgagccctcgatatggtacctttcctcaggatgatcagccagctaccttgtagcaagttgattatattggacctcttccatcatggaaagggcagcagtttgtcttcactggaacagacacttattccagatatgggttcgcctgtcctgcacacagtgcttctgccaagattaccatctgtggactcacagaatgccttattcaccgtcatggtattccacacagtattgcctctggccaaggcactcactttatggctaaagaagtgtgacagtgggctcatgctcatggaattcgctgatcttaccatgttccccatcgtcctgaagcagttgcattgatagaacagtggaatggccttttgaagtcacagttacaatgccaactaggtgacaatactttgcagggctgggacaaagttctccagaaggccctgtatgctctgaatcagtgttcaatatatggtattgtttctcccatagtcaggattcgtgagtccaggaatcaaggggtggaaacaccactcaccatcacccctagggacccactagcaacacttttgcttcctattcccatgacattacattctggtggcctagaggtcttatttccagagggagaaacgctgccgccaggagacacaacaatgattccattaaactggaaaataaggttgtcacctggacactctgggctcgtcctacttttaagcaaacaggctaagaaaggagttacagtgtttgctggggtgattgacccgggctatcaagatgaaatcaatccactactctgcaagggaggtgagaaagagtatgcaaggaatacaggagatccattagggcatctcttagtattaccatgccctgtgattaaggtcaatgggaaactacaacagcccaatccaggtaggactaccaatggcccagaaccttcaggaatgaaggtttggttcactccaccaggaaaaaaatccacagcctgccaaggggtttgctgaaagcaaatggaatacagaatgggtagtagaagaaggtagtcatcaataccagctacgaccacatgaccagttgcagaaacgaggactgtaattgtcatgagtattttctccttcttttctttagttaaaaacatgtttgtgcgtgtacacacttgtactaagaaaatatctttattttatttcttattttcctttatcatgtgacataagatgtgttgacttcatatcagcatttaagtgtgttaactttatgtaatagcatttggattggggatcggtgcatttctggttgtatgaaggagagttgtattaactcccttaataaactccccttaatatgtacatctgtcctattagttctgtccctctagagaaccctgactaatacatattggttatttttatttttattttttgagacagagtctcgctctgtcacccaggctggagtgtagtggtgtgaactcggctcactgcgaactctgcctcccgagttcaagtgattttcctgcatcagcctcccaagtagctgggactacaggtgcgtgccaccaagcccagctaatttttgtattttttagaagaaacaggggtttcaccatgttgtccaggctggtctcaaactcctgacctcaagtgatctgcccgccgcagtctcccaaactgctggaattacaggcatgagccccaccacacctggcctatattgattgttaaaaggacagtgcagaaaagtgctgttgagaaataaggttgcccgtccctgccaagacatctaaaattgttttaaacctagatgcaattctgtatttgaaacctccagtcacctagtaggtgcaagaaaaagttgaaatatttcaaggtaatgttggcattcccagaaacaattccaaaaatgaggagacttactatcataaattataacagttgcttttaattgagcaacagcttatgggagagaacacaagcgcccatctccatcttgtataccctgtctttatggttggttcatttgtagttagatagaagccagtatatcattccaatgttttcatttctgttcagcagttaacatctgttgtgatgtggaactgcaaggtgaaagcagcttggattcctgggtgacgtgagagccatgatccgctatggattagtttattattccataactaaatactacagactgtgtgattaaacaatagaaatgtatttattcacatttctggaggctaaaaaatccaagatcaagatgttgactggtttgaattcttctgtgggctctctttggcttgcagatggccaccttctcgctgaatttttacatgattgtccctctttccgtgtgtctgtatcctaatctcctcttcttgtgaagacgccagtcatattgaataagatcctaaccataaaacctcatttccccttaattacctcttcaaaggctctatgtccaaatgcagtgactttgtatgtgtgcattttgaggaaggggtataattcggcccataacaccctgccaactaaaatcagaatttctatgcacaaaaataaacttgttgtgttaaatcatttaaatttcaggaaatgttttcattccattagctcactgttactttatctgactattacactgctcctcttccttttattaggcttactttaatgcttttcttacaaataaatactgcatatattattgttgcaaaaaaaatgataaaaatacatggaaatcacaattctctcctctgcaaagttcctccaaaattcagccccctactcagaactttccacaatgtggtgtgtaaattttaaaagctaatttcaagtttttaaaagatagatgtggtaatgtgtgtgtgtatatatatatgcatatataaatatatatatttatatatgcatatataaatatatatatttatatatgcatatatttatatatgtgtgtataaatataacaaaacatgagtaatgacatacatgtaaatatgccacttgcctttgccactctgataggttcaattgcattcccctaaagttctatcttgaaattaaaaacgtgacattatttggagataggattatttcagaggcaatcaagttaaaatgaggttattaatgctggccctaatcaaatatgatgggagtcattttaaaaaggggaaatttggacatagagatatgagtagaaggatgataatgtcagcatacttggactgaagacagccatctacaaggcaaggagagaggcctggaatataacttttcatcacagccctcagaaggagtcaaccttgtatacaccttgctttttgactaccagactccaaaactgtgagacaatatatttccgttgtttatgtcatccaggctgtggtacattgctatggcacccctaacatgccaatataatcatttattgaaatggatccaagatcgttccatgacagcacaaatgttaataaatctatcttacttttgcaactacttcctagaattccagtttatttctgtgcaataatgaattgaacaaatcttctgacagacaaatatatgtttatcttttgtggctataattcatgtaaataaaatcaacatctctgagcataaattctgggacaagtacatataattacttataaggaatgcattttaatgaggaaactgagtcagtatgaatattttctattttttaaatgttactgacttttttcctaaaatatttcaccaattaattctctcacattaacagaggaaattattattatttaataataatgattattattattccccataattgtctatggggaaatgattcatttattcacaaacacattttatcagagttttaaatgtttgtcaaacttatgggggcaaaccctaggtgactttgggtttggtgatgacttttttagatgtaacaccaaaatttggttaaacttatgggtgcaaaccctaggtaaccttggttttgatgacggctttttcagatgcaacactaaaagtaccagctacctaagaaaaaagagataaattggacttaattaaaactaaaaacttttgctctgaaaagtcactgttaagatcttgaaaagacaagccagcgactggcataaaagttttgtgaaacacatatctgataaaagatgtatatttaaatatgcacaaaacgctgaaaacccaatcataagaaaacagaaaacccaatttaaagtggacaaaaactataaataagtacacaaacaatgaatatataggaatttaaaatgagcatattaaagagttcaatgtcatatggcattttagagaagtgcaaattaaagcacctaggagatagcgctctacacccaggagaatggctgacgtccaaaacactgaaacatcaaatgttgacctgtatgttgagcaacaggagctttcagtcattgttagtaggacagacctggaggaatcataaaagcataaggctaagtgaaagaagaaaatcttaaaaggctacataatgtatgattccaatcatacaatatttagaaacagttcattatgaatacactaaaaatatcagtggtttccggaggctgaggagttagggttggggcaagggggattgataggtggagcacacaagagatttaaaatggtgtaacaagtctgtgtgatactgtaatgatgaatactcaccattacacacttatcaaaacctacagcatccccaacgttgagtgattcctgatgtaaactgtggacttgacctaataatgaggtatcaatacaggtccatcagttgttgcaaacatgccataataatacaaaatataaataataggagacactgtgtgtgtgtgtgtgtgtgtgtgtgtgtgtgtctgtgtgcgtgcatagggcagggcaggagggcaggaattgggggggggggcgtagatatgtgagaactctgtaactttgatgaagttttctctctgtatttttggattagcaatgctctaaaaatgatgtctattagtttttaaaaagacacaaatgatttgaagagaatataccaatcaggaaaaggcatataaaaagatgaccaacgtcatttgtcattaggaagatgcaaacaaaaaacaaaggagattcaaatacaggcttattagaatggctgaaatctgaaaatctaaaatactaaatggaagaggggatatgcaacaagaggaattctcattccttgctagttgagatgaaaaatgatgcagccagacttttaaatccatgttttgtggacctactcatatgacaaattgtgaaagttaaaactatatgaactgcaaacagagcatagttgctagagtctttggagaagtgccttgactgacctcaaaagagatgcacaggggacttttcgggtgatggaactggtcagtgtgacacttggttcgtagatatggaactccacgcatttgctaaaatacatataatttcacataatagttaaatctgatgagtgtattttaaaaattaataaaaattataataaaaattaatgacattaaattaataaaatgttaaaaataatttttttaaaagatcacgcacaggctgctgaaaagacaatggatttttctgggacaaggatagggaaagaagaaaactaagggagcctttgacataggtcaggagagagattctattaacttcacacacggtagtacttaaagtagaaggttttggaatggattttagaggatgacagaacaactgttgctgtcgggacaggagaaggggggagtgccggccctggaaggagtaaaaccttgaggaagactgaggggccttcccacctcatttcagacacggggcagcttcagttaagcagagaaaggagccccggggctggccaacaagcaagaagggaactctgtggaaggatagctatctcccaacacggagggaaggcccaggcgtcgcccagccactccttgctgtcacccctggacaaaacagatggagaggtgaaaacggagaggtgggcagggagaggtgggcgaagggcagggaagtggacaggaacaggtgggagtggggaggtaggcaagaaggggtgggagggggcaggttggtaggcccgaaggggtgggaggaagttgggaggtgggtaggaaaaggtgggagggagtgggaaagtgggcaggaaggagtgggagtggtgggaatatgggcaataaaaggtgaaagggggcagtaggtgaacaggaaagggtgggaaggggcggggaggtgggcattaaggagaggaaggggtcagggaggagggtgggagggggtagggaggtgggcacaaaggggtcggggggcgctgaggagggcaggaagaagtggagtgcggggaagtggtcaggaaaaggtggaaggaggcggagaggtggggggtggtttttccatggagaggaggccccaccccacgctgcctctgctgtcagccctggtcagccttggcagggttcgcggatgtgctttcccgacttgcactgtgggagtctgaaggacctgaagcattttgcgaggagtctggactcaggtcagcagagggaagcgtcttagacctggccaatcctcaaggtaagggccctaagggagaactgagggacttcgcaccaaggacagaagaagccccggtctgccctgcgctgccataggacttgcaggccacagacaggaagatggccgccgagggctgaccgaggcgtccccacaacagaagaagggaggaggtgccagccctctagggaataaataggaagacattgaggaggactgggggaacccccacctcagaggacagcttcccagagattcccaccctgctcctcatatcagccctcgtagagctcctcagtcagctcaggctgagcggcagtcctctcattgctgggggaggggtggaggggagggggaggggtggaggggaaggggaggccttggtctggggggttccatgacaagtcagcagggagagttgcctccagttggcagagggaagattcccaggccctgctggtgataagagtgaggacggagaggtcccacgtgcatcagaacagacgtgaggccaccccgactgcccccgtggtagagtgctgggaggtggctgccacctcgctacctcccgctgctctcagggatgtggagtttgccctgagttttggccagaagagtggtagggacatggccctgtctgagaaaaggtgaggatgctaattaaattctgatgggaccatgcagtccagaactgtggggctctgggagtctggtcagccccagctgtcagccttgggaggcccaagactctgcttgcagtctttagcctgaggggctccctcacttcctcttgcaggtgctccaggaaccaggagttgaagacctgggtctgaggcacacttcctaaagtcagcacagcagaggaggcccaggcaatatcaggagtcaaggtgagtgcacgccctgactgtgtaccaagggccctacccccacaaacagagcagacctggcagcacctggccatagccacctactgccattcctggtgcctcaggctctgcctgccagctgtgccccgaggtgctttctcacatcctcctacaggttctgagggagcaaacctcttaggaagacaggcgacctgtgaggccctagagcaccaccttaagagaagaagagctgtaagccagcctttgtcagaaccatcataggtgagtttctcagctgaagctactcacactgtcactgtcttcctcaggcctgtgggatcccatcatccccatccctgctcacacgtttacctgctgctcctgaacaacaggcctcatgcctctctttccaaaccttccacgcctcagctttgaggaagacttccagaacccgagtgtgacagaggacttggtagatgcacaggattccatagatgaggaggaggaggatgcctcctccacttcctcttcctctttccactttttattcccctcctcctcttccttgtcctcatcctcacccttgtcctcacccttaccctctactctcattctgggtgttccagaagatgaggatatgcctgctgctgggatgccacctcttccccagagtcctcctgagattcctccccagggtcctcccaagatctctccccagggtcctccgcagagtcctccccagagtcctctagactcctgctcatcccctcttttgtggacccgattggatgaggagtccagcagtgaagaggaggatacagctacttggcatgccttgccagaaagtgaatccttgcccaggtatgccctggatgaaaaggtggctgagttggtgcagtttcttctcctcaaatatcaaacaaaagagcctgtcacaaaggcagagatgctgacgactgtcatcaagaagtataaggactattttcccatgatcttcgggaaagcccatgagttcatagagctaatttttggcattgccctgactgatatggaccccgacaaccactcctatttctttgaagacacattagacctcacctatgagggaagcctgattgatgaccagggcatgcccaagaactgtctcctgattcttattctcagtatgatcttcataaagggcagctgtgtccccgaggaggtcatctgggaagtgttgagtgcaataggggtgtgtgctgggagggagcactttatatatggggatcccagaaagctgctcactatacattgggtgcagagaaagtacctggagtaccgggaggtgcccaacagtgctcctccacgttatgaatttttgtggggtccaagagcccattcagaggccagcaagagaagtcttagagtttttatccaagctatccagtatcatccctagtgcctttccatcctggtacatggatgctttgaaagatatggaagacagagcccaggccataattgacaccacagatgatgctactgccatggccagtgcaagccccagtgtcatgtccaccaacttctgtcctgagtgatgtctgaagcagattccccctctgtgtttgaagagggcagacaaggttctaggcagtggaggtccagagtggagccggagggaccacagtggtttttgtttctgtttcatatgagtgacttaagagtttaacatttttttgtggggggtatattttacaaatgcttctccttccaattgctttaattcacttcagaatcttagtttatgaatattattcacacttgtattgccgtttgtctgatttaagagaaagagtttgatatttcataaaaaaagggaaaatctgtcttattttatgaactgaaacagtataatatggtgttcagataagaattttctttaaaatttgaaataactctgcaattaaatggtggaacagaataaagtatgtgatatttgcatatccttatcatgttactctgttgttcttccaaattaaggatatatacctggctttgcgtggcttattcgagaaagtagcagaaattaaatcttaataaataaaagcttcagtgactatttgctaaacattatttgagcagttgcttgtggagcgtgctcttagtagtggggatactatgaaaaccaagacttatctctacccataaaatgttagagtctaagttcagaagctgtatcaggaacatggtaagatactctctacaatcataaaaacaagtttaaaaaggagtgggcaggtgaaactccagatggagctttcaagtaaaaaggcccagagctaaggcagttttgcccttcgggaaacttcaggtgcttctgtgggagctcatggttatgaagctggttggtggcagggcccagaccctcagaaggtgatagaaaaacctggaatggaaaactgctctgagcagttccttctggtgtaggatgaggaagagaggagtctccacatggggaattaatagaaggtgtcttgcagctgtctaactggtgagcttgaatacagtgcaagaactaggtgattgatacccaacatctgcaaggctttcctgagacatagggcgataatcccttgaagtgttgctcagaagcctctaggctggcacttatttgactggcctgggagaaccagagcctactccattgaaagacatttaattaggttatttcaattgtaatgtgggcaactgtaagcaagggctagatttttactggaggacaaatgaaaatagtggtttggaaggatgagcaaaaggcaaggtgtaaaggagttggtgtttgactcaaattctagcatctttgagttgcattctagctgaagatgccttgccttttccaaattatacaatataccgtttcagaaaaaaatgtactgggttttatttatgaagccaaagttttggttaagctggtattccatgacgcattcacctacatattctctgagatgttatggataacaaaactaagagctgaatatttcacaaaagacggtaacctttggtgtggtaatcattgataacaactgccatttattaaaattccaacatatgccaggcactctggcaggtgttttactcacattacatacactccagcaattctataagacagggcttatcaaactcattttgcaggtgaagaacccaaggctcataatgcttgataaattcccaagaccacatagctagaatgtgacaaggttttgacttgagccctggtctgaattcatttaggcccacactgtccccactcctcccagcctgaggaaggcctttgcctgttaagtcacttcttttcacacttgttaatgtctctgaggtgaaataaagatgaactgtgtggctaaggtattaagttaggccacaagatggaaggtcaaatgggaataaaatacacttcggggaacattattggctttctttacctaaagtcctcttgttctgagccctaggtttcttgagagctgaatgtccaggtgctgacagatttgtccatgcccaacaatttttcccattgcagctccccccagctccttttgatctcccctgtgtggtctcttgtgcaactctggaacctggcctgctgactaacttctcattacggtctcaccctctgaagtgtgaggactgaggagtcacatgtgcaccagaatagatgtgagactagcccctatttctcctggtgtagagtgcctggaggtggctgctgaactctcagcgcaagaacctagaagcaactggccttcccctgagatagaccattcctactgcctgcagaagttccctgactcatccatctctcccccaggttcctctatgataatggcctttcgatgtgactattcgctttggatagtgacatttccatacctaggctgggcatcttcaacacactctcaacgtattaccaaacaggctgcagagtaaaatctgatttgccagataatatatgggttttagggatgtaatcctaaggtcagaaatagcctatttgaaatctttctaatatttgatacttgtagtatgattttaatgagatgcattatttgaaacagggcactgaaaacagagatgaacaggcttttgtagatgatcaaatgccaatctttccttcataaactttgtagatgaggaaaggctatagacgtcactttgtaaatgatccacaagaaggtgaatttctaaaaaacacaaaacaatatcttgaagactgcttaggaggtgacaaggatactttgggggacatgctggttttgatgagaaataaacagtagttaaatatccttccactctctcttgtctgtgtacctgccccacaagaaaatcctggcttgcagtgagccacaggcccatgtatagctgttcaggtatgttccgtcatatggagggtagcagaggctcacagggtagattatttaccgtacacgaaaaatatgacagaattctcagcctaaagaaattatacaggttattaaaaaggacagtgccaagtgctgttgagggaataacgtagaccctccctgccaagacttacagaattgttttaaaactggatgtaatcctgaatttgaaaccaccagtcacctcgtaggtgcaagaaaaagttggaagatttcaaggctacgaggacattcccagaaacaattccaagcaatgaaggcacttactgtcatcaattataatagttgcttttcattgagcaccgtaataacatatgggagagattgcaagtgcccatctccatcttgtctagctcgccttcctggcgggttcatttgtagttagacagaagccagtgtatcattcccatgctttcatttccgttcagcacttaacatctgttgtgacgtggagctataaggtgacagcagcttggattcctggctgaggtgaaagccaggacccgccgtggattagtttcttataccataacagaataccacagacggggtgacttaaacaatacaaatgaattttctcccatttctggaggctaaatatctaagatcaagatgtgggccagtttgatttcttccctggcctctccgtggcttgctgatggccactttctcactaaattcttacatggtttttccttggtctgtgtgtctgtatcttaatctgctcttttatgaggacacctgtcatactgaatatgagcctaaccttaagacctcattttaccttaattacctctttaaagtttctatcttcaaatacagtcacattctgggatactgggttttaagacggatatatgaattttgggggagattcaaaattcagcccataataccctgccaactaaattcagaatttatgtacaaaaaagtaaacgtgttgagtcatgtaaaaatgaaggatttttttgttgttgttccaagagcttactgttattttatctgcctcctggactgctcctcatccttttcttaggcttatttcaatactttccttacaaataaatactgcatatattgttgttgcaaaaacttaaaaaaagaggtagaaatcacaattctcccttttggaaagttcctccaaaattcagccccctattcagaagtttccacaattaaccgtgtggtgtttaaatttaaaagctgatttagaattttgagaagattgatgtggtttttaaagtaaaatttatacatatatgagcttatgtatgtgtttataactacacatgggtaataatatacatataggtctgccacttccctttccactattatagattcaattgcacccccactgaagtcttatgttgaaattaacatgtggcattatttggagacgggattatctcagaggcaaggaagttaaaatgtggttattaaagaagagctggtactattcctatgcaaacatcctttgtttattaataaacatactttattcacatttatttccttgtcacgaaagtctattttctgtcccaagataccctgaggatacgccattacacttgttcatcatgtctctttaaatgccctttggctgtgccagttcactgagacttctcttgattttgaaaacattgacagtttggaggtgtatggtcaggtattttgtaaaatagcctttgattgggaattaagtgattattttttatgatttgatgtaggttacgttttctcggaagatgaacagagaagtgaagtgccattcttatcatatcataccgacggcacataataccaacacaatttgtcactgatgatgttactttgatcaccatggtgacctagtgtttgtcagttttcttcagggtaaagtcacattacttttttccctgtgtcatactgtcatcttgggaaggataggaagacccaggaccagccagtagtcagatgaggcctctgagggaaaactgcagaaacctcctgcccacaaagaagaggatccacagaaaccagctccccacctgttgtcatccctgggaggcccaggggcatgttgacccacagtgctgtcccctgacgtcttagcgtgtagaaagaggagaaggctgtgcttaggtgagtctcacttcagatcatgagagcggaagatcaggaggggggccttctaggcatccccaggctgatacagaggatggactggtgagctaccccaccacggacacaggaggatccccaaaaacctgcccgttttcactgctaggaggccttgggcagggccattagggagagacgctagcgtgctccagtccctcttggggggttcatggaaatgggaaccttgatctgaaaaacagtccctggagagaagagggagggagtggaggccgtatcaggaataataggttgaggaagactgagggtccctcccatgccatttcagacggagggcagtggagccctacctggagtctgggaggccataccccactgtggatggatgtgattctacctctcttgcaccttgcaggtctcaaggatgggaggggcttattcggaggtgaaagactcagatgcatagaggcagggagcccagacaatgtcaggagtccaggaacagcctctcaggaaggcaggaagggaacacccatgactggtagtgctgcctgtcctgtccctgtgcctgctgccagccatggaggagcccatcagggtccccagatttacaaatttctgacttccattttgggagtcagccagaggggagattttctctgaggagggcagcttcagttaaacagagggagtagccccagggctggccactcaacaagaagagaactctgtcgaaggacagtgacctccgaacacgggggaggcacaggctgcaccctgccactccctgctgtcagccctggaaaaaggtggggtgtgagtgtcaaggactggggaggtgggagggaagaggtcagcagggcttagggagtgagcagaaaggtttggagcacatcctggaggtgggaaggaagggatggaaaggaggctgacaagcgggcggcggggggggggcgccttcctcctctgagaggaggccccgccccacgctatccgggctgtcagccctgatcaaccctgacagagttcccggatgtgctttgccggatgtgctttcccggcggccatcttgggagtctgaaggacctgaggcattttgtgacgaggatcgtctcaggtcagcggagggaggagacttatagacctatccagtcttcaaggtgagggccccgagggagaagtgagggacaaccccaccacagagagaagcagccctggcctgccctatccctgcggtggcacttgtaggtggcggaaacgaagatggtagccgagggctgagggacgtgtcctcacggcagaagaagggaggaaatgccggccctctagagaataaataggaaggcattgaggaggaccgggggaacccccacctcagaggacagattcccagagattcccaccctgctcctcaaatcagcccccatagagctccccaggtggctgaggctgagcggccaccctctcactgctgggtgaggggtgtaggggagggggaggaggaggccttgttctgggggtcccatggcaagtcagcatggggagctgcctccagttggcagagggaagattcccaggccctgctgggaacaagagtgaggactgaggggtcacatgtgcgtcagaacagacgtgaggccacagggaccgcccccgtggtagagtgctgggaggtggctgccacctcactacctcccactgctctcagtgatgtggagttttcctgaggtttttcctcaggccagcagagtggtgggggcctggccctgtctgagaaaatgtgacaatgctaattgaattctgagggggtcacgaacctcagaattgtgggactctgggagtctggccagccccagctgccgtcttagctggaggggctccctcccttcctcttgcaggtgctccagaaagcaggagttgaagacctgggtgtgagggacacatacatcctaaaagcaccacagcagaggaggcccaggcagtgccaggagtcaaggtgagtgcacgacctgactgtgtaccaagggccctacccccagaaacagggcagacctggcagcacccggcctgtagccacccactgtcattcctggtgcctcaggctctgcctgccagctgtgccccgaggtgctttctcgcgtccttctacaggttcccagaagacaaaccccctaggaagacaggcgacctgtgaggccctagagcaccaccttaagagaagaagagctgtaagccggcctttgtcagagccatcatgggtgagtttctcagctgaggccactggcactgtccctctctccctcagtcctgtgggatcccatcatacctattcgtgttcacacgtttacctgctgctcctgaacaatattcatcatgcctctctttctaaaccttccacgccccagctttgagcaaggcttccagaaggcaattttcatactggagttggtagatgcagaggatcccccagatgaggaagaggaggaagcttcctccattttctcttcctctttccactttttattcccctcgtcctcctcctgtttttctttctcatcctcatcctcctctctgcttctgcgttctccaggggacaaggatatgcctactgctgggatgccgagtcttctccagagttcctctgagagtcctcagagttgtcctgagggggaggactcccagtctcctctccagattccccagagttctcctgagagcgacgacaccctgtatcctctccagagtcctcagagtcgttctgagggggaggactcctcggatcctctccagagacctcctgaggggaaggactcccagtctcctctccagattccccagagttctcctgagggcgacgacacccagtctcctctccagaattctcagagttctcctgaggggaaggactccctgtctcctctagagatttctcagagccctcctgagggtgaggatgtccagtctcctctgcagaatcctgcgagttccttcttctcctctgctttattgagtattttccagagttcccctgagagtactcaaagtccttttgagggttttccccagtctgttctccagattcctgtgagcgccgcctcctcctccactttagtgagtattttccagagttcccctgagagtactcaaagtccttttgagggttttccccagtctccactccagattcctgtgagccgctccttctcctccactttattgagtattttccagagttcccctgagagaactcagagtacttttgagggttttgcccagtctcctctccagattcctgtgagcccctcctcctcctccactttactgagtcttttccagagtttctctgagagaactcagagtacttttgagggttttgcccagtcttctctccagattcctgtgagcccctccttctcctccactttagtgagtcttttccagagttcccctgagagaactcagagtacttttgagggttttccccagtctcctctccagattcctgtgagctcctcctcctcctccactttattgagtcttttccagagttcccctgagagaactcacagtacttttgagggttttccccagtctcttctccagattcctatgacctcctccttctcctctactttattgagtattttccagagttctcctgagagtgctcaaagtacttttgagggttttccccagtctcctctccagattcctgggagcccctccttctcctccactttactgagtcttttccagagttcccctgagagaactcacagtacttttgagggttttccccagtctcctctccagattcctatgacctcctccttctcctctactttattgagtattttacagagttctcctgagagtgctcaaagtgcttttgagggttttccccagtctcctctccagattcctgtgagctcctctttctcctacactttattgagtcttttccagagttcccctgagagaactcacagtacttttgagggttttccccagtctcctctccagattcctgtgagctcctcctcctcctcctccactttattgagtcttttccagagttcccctgagtgtactcaaagtacttttgagggttttccccagtctcctctccagattcctcagagtcctcctgaaggggagaatacccattctcctctccagattgttccaagtcttcctgagtgggaggactccctgtctcctcactactttcctcagagccctcctcagggggaggactccctatctcctcactactttcctcagagccctcctcagggggaggactccctgtctcctcactactttcctcagagccctcagggggaggactccctgtctcctcactactttcctcagagccctcctcagggggaggactccatgtctcctctctactttcctcagagtcctcttcagggggaggaattccagtcttctctccagagccctgtgagcatctgctcctcctccactccatccagtcttccccagagtttccctgagagttctcagagtcctcctgaggggcctgtccagtctcctctccatagtcctcagagccctcctgaggggatgcactcccaatctcctctccagagtcctgagagtgctcctgagggggaggattccctgtctcctctccaaattcctcagagtcctcttgagggagaggactccctgtcttctctccattttcctcagagtcctcctgagtgggaggactccctctctcctctccactttcctcagtttcctcctcagggggaggacttccagtcttctctccagagtcctgtgagtatctgctcctcctccacttctttgagtcttccccagagtttccctgagagtcctcagagtcctcctgaggggcctgctcagtctcctctccagagacctgtcagctccttcttctcctacactttagcgagtcttctccaaagttcccatgagagtcctcagagtcctcctgaggggcctgcccagtctcctctccagagtcctgtgagctccttcccctcctccacttcatcgagtctttcccagagttctcctgtgagctccttcccctcctccacttcatcgagtctttccaagagttcccctgagagtcctctccagagtcctgtgatctccttctcctcctccacttcattgagcccattcagtgaagagtccagcagcccagtagatgaatatacaagttcctcagacaccttgctagagagtgattccttgacagacagcgagtccttgatagagagcgagcccttgttcacttatacactggatgaaaaggtggacgagttggcgcggtttcttctcctcaaatatcaagtgaagcagcctatcacaaaggcagagatgctgacgaatgtcatcagcaggtacacgggctactttcctgtgatcttcaggaaagcccgtgagttcatagagatactttttggcatttccctgagagaagtggaccctgatgactcctatgtctttgtaaacacattagacctcacctctgaggggtgtctgagtgatgagcagggcatgtcccagaaccgcctcctgattcttattctgagtatcatcttcataaagggcacctatgcctctgaggaggtcatctgggatgtgctgagtggaataggggtgcgtgctgggagggagcactttgcctttggggagcccagggagctcctcactaaagtttgggtgcaggaacattacctagagtaccgggaggtgcccaactcttctcctcctcgttacgaattcctgtggggtccaagagctcattcagaagtcattaagaggaaagtagtagagtttttggccatgctaaagaataccgtccctattacctttccatcctcttacaaggatgctttgaaagatgtggaagagagagcccaggccataattgacaccacagatgattcgactgccacagaaagtgcaagctccagtgtcatgtcccccagcttctcttctgagtgaagtctagggcagattcttccctctgagtttgaagggggcagtcgagtttctacgtggtggagggcctggttgaggctggagagaacacagtgctatttgcatttctgttccatatgggtagttatggggtttacctgttttacttttgggtatttttcaaatgcttttcctattaataacaggtttaaatagcttcagaatcctagtttatgcacatgagtcgcacatgtattgctgtttttctggtttaagagtaacagtttgatattttgtaaaaacaaaaacacacccaaacacaccacattgggaaaaccttctgcctcattttgtgatgtgtcacaggttaatgtggtgttactgtaggaattttcttgaaactgtgaaggaactctgcagttaaatagtggaataaagtaaaggattgttaatgtttgcatttcctcaggtcctttagtctgttgttcttgaaaactaaagatacatacctggtttgcttggcttacgtaagaaagtagaagaaagtaaactgtaataaataaaagtgtcagtgactcatttatttgatgaacattgtatcagcatttgctcatagaaattactgttagtagtgaagttaccattaaaagcaagactcatccctaaccctaaaacggtagagtgtaggtccagaagccatatcaggaatgtggtaagattttctctacaatctaaagaataagtttaaaaaggagtggggaggtgagactccagatggagcctttgattaaaaaggccctgagctaaggcagttttgggctttgggcaactgtaggtgcttctgtgggagctgatcgttatgaagctgggtggtggcagggcccagactctcagaaggtgagagaaaagcctggaaaggaaaaccacttgagcagttccctctgggtggaggatgaatcagagaggagtctccacacggagaattaatggaaggtgttctgtggctctgtaactggtgagcttgaacacagtgcaaggactaggtgattgatacccatcatctgcaagttttcctgagaattttggttataattccttgatgtggtgctcagaagcctctaggctggcactcatttgccaggcctgggagagcccaagcccattccattgacaggacttttagttgggttcttttgaatgtaatgtggacaagtctaagcaaggtctagatttctcgtggagcttaaataaaactagtggtttggatggatgatcagtggggaaggtgaaaaggaattggtccttaacttaaaatctacaatctttgagttgcattcagttgtggaagcctcttctttcttgaatgatacaatatatccttttagaaagaaaatgccctgaggtatatttatgaagccaaacttttggttcagttcatattccttgacatattcagctagatgttctatgagacgttttggataatgaaaacaagagctgaatttttctcaaaagacagtagtagactttggggttataatcatattgatgacaactgccatttattaaaattccaaggtatgccaagctgtgtgccaggtgttttgctcacactacatacattccagccattctacagaacagggattatcaaacccattttacagacgaagaagctgaggtttatagttcatgacaaattcccgaagatcacgtgatgatcacatgattagaaagtgactgggctgggacttgagttctgaattcatctagacccacactgtccccactcctctcagcctgagcatagccttcttcctgttaagtcacttctcttcacacttcctaatgtctttcaggtaacataaaggagaaacctgtgacaaagtatttagataggcctagagaagaaaggtgacaatgagaatcaatacctttcaaggatcgttttgggctttctttacataaattcttcctgttatgagccctaggtttcttgagagctgactctgtctgggtggcagtacttttgtccagccccagggctttcccaccttacaacaccctccatttgatctcccctgggcgctctcctgtgtaactctggaccctggcctgttgagtaacttctcactgtggtctcgcactctgaagcctgtgcccagccctcagtgcaagagcccagagacatctgcccttcccctgacatagaccactgtttgtcactggagaagttccctgaccgatccatccctcccgctggctcctctgtgataacggccctcgatgtgaatatccactttggatagtgacatttccatacctacgctgggcatcttcaacacactctccacatatttccaaataggccgcagagtaaaatctgattgtcacataacatatggggtttagggatgtaatcctaaggacagatatagcctatttgaaatcttcctaatacttgatacttgtagtatgattttaatgagatgcattatctgaaacagggcactgaacacaaacagagatgaataagtttgtgtagatgatcaaatgccaatctttccttcataaactttgtaggtgaggaaaggctatagacatcgctttctaaatgatctacaggaaggtgaatttctaaaaaaacaaaacggtatcaaaatcttgaagactgcctaggaggtgacaagggtactttgggggacatgccatctctgatgagaaataaacaataattaaacatccttccactgtctctcatctgtgtacctgccccacaggaaaatcgtggcttacagtgagccacaggcacgtgtatagctgttcaggaatgttccgtcatatggagggtagcagaggctcacagggtaggttatttttcacacaccaaaaatatgagagaattctcagtctaaagaaattatataggttattaaaaggacagtgccaagtgatattgagggattaaggttgaccctccctgcaaagacttacagaattgtcttaaaactggatgtaatcctgaatttgaaaccaccagtcacctcgtaggtgcaagaaaaagttggaagatttcaaggctatgcggacattcccagaaacaattccaagacatgaagagaattactgtcctcaagcataatagttgcttttctttgagcaccataatgacatatgggagagactacaagtgcccatctccatcttgtctagctcgccttcctggcgggttcatttgtagttagacagaagccagtgcatcattcccatgctttcgtttctgttcagcgctaaacatctgttgtgacatggaggggcaaggtgaaagcagcttggattgttggctgaggggaaagtgagggcctgctgtggattagtttattatgccataacaataccacagactgggtgacttaaacaatagaattgtattttctcccatttctggaggctaaatatctaagatcaagatgtgggccagtttgatttcttccctggcctccccgtggcttgctgatgaccactttctcactgaattctgacatggatgttctttggtctgtgtgtcggtatcttaatctgctcttttatgagaacaccagtcatcttgaatatgatcctaatcataagatctcattttaccttagctgcctcttcaaaggttctgtctccaaatacagtgatattctgcagtactgggggttgaggcttggatatatgaactcggaaaggggcgcaattcagcccataacaccctgccaacttaaatcagaatttatgtgcacaaaaatcaactcgtgtgaagccatttaactttcagggagttttttcttttccatcaggttactgttaatgtgactactggagtgctcctcttccttttcttagggtcatttcagtatttgacttaaaagtaaatagtgcatgtatttttgttgcaaaaaaattctaaaaagacatagaaattgcattgctttctttacaaagttcctccaaaactcagcctcctactcagaaatttccacaagtaacaatgtggccgtgtaaattttaaaatatgattttcgatttcaggctttcataaagatagatgtgctattttatatatacacatatatgtacatatatacacacatgtgtaatgatataatgatatacatatagatctgccacttacctctgccactataatagattcaattgcctcttccacaaacgtctacactgaaataaaaatgtggcattgatttcgagataggattatttcaaaggcaatcaagttaaaatgaggttattaatgctggccttattggaagccagtataaacaggggatatttggacatagagatatgagtatggagatgacagtgtgagtagacatggagggaagacagctaggtacaaggcaatgagagaggcctggaaagcatcccccagtcacagcctcataaggaatcaatcttgtgtacaccttgctcttgggctaccagattccaaaactgtgagacaatgaaattctgttgttttgtcatccaggttgtggtactttgctattgcaaccctaacatgccatgatactcacttattaaaatgtatccagcatctttccatgtcagcacatagagatctgccttactttggggacttttcccgagaatgccaatttatttctgtgcattaacaaactgaaccaacctcctcctgatgaacacatatttgctttttctttgtggctaaaattagtataaatataatcaatatatttgaccataaattctgggacaagtgcataaaattccttataaggaatacatttcaatgtagaagttgtgtagaagtgaacagggtatgaataattttatactttttcaaatgttgctgactctttccaccaaaggtctcaccaattagtttccctacacatttgttgatgtggaaatgattcatttgttgacaaacatattttatcagaattttaaaccttattgaaacttatgggtgaaaatcctaggggagtttggttttggtaatgacattttcagatgcatcaccaaaattttggtcaaacttataggtgcaaaccctagttgaccttaagtttggtggtgactttttcagatgcaacaccaaaagtgccaacatctaagaaaagagatataaattggacttcattaaaattaacaacttctactctaaaagactgctaagagaaaagacaagccagagactgggataaatgttttgtgaaacacatatctgataaaagttatatatttaaatatgcacaaaacgctaaaacccaatcataagaaaacagaaagcctaattgaaaatggccaaaaattctaaacaggtaccccaccaaagatatatatgaatagaaagtaatcggacacaactgtccaatttctgatatggtttggctctgtgtccccaccgaaatctgaactcaaattttaatccccacatgtcgagggagggagatgattggatcatgggggcagtttcaccgatgtttttccccttgtagtgagtgagttctcacgagatctgattgttttgtacgtgtttcaaagttcctcctttatgcttcttcttcctgccgccttgagaaaaaggtacctgcttccccttcgcattccatcatgatcataagtttcctgaagcctcccccagccgtgtggaactgggagtcaactaaacctctttcttttataaattattcagtctcaggcatttctttatagccatgtggaaacagaataatacaatgacatatatcattaaagaatcgcaaactgaaacaactaagatataacactacagacccagaagagtggctgaaacccaaaacactgaaccaacaaatgttcacacgtgtgttgagcaacaggaactttcaatcattgttagtgggacagacctgaaggaatcgtgaaagcctattgctaagtgaaagaagaaaatataaaaaggcgacataatatatgattccggtcatacgatattctggaacaggcaagatgaatacactaaaaatattagtggtttccaagggctgaggggttggagttgaggaatggaggattaatcaataggtggagtacacaggagatttaggttggtgaaacaattctgtatgatactgtaatgatgaatacttgccattgcacactcatcaaaaaccatagcatccacaatgtggaatgagtcctgatgtaaactgtggaatttacttactaaataggtatcaatacagatccatcagttgtagcaaacatgctataataatacaaattgtaaataataggagacactgtgtgtgtgtgtgttcgtgtgtgtgtgtgggtgtgtgtgtgcgtgaggcagagcagggaggggggtatagatctgtgggaactctgtaattttgacgaagttttctctctgtatttttggattagcaatgctctaaaaatgaagcctattttaaagaaaaatcatgtaaataatttgaacactttatcaaagaggatatacatattggaaagaggcacgtaatgtcatttgtcattagggagatgcaaacaaaaaccaaagaagtttgcaatacactcttattacaatggctaaaatccagcagtctaaaatatccgatgtaggagaggatatggaacaacaggaattctcattccttgctagttgtgatgaaaactgatacagctgcacttttaaatcagtattttatgcacctcctcttatgacatggtgaaagctaaaagtacaggaactgaaagaagaacatagttgtcaggggctttgcagaagtgcagtgactgacctcaaatgggatgcacaggagaattttaggttcatcaaactggtcattacgatactcgggtggtacctatgggcctccatgcatttgtcaaaatacgtataacttcacaaaatagttgcatttgatgtgtgtttttgaaaaaacattttaacttttactttcagagatagaagtgcaggtgtgttacataggtaaattgtgtcatgggggtttcttgtacagattatttcaccacccatctattaagcctagtacccatttgttatttttcctgatcctctccctcctcccactctccaccctctgaaaggccccaatgtgtgttgctcccttctatgtgtccatgtgttttcctctctagctcccacttataagtgagaacaggtagtatttggttttctgttactgtgttagttcacttagaataatggcctctagctccatccgtgccatggattgggattttttttaagtagcaacaacaaagaagactttaacctagtctaggtgagagagaatgttaacatcacatacagcagtagtaacggagattgaaaaagtggaaggatttggaatggattttagaggttgaaggaacaaaagttgttgttggattggatttgggataagatgaagggagaaatcaagcacaaaagtaagaattgtgcccctttgatggtaacaaatatcaaatgaagacatactttgttttttcaattttttgacagccttcatgtgtattttataatcaccctgacacatgcacaaacgtttcttattccttgaaatctgggaatgccgtcccctccttcaacctggtgccccacaattctacaatcatggcaactatgatacaccttcactgtcagtggcagcatgttcactgaaggctgaatctaagtgagaaataggaactgaaggtgagtcatttggggcatgtttggagatgggttgtgttcactcctttaaaaggtccctgacactgacccactgcttcaatcccaagaacattagtacctctctattctggacaggagacttatttccaataccaggaggtaaaatgataggctgccattttctttttaccatccataagaaatactcccttcttgggacctcagaagaaaagctccatgaggataattcccaaggacatgtgggccagagctggagtttacccaccagctgcctcccagtctgggagaagagcttccttgcctgtgggtttccaccttgagtgctgaggtttgatgatccaccaatcttggctgtgagcagaggccaactgcccctgggaaacggagacaaagctaaggaaggaagtcagctcatgaacagctgagttgatcctgaccatagtgggtgcagagaaccccaatcctcagggtaatctctggcaaagccacaatcaactgtttttggaatttcagggctcatgaatccttctgagggtcctaccaggagtaagaacagctgaaaagaagtatgtggatctcttatccatgtggagagggagatgggcctctactcctatcatgtgagcaacctggcactgccactaagttagtaaagtgtttgtggacctggtcagggtgtctgtcatcaacactccatcatgacgttctggaatagaactgttaggttatattccttgaatcaccagggttccagaggtcagcaggtggatgggtcaagtaagagggggaataaatccaccattgtcccaggtagccttcccccagctactactgagatctaagttctactctcaaaaagcaaaggcttatgaaagcagctaggccttctgtgggtgagataaaggggagagaggaggtgccatttcctctgttcctctttgactcatatcatctcgctcctcttgttattaaagtgaccattgaccccagagtctttcagttctttcacctccagccttactgatgctctaatttactcatattgctgtctcactaaaacataatctatacaaagacttatttattattctgtgcatttctgtgtttatgaagtttttataataaacatttttggagtagattttgaatttccctataattgcatttttagtataatatgaaaaagggttccagttacattaaaatgttttatatggatattcagttgttccactgatatttatttcaacaagacagtctcctgctctaaagctgcaacattttttaatcaattaagcttgcatttatacatgttttgttgcttttgtttttcaggactttccattcagttccattggtctatctgttaatccctgcacccaaacctcaaactcttcattataatagcttctttgtaattcttactatgttggacgaactgctctttttcaaaactgtattgactatgcttggctatttgcatgtctttatattttagaatacggtgattcatacatgccttcatgtccaaaggcatttagttgttctgatttgactccaggctaatcacttttaacttcatttctggtattccacacacactggggtggggagtgtgtcccccaagatgtcaggcaacctcgctgctatgactttgctgggttcagcccacatggatgctcttacaggttggagttgcccattggtgtctgcagctgttccgtgtgcatattgcaggctgtcagtggctctacagtttgatgagaatgtaaattagtccagccactgtggaaagtagtctggagatttctcaaagaactcaaaacagagctaccagtcgacccagtaattccactggtagatatatacctaaaggaaaagaaatcattttcctttgaataaattgccagaatccttgtggtgatggaactattctgtaccctgactctatcaatgttaatatcctgcttgtgacattgtattatggttttgcaacatgttactagtgaatacaattagatatgctcaatctctatagtttgtttataaatttaatgatatttagttgcagagtcttctgtgtctatcttttgattatcatcctgggcttgtagtcttattattaagcgttcatcctccctttgattctacatatggggtcctcggctttcttctaagaaactattagtacagctgtaattcatttgggagaatgacttaatacatgaatctgatttgtttttccacatggatatcaagtagaacaagtcccttttattgaagtagtaatcttctactctttactatcctttttatgttaccctttcgttagctgatcttgagcattcattttttcaaataatcatttaaaccatctcctcttactgaaattttttatttggcttatcagttgattgctgaatgtcaaatgattaacctcaaagatatggatactactttgtaacatgttaggcctatttttcaagtttaattctcccatcaaaaaagaaaacttaaagaaaaagaatgtttttgatgacatgacattccgtattcaactaatgtgttttaatcgattttctgatgtcaaaatgtatgttctcaatcttttcttgttttttcctctaccgaaaactggaaaagctcctcattatcagctcaaatccagactgtgttctagcattgaaaattgtatcatcaagctgtgccaaacttgtcacttagaactttcagagtctcagcagtaattcttgctttgacaaccccattctttaccactcccggtgcacacctactccctcttaagcaatccaattgtgaacagagcttttggcacatccctactcacaacttggcccaccttgaggccagattccttgtcaatttccatcaggccaagatcctcaatggtcggaagtttgtattttctatcatttatctccaaccctgtacagtgttcttcatgaaacagacatttgatgaatgtagtattctattatcaaaaattttcttttgagttgaaaagaaaatatgactgtatatactccctcattttgctgattgagaaacaaagacgagagtggtggtgtgaatgtttaagtttgcttagatgcgcagagcctaaattaaaatccaattctgctgggctgccagtgtaatgtactttagaggacttcaggccgctgttatccatcagtgttctgctaaatcaccctccgtctctttctcttctaccctctttgctctataatcatacgccttttttagattttaaatttttatttttatatctgtttttttgtaggtgcatataggtgtatacattaatggattacatcagatattttgatataggcatgtaatgcataataatcacatcaagataaacaagataaccatcaccttaagcatctatcctttgtattacaaacaattcaattcttgaatttctttttttctaggctttatctttagttttcttacatttgtatatattttaaattctctatggactttctcctgcgccatatcctcttatcaattattgtaacctttaacatttttgtataattctttccaaagcatatttaaaagcaggtacatattctctccatggctgtgctttgagataataatattggagatgaaatcctcttagctgagaaaaggaaagactggcgatatgacattccatcaaaaaaattgcaaacaaatttttcttttaaaatattcaatttttaaaatgtttttgattactgtacttcttaagtgtgaaaaattgtctcctggacccatttttctcagaaggaaatgaattgcaatcaatatttgagatatttccggctcctgagaactatggctcctatatgggaaacaggagcctgggttggagaaatgaaatcattgagctatttagtttccttacaatgcttctaaaccatctaagctttaaaaacttctttcaaggtatctgcttttccgctattcaagtataattagggttgattgactgccagagattaaaggagctgtaacttttctgtaattttcaaaagtgttacaagaattagaaggtgaagccatcccttggttggcaacaacacacttatagatgatctaaaagagacgaatgagtggactgctttaaattaaatgaaaatacttaaatacctgtgtggctatcatcaaaataaatatggcaattttactcagtagtgctaatcacagaggtttcattagttttaaaacaaacaaacaaacaaacaaacaaacaaagatttcattggtgacctggatatacatgtttttcagcatgccatatttatatccacagataatttttcctcaaaaagaaaagcttgctttgctatatgtgcattttttacatatgaatgttgatttctgcttcagagaatgtagctttttgacagtagcctcttcataaatgtccatggtagcaatagcatttattgaagagactttaggatttataggacagccctacaagatctgttttcatgtgccttctgtgatgacttctcaatgctcttttgctagattaatggtcatattgcctcgtgaacatattgattttgtattattttgtgaattattttgcattcccttatgccatctcgttttgactcttttttaacctcgtttttcttcaatggagttcttcaaattatacgacatatgactcaaccaaaatgccaaaaaaattaaaaatcaaattatgtggatattaagcatttgtggtgaaacaagacttactgcaattcctcatctatgagctccatatgtgtcaattcatcactatagaagtcttgtcagtttttaccttggtacataattatttccacatctagtcttctagggggcttggcagggcatcttgccagctggtccacattaatgaatacacaaactgcttatgaactgtggctatgctgcattttcggctaagtgatatcacacttatatgcagagtgattatactgttcgaagctccattttcacatgaaggcattttcttcacactttgtcgaaaaccgtttttagtttgtcaggaaaggccagcagattgccagcctaacaagtgaggaaaggatggttatttgtttatgtctggggccacactaatattaaatagatggcttgtcagaatcatcatctttgggttattttacagcttatgactaatatttatgggcatgcaacaatcagaatatcatgaccagatgccagtaaggaagccattctatttctttccctgggaaaattgtttctgtgtctacacatccaataaggtcatgttgatatggtttggctctgtccctacccaaatctcaccttgaattgtaataatctccacacgtcaaggttgggaccaggcggaaataattgaatcatggtggtggttttccccatactgttctcctggtagtgaataagtctcgctagatctgttggttttgtaaatgggagtccctttgctcttcattcatcttccaccatgattgtgaggcctcccaagccatgtggaactgtgagtccattaaacctctttcctttataaattacccagtctcaggtatatgtttattagcagcatgaaaatgaactaatacacatgtcaaaacaaaaatcagtgtttgttattctccacaaccctatgtatcacctaagtatggcttcttttgatattaatagaaagctcttttatagaaaaggtatgaacatatgactacttaacactgtgatgctttaatgtgtgtgcatgcaaacacatacatacatttgtgtttattttcaaaggaagaatggactccagttatgtacatttgtttttaaaatgtacatctgattgtatgatttcttgagtgggtatcatataaacatccattaagaaaccaaaaagccacagtgatcttaccttttgtgaatacaacataaccatgaggtttcttgctatctagacaaatgctgttaccatctcatttctgtgtcagttttatgtaggcaaggcatacagacacacactgacaattgtctctggcagatgctggcatttcattcatatcacctttcgtttgaatttttaaaaaataaggctgacagtactgcttatgcataacacattggaggcttctgaagagttacaatacaggtatacattcttacttctctgtctgagagtgttctctgatcatcctggacaggggcagactggaagtgctatgtcagtatcatcccaggagttaccctcaacaaatgaggaacagaaatcattgaataaatatcccagcttcctcatttcttggtagaataattctgagacatgatccacacagcccctcagaggatggccaacaggatggagtcccatttgcccacactggtaacctcgtcatcaacatagattttattgactctcctccctcccctttctcctttcctcattgtctccagtgctttctgtgatgactgcccaaataagcaacttacagtgaaatctttgcctcagagttgacttttgtaggaacccaaattaagacattgactttagccaataaaataatgaagacaaacacctagtgaaaaattcttattctagttgcctaaggtgtagtattttcattttattgctttcaccaatgttagctaaataatgcccctttcatttgaataattaaaaaataaagctgactgtactgcttgcgcacaatcatttgctaatctctttttggagatttattctattaattttatttaagctaccttctctatgcagataactcccaagtttacagctccattaaaccttctcctgttttccattctccacttgtccttggtctgtgtttactgggatcatgtttttgactgaaaaatcaaacatttctaaggtttaattattcatcccttttccctttctccaaactagctatcctttctaactcaccagcagttccttacctccaatcttctatcatctgctgtcaactctatctgttctatccagtcaacaatcaagtgcatatcacttcataacaccttgcatgactgtctttatattttcctgttgctcacttagttccagcttaggttcagactatgataataacttcataactgtttttttctgccaatttcctggcccaaatccttatttaccaatatgatttcatcttcctaaaactctgcccactgcatatggaatgaagtccagacttcttagaaagacattcaaatgcctccagaaactaaattgtctgcttgagttcccagtattttcccacgtgaacactgcattctagccagcaagatttattcactctatccttgatacatgtgatattttccatctttaataatttcctctaactttgtggtctgatggcagtttattcatatctgaatctttgtctaattctaacaaagactcctagaagtttatttctagaaaattccaatcacttcatttacaggtgggtaaaaccaggcctggagaagtggtgcgatttgcttaaagacatggatattaagtaacagatgcaagagagagtagaacaaagttttcaagggagtattgtattaattattccaagccatctcctcctgacttgccagggcaatgattttccgtatgatttgtgttacaattaatagtatgcctcaagctcactattgctttaattatttgaaatgtagaccaaagctattatttcaatttaatataattttctcccaaggttgattcaaaactcttgaagaacagggaccatatattttacttctttatagagttcaaataatggtaatgaggtaatgattatggaattctaacaatttttttagtatatattatgtgtcagacactgtgataaagtcattttatatacaattccatttaagtttcataataactttatgtggcaataccattatcattgcctttgtatataaaacaatgaatcacaaagaagttaaataacttcaagttcacaaagctagtaattatcttggacagcctttaacattatgcttgtataaataaaattcctgaaatatttctttaacttgcaaaagcaattcgataatttggaatttttggctatcgaataatcatagtttcttcactgcttctcattttgttcacaatgtaaaatttaacgtgtgcactacatttactgctttactttgacaattctgtaatccttggtttagcatgtaatcacaattctccaacaaaacaaacatgaaggagatagttctcaccaaggatgacctaccaaggtcacgtttaccgaagtcactgcttctggaaatcaagattttttctgcttatgggaatgtttctctttttttaatcttgtggatatatagtagatgtatatatttctgggttacatgaaatattttgatgcaggcatgcaatgtgaaaaagtcatatcggggaaaatggggtatccatcacctcaagaatttatcctttgtgcttcaaacaatccagttttaccactttagttattttaaaatgcgcaattaaatcattttttactatagtcaccctgttgtactagcaaatactaggtccaattcatcaatctaactatacttctgtacccattaaccatgcccactcccgctgtccccattaccctttccagcctctggtaatcattcttctactctctatctgcatgagatcaattgttttaatttttagcttccacagattagtgagaacatgtgattttttttttctgtgcttggcttatttcacttaacataatgacccccagttccatccatgttgttgcaaatgacagaatctcattcattttttatgggtgaatagcactccattgtgtatatatgccacattgtctttatctattcatttggttgatggacacttagattgcttccaaatcttggctgttgtgaacagtgctgcaaaaaacatgggagtgcagctatttctttgatgtactgattttctttcttttgggaatatacctagaagtggtattgctggatcctatgatagctctattttcagttttgggggaaactccaaatttgtcttcacagtggttgtactaatttacattcccaccaacagcgtacgagggctctctttttgtccacattcttgccagcttttgctgttgcctgtcttttggttacaggccattttaactgcagggacatgatatctaattgtaagtttgatttgtatttctatgatgatcaatgtttttgagcacctagtcatatacctgtttgccatttgtatgtcttcttttgagaaatgtctattcaaatcttctgcccattttttactggattattagattttttcctgtagagttgtttgagctccttatatattctggttattaatcccttgtcagatatgtagtttgcaaatattttctcccattctgtggattgtctctttggtgactggttcctttgctgtgcagaacctgtttaacttgatgagatcccatttgtccatttttgctttggttacctgtgcaggtggggtattatacaagaagtccttgcccagccaaatgtcctggagagtttctcaccatgttttctttgagtagtttcatagtttcaggtcttagatttaagtatttaatccatttgtatttcacttttatatgtggcaagagatagggttctaatttcgttcttctgcatatgaatatccagttttcccagcataatttattgaggacactgccctttcctcaatgtatgttcttggaatcgttgttaaaaatgagttcactgtaggtgcatggatttgtttctggggtcttcattctgttccattgatctttgtgtctctttttatgccagaaccatattattttggttattatactatagctctgtagcataattggaagtcaggtaatgtgattcctctagatttgttctttctgggatagctttggctattctgaatcttgtgggatttcatatcaattttatgatacttttttttctatttctttgaagaatgtcattggtattttgaaagacagtgcattgaatctgtagattgctttgggtagtatggacatttcaacaatatttattctttcaatccatgaatatggaatacctttccatttttgtgtcctctttgattcctttcatcagtgttttgtagttttcatttttcaggtcttttacttctatggttaattcctaagtatttaattttatgtgtggctattgtaaatgggattacttttttttcacattgttcactgttggcatatagaaatgctactgaatttcgtatgctgattttgtatcctgcaactttacagaatttattagttctagtagttttttaatggagtcttcagggttttttttcaaatataagatgacatcatcctcaaagaaggataatttcatttctttcttttcagcttggatgtcatttatttctttgtcatgtctgattgctctagataggacttccagtactatgttgaataacagtggtgaaaatgggcaaccttgcattccagatcttagaggaaaggctttcagttttccctccactcaatatgatacaagcaatacaagctgtgggtctgtagcatatgacttttattatgctgaggtatgttcctactatagcaagcttttcgagggttttcaccaacaagtgatgttgaattttatgaaatgttttttcagcatcaattgaaatgatcatatgttttttttccttcattctgtgatttgatgtatcacattgattgatttacatatgtagaaccatccttgaatccctgggataaatcccacttggtcgtgatgaatgatctttttattgtgttgttgaatttggttttctagtattttgttgaggatttttggatcaatattcatcagttatatttgcctatacttttcttttttcgatgtgtctttttctgtttttcctatcatgttaatactagccttgtagattgagtttggaggtgttctctccttctttagttttctgaatagtatgaatatgattggtattagttctgctttaaatgtttggtacaagtcagcagtgaatcccttgagttccagtattttctttgtggtgggactttttattaaagcttcaatctcattacttgttattggtttgttctggttttagatttcttcatggttcaaccttcctaggttgtatgtgtctagaaaggtgtccatttcttctagatttttcaatttattggcatatagtttctcacaccagccactaataatcttttaaatttctgatgtattagttttaatgttttctttttcatctctggttttatttatttggagctctcttgtttttttcttagtctggctaaagtttgtcaattttgttcatcttttcaaaaaatgtctttttgttttattgatcttttgtattttgttgtttcaatttcacttatctccgctctagtttttattattcattttcttctactaattttgattgattttgattgtcttagttattttagattcatcattcgattatatatttgaagtttttctttttctgatataggcacatatacctgtaaacttccctcttagtactgcttttgctgtatctcataggttttggtatgttgtgtttccattaccacttgtttcaaggattttcttcaatttcctttttaatttttgaattgaccttctggccattcaggaacatactgtttaatttccatgtatttgtatattttccaaaattcttcttgttgtagatttgtagttttaatccatttgtggtcacagaagatgcttgatattgttttagttttttgaatgttttaagacatttttgggacctaacatacggtttatctttgagaatgatccatgtactgaggaaaagaatgtgtattctgtagctgttggaaaaaaacgttctgtaaatatctattagggccatttgttctatagtgcagaataagttccatgtttctttattttctgtctggaagatctgtccagtgctgaaagtggggtgttgaagtatccagctattattgtattagggcctatctctctctttagctgtaatattatttcctttatatgtctgggtgcttcagtgttgggcgaatgcatacatacttatatatagttgttatatcattttgaggaattgacccctttatcattatagggtgactttgtcttttcttatagtttttgtcttgaaatctgctgtatctgatataagtatagctactcctgctcttttttggtttccattggcacggaacatcttttttcattcctttatttttagcctatgtgtgtctttataggtgaagtgtgtttcttataggcaataaaccattacatcatgttttatcatccattcagccactgtatgtctgttcattggagagttcatttacattcaatgttattgtattattgatcagtaaggacttactcatgcctttttgttatgtgttttctggttgtttttggtattctctttcttttttcctttcttcctgacttcattttagtgaaggtgattttctctggtgatacaatttagtttcttgctttggattttttgtatatccgttatgttttttttttatttgaggttaccatgaggcttgcaaatactatcttataacccattattttaagcttttaacaagtcaacactgctttcataaacaaatgaaaagaaaactaatacaaattgtacatcttaactttaacttcttgcttttaaacttcctgtgatttctgtttatatcttattttacagtgtatgtctagaaaagttattataattactatttttgattggttaatctttttatttaagacaagagtagtttacatatcatagttacagttttatagtattctgtgtttgttctgtgtacttactgaaagcagtgcattttgtaccttcagataatttcttattgctcattaatttccttttctttctgattgaagtaccccctttaacatttcttgtagggcctgtctggtgttgatgagacccttcagcttttgtttgtctgggaaagtcttcatttctccttcatattcgaagattattttttgctggatatactattctagggtaaaagtttttttccttcagcaatttaaatatgtgatgccactctcttctggcctgtaaggtttccactgaaaagtctgctgctggacatattggagcttcattgtgggttacatgtctcctttttcctgctattttttaggatcctttttttttatcctttgggaatttgattatttaatgtcttgaggtagtcattaggttaaatccactgggttttctgtatccttcttgtccttggatattaatatctttctctaggtttgaggagttgttattatccctttgagtaaactttatactcctatctctttctctacttcttctttaaggccaatatctcgtagattttcctgtttgaggctgttttctttatcttgcaggtgtgcctcattcttttttgttcctttttgcctcttctgtgtatttttaaatagcttgccttcaagctcactaattctttcttctgcttgatcaaatctgttataaagagactctgatgcattcttcagtatgtcagttgcatttttcaagtgcagaatttcagcttgattcttttaaattgtttcaatctctgttaaatttatctgatagaattctaaattccttctctgtgttatcttgaatttctttgagcttcttcaacgcagctattttgaattcttggtctgaaaggtatatctctatttttccttggttgttctctggggccttatttagttaatttggttaggtcatgtttttctggatgatgttgatatctgcagatgtttgttgctgcctagacattaaaaagtaaggtatttattgtaatctccatagtctgggcttattcatatccatctttcttgggaaagttttccaggcattcgaaataacctaggtgttgtgatctaagcaatgtcttcattgggggacaccccaattacagtaaagctgtggttcttgcagacccatacaggtaccatcttagtggtcttgtttgagatccagaagaattttttggattataaggcagaagatcttgttcatttcccttagtttcttcaagacaaatggagtctctttctctgtgctgagccacttgacgttgtgggaagggaaagtctttgacacaagcatccctgtgaccactgagaacacactgggtgagacctgaagctagcagagcactgggtctcactcaacgttcactgtaatcattgcctggctaccatttgtgttcactgaaggccctaaggctgtaaaatcagcaggctgggaagccagacaggttattcttcctttcagtgagacaagctctcctaggccccaggtggttccagagatgctattctggagctaaaaactgaagttagtaaccttagatttctatctggtgttgtattgcccagtggctgagctagcactcaaaccatgagacacagtcctgcatattcttcctttccctttccacatgcaaaggagtctcacctcatgtccagcaccaccacaggcccgtggggtgtactgctaggcctctatcaatgttcactttaggcccaagggctttttaatcatcttttggtgaacgctgcttgtggtgaatgctgcctggcctggtctcacccttcagggcactggggtctccacctgcccagggcagatccagaaatgtcatccaagattcaagtcctggaattggggaccctaagggcccacttgatgctctgtgctcctgtggccaagctcatacctaaggtgcaagacaaagtttccttcactttcccctcctctttctttcaagcaaaaggagtctcgccttgtaaccacgagagctgggaatgtgctgggtctcacctgattccagtaagtctcagagtgccaagtcccatggcgtactgcttggttattgctgctggttattcaaggcccaggggctctttattcagccagtaatgggtcctgccaggactgtgtccttcacttcaaggctgtggattcccttctggcccaggatgtgtcttgaaatgtcattcaggagctagggcctggaataggggcctcatgactctgcccagtacactatcttacagtggcggagttggtatccaagatgcatgacaaagtcttctctcctcttccttctcctctcctcaagcagaagaaaggtgtctcttttgacccatgagacgtgcagcctggtgctgtggtagaggttgcacaagccttcccttagctaccccagctgatgtctcagtaagtcgtgtgcccaccccccaagtccactggctctgagcccagctgtacacttgggctcacggaggagttgcagtccttgtggcctagactgcccttcaagtttatttagggacccggggcactcaagcctgaggttgcgaggcttgctggaactcaagttcccactgctgggatcggtgatttccctctggcttgggctgatccatatgctttctccctgggtagggatcagttatgtacatcacaattctgctttctgctgtgacaggacagcactgagttcattgaagaaaatctcacagttgctgtgttctccctttccaagtgcacagattttcctcaccttgcagccactgtcaaggtatgggggaggggtggtgtccacagttcaagatgtctttcctcttttttccagtgcttctttcggtattacgaagttaaaaccaagttatatgaatgcttacctgatttttgttttttataaacgtgattttttttgtgtagatagttgttaaatttggtgttccatctattctgcctttttgctctgctcccaacagtattttttttgcattaatggtgaaagccatgcatcatgtaagatgatagttatgaaatgagtatgtctccattaagatgctgtagtggagtatcattaattcaatagctttaagaagtctatgttgcttggaagattgaaagaatttttctgaaagaaatatcatgttgcttcctaaactttcacaagccacactttcatgcattgtaaattctagataaaaagtttaggatatcagtgaatatccactctagcaaagttcaaaatatatgcctaaattgttcagttaaaaacacagtgcccaaactagttgaatgacctaaattagtagttcttaactctgattgcacattagaataaactttttagctttaaaataaatcccatgtacagatgtctcaccaagtctgacaaatcataatatcttggtaggggaccacaggactgatattttttagaaactcagtcatttgttgtgcagtgagagtttagaactactcatttcaaacaatattctgtgcttagttagaatattttcattatagcatctttaaaaaaatattttgtatatgtgtgtatattgtagtaatgcattgattttctgtacacattaggcaatgttttacccaacgattgtatgtttcttgactttttttaactgtaaactcttcaattcctgttctgcttttccgggcttaattaataggtagctattgacatcctacagcagacctaacacaactgttttatcctggtaggtagcaaacatctgaagccctaattttgcatgctaaaaaagctaacaattattgagtatcttagtatgttgcaggccttgttcaaaacacttttcctgtattaaaatatcgaccacaggtaaccatctaataagatttttacagatgaaaaaattgtgactcagagaaattaagtatcttttaaagtcatatagttagccaactgaagaacaggtatcagaagttaggaaaacagacaaaagaatccataatattaattgcgaccatgtacttctctttaatgcattttttttttataaattaacatgattgttggaagaccagagaatgaaagaaattagttacattcctaagacttgactatctgtactggcagtgatagaattcctaagattctcggagaaacatttagatacatttaaaacttcttggagtgttagaaaactcaaaaagagcagttaggcatgtaaatttcacatgcttgttacctaggatttgccttaagcataggaaccagtggcaaactacttgggcaatgcattctgtttctgaaagtcgcactaaaagatatgagtttgctgtttccttcccttatgggaccttaaattaagctactctataaaatctgttggagagctttgagaaatgctgatatccagggatcatcttccatagatgttgattcaattcgtctgggattagggcacaggcataggcattatttttgaagctcccacaggtgattctaacatttggccagagttgccacacactggtataattcatcaacctgaaaaaataagaaatgcacattagtattcctaaattctcttaacagtcttgtgctgcttcaaagcatgaatgatctttaggtcaattgtatttatgttgatcttgataacttatacttcctcagcttgttgcattttatggagctcatattcactattacataacatttatataactatgacggtgatagagacaggaagacagccaaagatccccaggaaaaccccaccttcaatcctaaaacagcctgaaggctgaaaaactggactgctggttccagatgaagcctgccctttcccaactgattatttctgaataaagcccacctgcacactgggaggacagggtggagcctcaggaagttcataccatttgtagggggtaggagcctggcctctcctgttcctgtgtggtgacctgagaatcaatttgtgaggcaggaaacctgctagcaggactctcgctttgctgagttaatttttcctttttcctttccacccaataagttccattttcctcacccttctatgtatccacaagcctaatcattcctggttgtgtgacaagaggccagttttagctgaactaaggagaaagttctgcaacatttttggcatccagatatggggctcgaggaaaggtgagtaacatgcaaagaaaaaatcttttttcctttcgcttctaagcctttttgtgctcagatatgttgggagagtggaggaaattatgccttcccccacatcactcctgggggtcaggaatgtcggccttttccttttccttctcttttcagggtgcacgggtgaaccgatggctccccatctcccgtaagtttctctccctgttagaggaatccattggcataagaataagagattaggctgagcgtgctggctcacacctgaaatcccagcactttgggaggctgaggtgggtggatcagcaggtcaggagttcgagaccagcctggccaatatggtgaaaccctgtctctactaaaaaaaatacaaaaattagccaggcatggtggcatgcacctgtagtcccagctactggagaggctgaggcaggagaatagctggaacctgggaggcgaaggttgcagtgagccgagatggcgccactgcactccagcctgggtgacagagtgagactccctctcaaaaaaaaaaaaaaaaaaaaaaaaaaaagaacaagaggttcttaccccaggcatctttccaaccctgaactttaacttgtttttctttaccctgtcagaagttaacttttatgtgacactttttttttctttttagaaaaagttttactaggccaggacccaactatcactgtttatattctctgtaaagttttaattataaaaaaagatttgtcaggttggtcttaagctgtagccaatttggtgtgctctgcatgactttctgtaaggtcagtagcaaactttgctgcaggcctccatcttgttttacatcctcgggagagtgacctgtaaccatgtagcaatgttttgtttagcctccaccgttttatagtaacagccaggttcaaacctgacttagggaatgagtacttttggactgatatctgtgtgacttttgctacttgctgattctcttcccctccatgaacaacttctagtttttttcttaaatcttcctttctctgggttacctttaaaggttctaaattttgtaagaactgcttagcccctttgaaaatacctcatacacttgtggttaaagcataaccttaattgaggcgtgttggtttcacctgtgtagtgaccttcagtagcgtttgaaagccagaaatattggctgcttgttgtggctgaagttgggtaataagggagttaaaaggattttcttagagagtgctcagcttaatttaaagtgaatatccaacttatagatatattgaaaaagcctttatgtttttcttttcttggatcctgttttgctggaaaaaaagtgttttgtttttttttagtcaactgaattatttttctctattttgccttgccacttttaaggcatgcatgagacgggagagaactctgtttccctcattaaaccccaggaattaaaagtggatgaatccctctcaaaaacctgtttttgcctcctacctatggctgtttattaggctttagaagctgcatgttctcctagctctgtctcttaaagggctccacccagaggccaataatccaagtaggagaatggcaaattaaagatcttatgtctgctggattttcttctgcctgtgtagttatattttgtgttgtgtgtgtgatgtctataaaaaaagagttttaattggcacaaaggaagacaagcacttggatcaaatattttgtaaagggaagataaaagctgtggtaccttttaattaatgtgactttaatctttgagaaataaaaacagccttaaagattttggtagaatgcagatatcatcaaaatgtaaataggtgaactaaattatgcaggactgatactagtcttgctaaagattttaaggttacaaagtgactttttggttttttgagaacctttcaacttgccagcttcacaattggtaaggcctggggacatatggaattaaccacacccttaatcatgctggaaggagtcaaaccttggctgcacctggcacgtaattaaaacaacttaccaggttttacattaaagttaaaattgctaggagttaccattataacatgtaatttaaactactggaaatagatttacctgcaaggtgtgtaagaacagtacgatgtgtttttagtaaaaaattataagaaggtgcagaaatagggttcttgcctaaggttaaaggattgttttgaattaggtaaagctggagatttaaacaaatgatggaaggattgttaaaattattcttgcaaaagaaattctgtgtgtgaatatattgactaaattcaaaagggtattatatggtttctccataaatttagcattgaaataaaagcacaacaaagtactcttaaggtattaatctgctctttagcaaaatttgtaaaagattataaaagatttttgcttttttaaatttcgaagtcattttggcaaaataaataacatgataatctggaattctatttcaaaacatcaagtgttttaaacatctaacatatttaacaggattcccaaattcaaacttcaatttcaaaattgtcttgcctgacacctcacttttggatgctacagagggcctctggagtatccaaaaaagcagtaaacaggattatttgatatgtttagttacatcagattgccaacatagcgtttaatcttctttaggttatattttggtgaataatactaatatatgttccaaaactgttctaaaattctaatgtttaaagtatatgctatcataattaaagttgtgatttgaagttattgtaaaccacagagataaccaaacttctttgtcaattttgtttctagctgtaactaccctggacattttgttatccacagacaactgatatcttattttaatccttttcaaaaggtggtttataataaactataggactctgataggtgctctcaaatacaggtttctcataactttggagattgtgacattggaataaaggaaaatgtacaggacttgtgaagagctaaaatcttcatgaatatcaggcaaaacaagagttaactaaatggactgaactcagaaaactgaagcaatctttttgacttttgcatggaatattgctgatccttgttttgtttttcagagtcagagaaacttattttgaactatttatagcttttcataattgagtaaggtatactcctgtgatgaaaatttggagcatgtttgtctctctctctctctctccttgcctggcttctccagaatttggaaactagttgtgagcattctgaacttatggcaatatagttgtttgcatcagtgcataagaatccatttccttttgcaacaggactcagttgtagaaattggttgttttactgaggctttgactggaagggtgtgcttccctttaaggagtcaagctcaacttgcagagctgataaaagccccttgggaaaactggcctcatacccttgtctatgcagttactgtactgggttcctgacctgtggtaagtaaagaatgtcactttctgacaggcccaggagctccaagtttatctttggaccttaataggagaggattacccaactcacaggtatttgaggataaaaacccattgctgggctgggctttaaaaggttttatctgagattccttgtggaacagaattccatcaaagccaatccaaaaagcctatgtagaaataattattcttgctgtactttatgcaaataatcaggccaatataagactgaagtctattttgtaaataactcagtcctatcactctgtgttttttaacaaaaatgaggactggagagagagaaattatattcaaaacttatcatacatctgtcattaaattctacactcagttatttttaggtttttgcctacattttaaactaactctgcttgttccagtgaacaaaccagcagtctccagatgcagctcaaaaagaacaaaagggatgggtgatgtaaaaatctggatcaatattctacttctgagcaatttttctgcaaatcctgccaggtgatgggaataaatagaatgcccatcaaacagaggtttcctttttgggaaagtaagaccaagtgagctaaccaaagccaagccccatgcatctaaatcttagcaagcataactatagccaccagttgtctgggcatgtcgtaagatatccttttttcccccttgttgttggaggactcaattccacagcttcaccttagcatttggcttatgataagcagtctatgtaaccaccctgagacacatttttgtcccaaactcaattccaagcttcagttcaaagctctaggaaagaaaatgggatctgagggatccagagacagatgataatggaagttaaaaggcacagaacagggaagcatgactgattcctgaccattaagccaagcttcccatttcatggataaagatcatgctagtatctatggcataattcccaaggtctatggaattcaaaggatactgacagcaggtgagatagggcacatgtggataagagtgggtactgctaccctctaggcccccctgttaatatgggtgaaagccactttgacacccatggatgcaccctgttgtggtctctgggacttgggaatataaggacgaaggaaagaaacaggaacactttgcttttcttccctcacataccctgtgaggctgcgcattgttaaaattttggaatttatttaggtaatgtttactcaaatacatatgactatcataatgaaaacaagttttcagaaacagcagtgaagacaacctgttcagtaataatttagatttattctgcaaaaaaaaaatagtggttttcttctttatttctttgtttctgcacgttgcacatattaaaagtactaggcaattgttgttatttccctgtacactattaaacctgctcattagggatgggtgcattgggtaacccagggtgacggctaggtttaatagtgtgatttattaaacatttcatatttacctagtttatgagctagaggcaatccaaattaaaatcgatgaagataaaattaaatgataatcaatgaaggtatttacaacaaaaatgaggtatttacaaatgttattcatagatgttaatcaaatgccattatttaattgttagtggatctgaaatgtatttcatagtcattgtgttttcaagccatgctttcttctgtgtcctgactcttcgaatctgaaatgaggagattcaggaaggggaatttgaatctgtttgtattttctcctcttgacttaaaatataggggaagaaagtggttggccctgatcatgtctgcttcgctctgtcatttgtattcctctagagtccctaaaagagagtcactcctagggtctggattagaccttatttttgccttctaaataccaggaagccattgctcatttctggtgatgaaatatgctcttatttattttccctagttgtggagtagatttattcttactatcttcctagctcatggtgacctatggcatgctatgtaagatgattggctgtaaacttgctagaggggtctcaaaagcatgggttctggtatcaggaagccttgtgtcaaatcctgggtaactttggtcagatcacttaacctctctgtgcctccatttccttatctgtaaaacaactctaacagtcacagacctctcacaggattgtagtaagaattaaataacctaggacatgaaaagcacttataattgtgcctacatcatggtaattacaagtatatcatttttatgataataatacaggaatacattcaatgaccttgtcttcctcatctctgtcttccaaaccattatcacatcttgaaaaactgtgtttcaaactttaggtggcaatgcattagtgatttgagagatcagttttttggcgtgtggcttatattattttttcagttgaaatagaacagaaaaataccagagctcatcacacataggacaaatatcattccatgacatgtttggttcaactctgtgtgtgtgtgtgtgtgtgtgtgtgtgtgtgtgtgtgtgtttgtgtgcgtgcgcacgtgcgctaactcacaatttgaaacggattttatgccatgtgcacattttatctgtctcactaaaccagaggaaaaggaaaaacttcaatggagtctacagccatttacccagtcccaacaagcccaaggtgtatgtcactctagttgatacatgcgactcgatagaggaaaaaaaaaaaaaaaaaagcctacctccaaagtctgtgatatgtattcctggtagctcttcagggaagaggggcagaggaggctgacgtaagttccatgcacttttgagaatcactgcactagactataaacaccttaagatccagcactcatcattgtattttttatagtgccctccatgtttgagatgtgtaatatatatttatctaataaattgccatgatttacacagagttctgtttaaagaatattgataatgcttaaagagcaaatgcatttattaagcaactactcttgggggcaagatgtattttgcaatatcatccaaaggaaagagttgtcaaatttggacatgagtgaatatttgacgggaagactttctttctaaggatgctattataatgaacgttagcagctctcctttgctagatatgacagtctaatgatatgacattgctaaagtcagcaatctgtctgcctgctgtcttggttggatgcaaacacagttgtattttgctttatacaagagataaatatacaagaatctttataatttacaggaggatttacaaaaaacttattgtaaaataaaacaacttggtgtattgtgaataccttttgacaaatttctcagaatttccctctactcaccagaaaatttcctccatgtctcatcacaatttgaatataaatgaattcaaattcacaagcatcacacaacattaactgcttcatattctttcctaaataatgcacagccttccatccaagtccctccaagacatatcttcgactttcccgaaagatgccttagtttttcatagatataatactataaggatcttcccatcaagttgctctgattgatgtagaatattccaaaagccagttgacagcagtgcctcactcttgcctctgctaccagccccttcatgagaatgtggtgatttgtggcagggtggaaccctgggtgcttccaaagtggcaaaccctatgtgtaatcaagcactgctggattactgccgtttctcttgcactggagccatgtcatcctccacgagaaatgcagaggttgtctctctttccaaacaggtcacactatcagatgtgaggtttcatgcagggctgcttttatgcttttgtgcgtaaatcttttgccaaaagacttccttgaacttttgtctgaagcttcttcctccttatgtgacaagcaggagtccatgaggctggcgaggccgctgatttgtattagccaccacaggaatgatacctaggtgtcagaagctttgtaagggcctacaaaaatgcttgacatctgaatctttaaaaaaacttcaaaaatacaaaaagtgatatactttggatatttgtaccatccaaatctcatgttgaaatgtaatcccaagtgatggaggtgggtcccggtgggtggtgtttagatcatgagggtggatccctcatgatcaatcatgtaaggttccggagacccttactagaagtagattctggagcaatgcttgtacagcccatagaactgtaggacaattaaatctcttttctttgtgaataacccagtctcagatatttctttatagtaatgcaagaatggcctaatgcaaaaatcatactaaaaataaaaattaatttacaaaatgtaacctcataaaagtatggattccggctcagactatctggccagtgctacaaaggagctagtttttctcatctggaaaacaaagataaagtaaatgctagctcataaggttgttatgaaaatgaagtatgttaacaaaaagttcttagaagcgtgcatgacacatggtatttgtctaataaatgttacctgctagtatacttaattttcatcagtagaaaacaacttttaaagttgttattgtgacttcacaagaattcctgattatagaacacaagtgtagaattatagccactttaaaatgaatgacttactttcattaaaataatttaaaaatctatattgcaaaattaatgcaaaatgtgagtgtctttaacatatttgacatgatataggtagtgtaggaccaacaaaagtgtgcacatcacccactctcttaacaaatggtgatgttatggcctgtggagaggcgcatccagaatacatccaggaaggtgtatttttcgtcattcacctttccttgatttagacataataatgggctcttggtctagatcatactttctaagaagagaaaaaaagttgcattctttcactaaaatatctccaattcaaattctgtttaagtggctgaagttccaaagttcaggatttcagaggactctaaaaatgattgattatgtcctagatcgctattctcccaaagagttttgaaaggtgaaaaggtaaatctccaatggaatacttatcaaactccaagagaaaatgaatacaatggagaacaaagttgaaaaaaaatgaagatgaaaatgaagaactaatggggagaatcatttgtgcttttacagcctttacatgccattactttaatgataacatatgacatgtcagtcatagttttcagagcaccttctcacttgcagtcactgggtgatcaccactctttctgaaggtgagaataatacaatactaaaaccaaacattcttaagtgattataatgaagcagatactattctaagcacattaagctcatggcatccctattaggcggttcatattattagaaaacctttgcagatgaagggacttaggcgtatggctcaagtcagcagtgatggaactgccacctatactcaggtcacctgactgcatatccagggttccttcttccagaatgcaccaacttgaaatgtttagaaagtaaccagccagttagggtgattttgttgtaatgatactatatttattctgctgttacataatacaggattagggaagtcagtgagtccaacccctacctccaggcaggacaaactagaaataattcctgacatatgcaaaacccatcttccttttaaagacatcaagaggaagtggtctcatgacctcctatattaacacccaggatataaagaagagtttgtatagctctagcactattgcacattcttagggaatgagaaaaatctcattaaaatttcatttcacaccactgagaaatgcaaagaggactctaacttaattcaaaattttaaataaatatcaagacttctgagatagctaaagctcagcaaagcttgcataattttgtttggcgattaacagagatggggagcagtgtggtctttcaacagaagcaccccagtcaaatttataagtaataaagttaattcactacttgacactacagaatgtgtgtttaccttagggtagtaatctgcaaactacacaccatgagccaaatatagccaatgacctgtttttgtgtggcagacaagcaaagatgatttttatagtttaggtggctgaaaaacccagataatatgtcatgtgaaaatcatagagaactcaaatgtcattgtccataaatacagttttttgggaatacagccattccattctattatgtattgtgtattgtgactttcatggtataagggcagaggtgagttgtagtaacagataccttatggcctaaaaagcccaaaatatttactatctggccttttacagaaaaagtttgttaatccctggtagtgaggcaaatgaaaacaagtatcttttttcttttacccacttcccctcattcaggtgaaggatggtatgaaacatttggaatcaggatgctagtaagcatctgtaaggcctcactgggccttgaggatgaaccctgatctggtttcatttacatgagggcagtcatggtcccagactagttcctgtctatattagtcctttacagtctacagctaggagtcctttggaattgcttgacagggattagaggaaaaacacatgacctcaaatgtccttagtgcttttggaagattggaacacagcagtccccatttatccatgagggatatgttccaagaccccaagcagatgcctgaaagcatggatggtaccaaatcatatatatgctgttttattctatacatgcacacctatgataaaatttaatttataaattagacacagtaagagattaaaaacaataattaaaaataaagtagaacaattagaacattatgtcaacatcactactcttgcactttaaggccattattaagaaaataaaggttattttcttaataacctttgggctgggcgtggtggcacatgcctgtaatcccagcactttgggaggccgaggcaggcggatcacgaggtcaagagatcgagaccatactggccaacatggtgaaaccctgtctctaccaaacattcaaaaattagctgggcgtggtggcgagcacctgtaatcccagctacttgggaggctgaggcaagagaatcgcttgaactcgggaagcagaggttgcagtgagccaatatcacgccactgcactccatcctggcgacagagtgagactccgtctcaaaaaacaaacaaacaaacaaaaaaacggttatgtgtacacaagcactgcagtaccggtatagtcaatctgataaccaaggtgtctagtaggtgactaagcagcaggtaatgtgtatgtttgaatatgctggacaaagggttgattcagatctgggcaggaaggaatggcatggcacaagattttatcatgctactcagagcagcatgtaatttaaaacctattaattgtttatttctgaaattctgcatttagtattttcatacgacagttttactctggcaactgaactgcacaaagtgaaaccatggataagaggaggctactctatataagtaatacataaatatgcatatttaagtttatttttctcactttaatagttgtatgtatggaatctgctttcagtatttttaaaacatttaattgacaaaaattttatgtgtttattgtatataacatgtttaagtatagtcactgtattatacaatagatcgtttaaacttattcttcctaagtgaaatttgatatcctttatcaagtatctctccatgcccaacccacagccctgataaccaccattgtactctctgcttctatgagttcatcatttgagattacaaatataagtgagattataaggtgttggtgcttctgtgcctagctcatttcactaaatttaatgctttccaggttcatccacgttgttgtacatgacaggattttcttcttttttaaggcaaaagattatttcattgtgtatctataccacattttctttcattcatccattgatggatacttagattgattccatatcttggcttttgtgaagaatgctgcaggaatatggaatacagttatctctttgatataatgatttcattaattaattgatataattgatttcattcatataattgatttcatttcctttggatatatacccagtagtgggattactggatcatctgtttatagttttttgaggaacctccatactgttttccataatggctataataatttacactcctgacaacagcattgattcccttttatccacatgcttatcaacacttgttatcttttgtctttttgatactagccattataacatgtgtgagacaatagtgcgttgttattttggtttacatttccctaatgattagtgacattgaacacttttttatatccctgttggccatttgtatgtcttctgttgagaaatgtctattcaggcccttagcccattttttaatgtggtgatttgttttctttttataaagttgtacaagttccttatattgtgggatattaacccctgataagatatacaggttccaaatattttctctcattctggaggtagtatcttcactctcttgattgtttcatttgctgcaaagaagctttttagtttgatgaaatcccatttgtctatttatggttttgttgcccgtgcttttggggccatatccaaaaactcattgtccagaccaatgttatggagattttcccttatgtattcttcttgtagttttatagtttcagttcttacatgtaagtgtttgatttattttgagttaatttttgtatatggtgtgacataagggtctaatttcattcttctgtatacatggatatctagttttctctacacgattttttgaagaaactgttccttccccattgtgtattcttggcacctttgtcaaaaataaattgacagtaggctgggcatggtgggtcatgcctgtaatcccagcactttgggaggccgaggcgggtggatcacctgaggtcaggtgttcgagaccagcttgaccaccgtggtgaaaccccatttccaccaaaagtacaaaactagccaggcgtggtggtgcatgcctgtaatcctggctacctaggaggctgaggcaggcgaatcacttgaactcaggaggaggaggttgcagtgagctgagatcacgccattgcactccagcctgggcaaaaacttcatctcaataaataaataaataaataaataaataataataaaataaataaataaataaataaattgccagtaaatgtacagatttatttctaggttctctattctattccattgatgtatgtctcttttttatgtcagtagtaccttgctggtactactatactttactatattttatagtatattttgaagtcaggtactttgaggcctccagctttgttgttttgcccaagattgctttggttattctgagtcttttgtggttccataaggtttttagaattttttttttcttttttaacttatgtgaaaaaatgtcagtggaattttgatagggatagcatggaatctgtagatcactttgggtagtatggacattttaacaatattaaatattctaatccatgagcatgagatatctttccatttatttctatattctttaattttttcaacaatgttttttagttttcagtatataagattgtcacctttttttgttaaatttattcttaaatattctatttttttgcagctattggaaatgggatttttttcttcatttctattgttatcaatgataattaattgttagtattagaaatgctactggtttttatatgttgattttgcattctgcaactttattggatttatttgttctaacagctttttggtggagtctttaggattttctacatataagatcatgccatctgcaaacatgaacagtttaactgcttcctttccagtttggatggcttttatttatttttcttgcctgatttctgtaggtcagacttctagtactgtgttgaatataagtggtaagtgtggacctccttgtctttttcctgatcttagagaagaagcttttaggtttcctccattaaggatgatataaactgtggacttgtcatatatggccttttttttgtttgaggtacgttctttctatacctaatttgttgagactttctctcatagaaatatattgaaccttgtcagatctttccacatttattgaggtgatatttattttgttcttcattctgttaatgtggcgtatcacttttatagatttgtgtatattgaaccatgcttgcatcccttggttaaatcccacttgatcatggagaatgatattttttatgttgttgaattcagttttctgacattttgttgagaatttttgattccatgttcatcagagatattaacctgtcattttcttttgttgtagtactcttgtctggttttattatcagagtaacgtgggactcataaattgagtttgcaagctttctctcccttcaatttttgaaaggctttgaagagaattggtattagttctactttacatgtttggtagaatcaccacttcttggtcttttttttttttttagagtttttttttcctgtttgttcagtctccttacttgctattattctgttaagttttatatttctccatgaccctctcttgataagttgtaagttgtatctagaaatgtatgtatttcttcagtgttatctcatttgttggcatatggtagttgttaatggaagtcggctatgatccttttttaattttgtggtatcagttgtaatgtcttttctttcattttttattttatttatttgaggtttttttgttgattagtctaaggtttgtcaattttgtttaccttttcaaaaaacaacacgttgatcttttttattgtctttctagtctttcatttatttctgctctgatttttaatattctttagttctacacacttcaggctatgcttgctcttctttttctagttccttgaggtgtaaaattggtctatttacttcaaatatttctcttttttatgtaaatgtgtattgctatgaacttctctgttggaactgcttttgctaaatcttatacattttggtattttgtgtatctatttttatttgaaatttctcttcaaatttcttctttaaactattagttgttcaggagcatgttgtttaatattcatgcatttgcaaattttctgaaattcattctgttactgatttctacttttatactattgttggttggaaaaggtatttgttatgatttgctaagatctttaagtcctaggtttgttaagacttgttttgtctcctaacatatgatttatctggaagagtgatccgtgtgcacttgagactaagtgtatgccattgttgggtggaatgttctttatatttctgtagtttccttttaatctaaagtctgaggtttccttattgattttctgtatggacaatttatgaatagctgaaagtggggtataaaatctcctactattgtgacattacaacctctccagatatattaaaatttactttatatattcaggtgctttgctcttggctgcatatatatttataattgttataatttttttgataatttgacttctttttcaatatataatgaccttgtctctttttacaggttttaacttaaaatgtattttatctgatatgactaccactggtttccatttgcatgaaatatatttttccattccttcattttcagtctagtgtgtccttaaaggtaaagcaagtctcttgtaagcagtatattgttttgtctacttttttatccattcggaccctctatgtcttttgattcatgaattgaatccatttacatttaaggtaattattgacaagtaaggacttaaacccattttgttttgtagagcctttgtttctttttccttctcttgctgtcttcttttgtaattaaataattttctttagtggtatgttttgatatcttgctttttatcttttgtggatctacaaaaggtttttgctttgtggttaccatgaggcttacataaaacatcttatagttaaaacaggctattctattttaagctgataacatattatgtttaatctcatttttaaaaatttatttactttaccttaccccttacaaattttatgttttcaatataacaatgtgcatctttttattttgtgtgtgtgtcttaaaaattattacagctattattattttaatagttttgtcttttaaccttcaagcaaaagatgtaaatggtttgcacaacaccattacagccttaattttctgaatttgactgtgtacttttatgaatgagtttaatattttcatgtgtttttgtgatactaatctgcatagttttctttcagcttgaaaaactaccttttgcattttttataagacaggtctgttggtgataaactccctcagcttttgtttaagaaagtctttatctcttcatttctgaagaacagtttttttcaggtaaagtattcttagttggcagattattttccttcagcactttgaagtatgttgtttatatatcatctttgggctgagcctcctgacccaatgcagagccagtccagtcaacatagactcaggcttaaagactgcagcagggtaggccaggatggcccctgtagttctgggctctggattggaaagaaaaatataatctcactctccccttacatgtgaggtttctgctgagaaatctgctgctacccttattgcaactctcttatgtgtcacttgctccttttctcttgcagctttcgggatcctttctttgtctttgagtagtttggttataatacgtcttggtataatcttgtttggattgaatctgaatagagacacttgatattcctgtacctggatataccttttctcatctttggagaattttctgctattttttaaagttttgttctacccctttgtttttctgtttttcttcatcaactcctaaaatcaaacatttggtgttttggtgctatcccataaatcctgtaaactttcttctttcatttctttatttttttttctcctcttgactatatacttacaaataacctgtctttgattttacatattctttcatttgcttaattaattctgcttttgatgcattctactgtatttttcatttcattaattgtttcaactctaggatttctgtttgatttttgttctaagttcaatctctctgataaatttattttattggccatttattattttactgatttcattgaattatttctctcttctcaaagtttaatgaacttccttaaaccaattattgtgaattatttgttaggcagttcatatatctccatttatttagtggcgcatctactgggtgattactgtattttttggtggtgttataagttcttggttttcttgtttcttattgccttatgttgatatctgcacatttgaagaggtaaggagttattttaacctttgcagactgactgcctgggaaagtccttcaccaatcagctcattcagagagttttggcaggatacctgttgtgatctgtaggcagacttgctgttggacttcttggacaagctggcctggtgtctgggtcagcctatgaatgggcctagcacctaggtccacatggttgagcctagagtttgaatcctctggggtggatctgatgattagattcatggcagcaggccaagagcctgtatccatggtaaagcctgaggtgtgggtctacaggtgttgactttgtgctggggtaagcattgagactgagtctgccatggtaagccaggcactaggatgaactttgttcctgggctgggtctgaagcctgggtgcttggaaagtggcctggccctggggaaggactatgtcctgtgtccgtggagacatatttagaggctgggtctacaggggtggttatggagtgtcagtccatggagttctgcctggcactggggtccattggggtgggtctggatcttcattctgctgaaacaggccttgaccctagatccactggagtctgaaactactggcactgacctggagactggagttggcctagtgctgggacaggcatgcaaccttagtctttgggggctagtctggagcctgggatcttgggtgctggcctgatgcctggagccacagggtctggcctggagcctggtatggtagaaacaagcctagagtatgagtctgcaggtactctcctaaagggttactgtgtggatgctggcctgtaggttatgcctgtgaatgttggcccaggtactggggccataggaatcagcctggaaccttcgtccctaatagtggtcttggagcctgggttcttgggatgagcacagcactggggtccactgggatggacctagaccaattgtctggtagagcatgggaccacaggagctggccgagagggtagagctgcagggcccaggctggtacctggtaggcctggagcctgcgtccatgggtgttggcctgatgcctgacctgggctgtggaatgcctgaagcctgagattgtatacacaaacctgattcttgactcgtctggaaccttgaagtcttggaccctgtggccacagaggctgccccagcagtttggcgtacctaaaacctggggatgtggggcaagtctgtttctgagagtggtacaggtcccagggatactgtaaccagcctgggcctggtgcaggcctggagcctaagtctctgtggtctggcctggctctaggatggctcaagaggctcagtccacagttaccagtctggagtcttgaactctgggggcctgttcagtgctgagttttattagaatgggtccgatgttggggacgaggacaaagtccattgttcacttccctctacttaccctaagcagagggtattgccattcatgctgtgcgacctggggttatggaggggtgatgcaagtaatatgaaactttcctaccctcttcaacgtgtcttcttatttctgtgctacttctaggtactgcaatctctcacttcatttgcttagctcttgtccaggtatatttgtgtgtgcatagttgttcaaatggatgtttctgcagcaggaggagatgagtcctggaaagttttattctaccatcttgctgatgttcagaccattcctctagttatttgtgtcattgagatctgcatttctctttgggcaatagcagtaacaggtctaaaccaaattgacattaattttgagtaatagagtttcctatttttaaaatttattaatttcctaaacctgcgtggctgcaagcatgtgtgtcatctctattaattgccaagctcagtgtggtcttcagaatataggaatggataaagacacagtccctgtcttcaagaagctcatagtccgaggtgtggggaggggtggggcagagagacatgtatcttttattaccttttatgtatgaattgccttgttaaacttcctcatgcagcttaatgagaccagagaagagggaacaattacatctccctggggaatagcattggagctgggtctttgtgtattaatagaaatttatagggaagacagagagtgaggggaggtgaaggaatccagaaatttgtaatggcattaaaaaatgtataggcatgtgaaagggcctggatgaacctagaaatggcctgacctagtgttcactgtgtgcatatctgaaggtggaaaaagtgggagaaaattgggaaagtggaaaggatatgatactcaaaagagaaaaattattaaggccaggctatagaaggccttgagtgccaccaggatgaagagtttagactttaggctttactactttatcattgcattaatgaaaataataataatttaaaaaaaaaacctcaggagattttaagccaggcatgaagtaattcaatgttagaagctggcttaatagttcagaataataacattggcagtttgaagtgcattctactttggtggttatatccatttgtggttttttttttactagtttttatactgctacagcaaacaacttcaaaatctaagtggtttacaacagccagaaaaaccacatttctcattatcagtacatgtcttccacgattggctttgacttttctttctgtgcctttgttttgttttgggagccaggctaaaggaacagcccctacctgggccatcctaggctgatatgagatggcaaagggagtgatgacagaaccaagcaatagcttttaaagtttctctttgaaaaatggcatgtatcatctccacttattattattttactggcaaaatcatgtcacatgacttacacaaactggagggcatagtgcagtcatctcacagagagggaaacaaatattagaaacaaacattagaaggaatagtaatgtaatccattggaatagtaagtgtacaaccttaccacctaggtttatatcccaggtctgctacttcctagctatgtaaactctggcaatttacttaacctttctgtaagtgttatttactattagaataatcttaatgaaaacatggaagtgaatattcatatatatgcttgtaacatttgccttttaaaattattgtctaaccttatttttacaaagatttcccaggtcctggatcccttatacctttgtcaaattttggacctgcagaaggctatgctcacctatgtctcaaaataccaaatacaactcagatttaccctcatagtttctactctacctaacagagcactttgctttgaggaggccctcaacaacatctgttctaatgaatggaattagatctgctgaggctctgtgggaagctgccaatagcagtgatttggaaattgcattcaaatggtccttagattggcaaagtgagtgaataaaagggtttaggacattgtggttgaaataactcttttaggacactaatgtcaccaattgacatttatacggagcttatatgtggcaggcattttacatgcactatctcatttaatattcacatttcttcccaggaagatgtttcatcatctttatattgtaggcaaagaaatggaggtacaaagattctaggaaactttcctaaggttatacaataaggaagcagcagaagtaaggttgaaatcatgacagcctactttctgagcctataacctgaactgttgtatgatcctattcctgcagcagtagccatcaccaactcaatattaaaaccagaatggcctttcaaagagatagctctagtccaggagtttccaagctgtgtttcacacaactttaggttccatagaggaatagcctttgattacaagtttctgggtacttagggttattgctgtaattggaagctatgatttcaaattgttgtatgatcaaaagacttttactattctgtttggcccacattataatatatacatattacaaattccaatttacaaaataaattaatatatacctgcatttttttaacgtcagagagctacatagagtttatttggggaaagcaaatgttatcctgaagaagaagttagagccactgatcaattccaacttttttttcctagacagttaaataaattgaaggctcaggaacaggggaagaaacattacaaccagactttcatattaggattcttgactctgtcccagttgtttctgctgtatcttgctgcttcagatagcaaaatgctacattgaatcgtatgcaacatgctacagcaagaaataaccaattcaactcactcttcctttttgtgtattcccaaaccctgagagatccattttcataaaatttgattgatctgtttagattgtctttatcgtactctaggatttgcttttttttccttctcattgataatattttaatagctacccctaggctgcagtggattcttcagttttatattgcacaatatatatggcttttcaataatttatcctttaatgcttataaaaagtgcatatgtgttaaaaattaacaaagaataaataatactctaacagcaagactgtttagatataactattcaccaaggaataagactgtcaaaaactgtgttaaatgtcttgtttagagcaacattttaaatagttttgtttgataattttttaaagaagtgggttatgtgttctaaaaaaattctaaattaattctccattgtgacagcatgctgcctaataaaaaggatcttttagattataacaagactgaggcagggagagaagataggtagaagatctctacttactactcaatttttctgtaagccaaaacttctctaaaaataaagtttattaataataactttaaaagaccctgaggatcagcacaatatatctatggctttcaaaaataattatttacttcattgagaaggaatactttaagatactcattagattggcaaaaagcttatagtaggataataccacaaggcagtaaacatattagtcagaatgagctatgcaatgctacagtaataagcatcctcagaatctcagtgatttaaaacaaggctcagaaaactttttctgcaaagggacaaatagtaaatatttcaaacttatctcaactactcaactcttcctagacaatatgtaaataaataggcatgtctgcgggctgtgtttctataaaagtttatagaaatatgcagtggaccagatttgaccaataagccatagtttaccaaaccatgatataaaacattgatgatttatttatggctcatacctaatgtttattgcaagccaactagaggctttattctgtcatcatcattgagtcccaatgtgatgaagtcagtatatggatcattaaagttcactgaggcagaggcaaagagaaaacatggtgaattcctcactagctcttaaggcttggctcacatttcattgcctaaaacaatttgtatgtctatgactaacttcaaaagggatggcagagggcaatgcctccatgtgtgtagaagacagagatctagaaatagctggtgaacgataattactacaaccgagaggatgtggggaaatgtgaattctgataccctggtggggagaatgtaacttgaaaaaccactatggggagtaatttaccacactgagcaaaattaaatatatcctacacaccaaaatttccactcttcattgagtgacctacagaatctcttatataagtgttctaaaaaatacatacaaagatgttcattacagcatagtttataatagaaaaaaatgaacacaacttcagtgtctttcaatattagaaaaaataaattatgatatttttcataaaaggaaatcatacatagcagtccaaatgaacaatatatatatcaattaaaatgaattacagtgtcaaatatatttagataaatttatttggggtggaaaaggaaagttgcaaaataatacatacacaatgattttacttatgtaaatgattaaaaactatgttgtttgtagaaaaataatataaagaaatgggcacatattaacataaagacaatgcttgtccctgaggagatgtggggattaatgtattgtagtgttttatttcaattaaagcatctggagaagctatggcaaaatgttagtatccattaaatctggatggcagataacataggtttctgttatgcccttcttatacttatttgtatggtcaacatctttttaaattaaaaagattaaaaaattgggtgggcgtggtggctcatgcctgtaatcccagcactttgggaggctgaggtgggcagatcacgaggacaggacttcgagaccagcctggccaacatagtgaaaccttatctctactaaaaatacaaaaattaaccgggtgcagtagcacgtgcctgtaatcccagctattcgggaagctgaggcaggagaattgcttgcacctaggaggcagaggttgcagtgagccgagaccacaccattgcactccaacttgggtgacagagtgagactccatctcaaaaaaaaaaaaaaaaaaaaaaaaaaaaaagataaattactacagctagagtgtggctgtaagcagagagagaagtgtcatggtgatagtaaatgacacaggaaaataggctgagctgagaacaagacaatgaattggcttctgatagcataacaggtgcaaaaaaatgagccatgaaaaagaataaaccaacattacttgctatacggtctgaaagcaaacttttcaggactcagctttctgatttatggagagttaattgtgaataaaaccctcaaaattaaagttcaacttttcatgcccatatactatctatctttctgtctgtctgtctatctattatctatctatctatctcaagcaaaaatacgaggttgcaggatatagtggaaaggagtttttgaactgaccctggttcagttatttactagctctttgacgtaaagcaaattactttagctgaatctgtttccttatctataaaatgtgagggaaaatccctgtcctgtctgttccttggggctgttataaagatcaaatgacataggtatggtggtattatttgaatttctaaagtgctaaacaaataaatgacagccctaaatgttgagaaatatcagaagttatttaacttgctagttttctctgttatatgggactgtgtctttcttgttgctctatagtctgactaccttgtggaatgaagcattgtgccaggtgtttttaggacctggttgatttagacccttctttagatgtttcttgtctccaattttcaggagcttgcaggactatcagagtttatattctaaaaataacatctttggctttggtagatttttctaatggagttctggaactgtcattcagtataaaatgtgtatagcaaaacatgtttactcacaataagtaaatattttggaggacagggctatttagataatctggttagaccagatcattcacctaaactactgtttttcttattttgtgtggtataagatgacacataaagcagttgatagagaaaagatataaggatatttttagggacactttttttagatctttcccaagctggttagtttttcctttcaacacagacctcactgttattttggcatacccttggctaagtatctgaaaaatgatagcttttaaatatattgcttttcatttcctgttctatgtttcagaggcacaaaataacttacatgcttgagatacaaactatttttggtagactttatttacttggtttgggcgttgctaagtaagggctgaatttttatatgtcctgggatagactgttctggtccatctccattatatatgacattagcatgactatactaatgtcatgctctaaaacagtaaactcttagccagctctcccattacccccatgcacatctcagctctttcaccacctaaaagccagaaattcacaccatctctttttcaaggctacattaaagcatctatgagttcctaatcatctgtcaactttacctcttttctcatctcaaaccttcaatttccactttttttctaattattaacaacaaatatatttgtgcacattattccttaggttactgcggcatctatactcattcatcaatgtgcagctcaaatgtcatttctgatgtaaagcctttcccaccagtagaaccaggagattttcttctcttattcattctgacatataagtttgagtatgttctaattaaatattttacataaagttttcttgcacctcacatgttagactgtgggaacttttagggtagggattgtcttattctgctttgaatcattggtacctttcacagtactcaatataagttatttgtattgtaattccctttatccatcaagatccttatgagaagcaaaaacttaaagttatgacccaaaaaagtatttactatcagtcctgtgaggaagaaaatggagtttatatctccaaaaacatttaggttggttttaattttcagagagaagaaagatttcctttcagaatttttgccagatcagtgaagagctaattctgttctaggagaaggtatttgcaggtgttatcttttttaaaactaaagtccaaaacttaatcaagttttcttagattttaccgaatgccctttttcagtttcagagtctcatcaaggatagtacactgccattagtcatcttgtctccttaggcttctcttgcctgtgacagtctcagatattccttgttttagatgaccttgacaattttgaaaagtgctggtcaggtgttttctagaatctcccttaatttggatttttcttatgttttctacatgagttagactggggttatgggttactgggaggaagaccacagagataaagtgccattttcatgacgtcatatcaagggtacgctatcagcgtgactcataactgttggtgttgatcttcaccaattgagtgaggaagtatttggcagttttctccactgtaaactcactcttgtattccctctttccatactatcctctttggaaggaagtcaccttggacagcctacacttaaagagcggtgaatcattctccctttacttgagggtagaatatttgcataaatggtttgaaattcttctacaaaggagatttgtcttttttcttccatttatttattcaaatagttatttatatcattatgaactcatggatatttaatttacactttgcattctaattcaatactactttatttattttcttcctcaaattgtttcagttttggccattggcatctctttaaattgactccaatgtgtctttgatatgcccccttcactgcattttttgtttgttttgatttcttttgcttagaatgtccttactgtcaaaccctacaagatattccaggcttatcttgtatatttcctagcccagtcctaaaatgagctattttccaaggagccctgatgccctttattggagaatagtatggcactatcttttcagaaacagtggcatgatgataatagtggaaagcttatgtgaaacaatttgtgcttagatgaattctgataagtatatgccacacagtgtgacactggataagaattgagattctcatacagctcacctgtaacacaaatagcataaagagattcctgcaggttctaaaagactttctagtttcccattttttcattcttacactagtcattttgaatccttcacatttgcaatgaagccacagacaattaaactttgagataaaatatgacagaaaatggtactaaccttataaacagactacttagcaaaacaatctcccaaataatagtaattatatgctttgccatttgcgtggtgagtatacttacgttgactaaataactctgtgtcagttatgatgccaattttagtttttagatgttgtagcattgtgcaaattttagctgaaaggcaaaaatgattatctgagcaatctattgctccatctagtatttatagtgcaattaaaatgttcactgctgcacttatcaaaagtagcataaatcttataagacattaatatatatgctttaaataaatgttaccgctaattattctaacatgaccttttctataaaggtatccattgggacataaaacatatgaaggacaaatgattccaagacattttagggacactgcttttttttctttttttctttttgtcaaaattctctctgactcataaggatttccttccagcaatgttataaagcaatatgataatcaacaaatgaaggttaagtactcttcccactttcttatgcttaaaataaaattagccagatgaccttttcacagttacatgaaattactatatttttatctttagcctaaaagtatacagccaaaaggaaaacaaatactgtactctgtttaatcagatgttgaaccagtcccccagtgctatttattttccatcgtttctttcagcctttgtcatttctcattagtacagttgcagagaaatctcgagtgcttttttgacctcacatatgctttattttccaataaggaaagccaatggaccttctgtctggaacctttaacatattgtctgaagcatttcctaaaataaatatgtcaaccaagtagcaaaataaattccagtaatgtacagtatctcatatcctgcaaagtcaccgtgcagacagtgctgccaatcctttgcaggaagtggggttagagtggaggagtgcttgactttcaggaaacattctatgcaaaagcaattggatcagggtcacctacaagaaagtatggtgatcattttctaatacttataaccaggagttagaacatgtgacaatggatcaggccactaaaaatgatcatattacttgatatggtttggctctatgtccccaccaaaatatcatctctaattttgtaacaatccccacatgttgtgggagggacctggtgggaggtaactgaatcatggggtcaggtttttcccatgctgttcttgtgatagtgaataagtcccataagatctgatggttttataaagggggttcctctgcacatgctctcttgccttctgccatgtaagatgtgccatcatcctccttgatttctgccatgattgtaaggcctcccagccatgtggtactgtgaatccattaaacctgtttcctttataaattttccagtattgagtatgtcttttgtattagtctattctcacactgcgaataaagacatatccgagactgggtaatttataaaggaaggaggtttaatagactcacagttccacagggctggggaggcctcagagttatggaagaagacaaaggaagagcaaagggacatcatacatggtggcaggcaagacattgtgtgcaggggaactcccctttataaaacaatcagatcttgtgagacgtattcactatcatgagaacagcagtggaaaaacctgcctctgtgattaaggtacctcctactgggtccctcccacaacatgtggggattattgtaataatcagatgagtcaaagtctcatctgagacaaagcaagtcccttccacctatgagcgtggaaaatcaaaagcaagttagttacttcctagataccataggggtacaggcattgggtaaatacagccattccaagtgggaaaaattggccaaaacaaaggggctacaggccccatgaaagtttgaaatccagtggggcagtcaaatcttaaatctccaaaatgatctcctttgactccatgtctcacatccaggttgaatggatgcaagatgtgggttcccatggtcttaggcagatccacccctgtggctttgcagggtacagcccccctcctggctgctttcaaggctagcattgagtgtccgtagctttttgatgtgcacagtgcaagctgtcagtgtatctgtcattctaggggctggaggatggtgactctcttctcacagctccactaggcagtgccctagtgagggctctgtgtgggggcttgcatcccacatttcccttccacactgccctaacagaggttctctatgagggcactgcccctgcagcaaaattctgcctggaagtccaggcatttccatacatcctctgaaatcttggcagagattctcaaacttcaattattgacttctgtgcacccacaggcccaacaccacatgtaaggtcccaaggcttggggcttgcaccctctgaagcaacagcctgagctgtacattgaccccttttagccacagctggagcggaaatagctgggatagagggcatcatgtttggaggctgcaaagagcaggggccccctgggctcagcccaggaaaccattttttcctcctaggcctccaggccatgatgggaggagctgcaatgaagacctctgacatgccctggacatattcttctcattgtcttggtgattagcatttggcttcctgttacttatgcaaattcctgcagcctgctctagtttctacctaggtaatgggttttgcttttctaatgcatcatcaggctacaaatttttcacacttttatgctctgccacctcttgaatgctttgccactcagaaatttattctgccagataccccaaatcacctctctcagttcaaattttcacagatctttagggcaggggtaaaatgccaccagtctctttgcatagaaagagtgacctttactctagttcccaataatttccttatctgcatctgagagcaccttagcctggattttattgctccatatcactatcagcattttggtcaaagccattcaacaagtctctaggaagtttcaaactttcccacatcttcctgtcttccgaaccctccaagtctctaggagttccaaactttcgcacattttcctatactcttctgagtccaccaaactgttctaacctctgcctgttacccagttccaaagttgcttccacattttcaggtatctgtacagcagcaccccactctactggtaccaatttactgtattagtctcttctcgtgctgctaataaagacatacctaagactgggtaatttataaatggaagaggtttaatagactcacagttccacatggccaagggacctcacaatcatgggggaaggtgagtgaagagcaaagtcacttcttacatggcggcaggcaagagagcatgtgtagggaagctcccctttataaaaccatcagatctcatgagacttattcactaccacaagaacagcacaaaaaagacccacctccataattcaattacctcccaccgggttcctcccatgacatgtggcaattattggagctgtaattcaggaggagatttgggtggggacacagccaaaccatatcatctttattagctgtgtgagaacagattaatgtagtaaattggtaccaggtagtgaggtgctgttttaaagatacctgaaaatatggaagcaactttggaactgggtaataggccaaggttggaacagtttggagggctcagaagaagacaggaaaatgtgggaaggtttggaacttcctagagacttgttgaatgtctttgaccaaaatgctgatagtgacatggacaataaagtccaggctgtggtggtctcagatggagatgaggaacttgttggaaactggagcgaacgtgactttttatgctttagtgaagagactggtggcattttgcccctgccctagaaacctatggaactttgaacttgagtgagatgatttagggtatctggaagaagaaattcctaagcagcaaagcattcaagaggaagtagagcataaagtttggaaaatttacagcctgatgatgcaatagaaaagaaaaacccattttcttgagagaaattcaagcctgctgcagaaatttgtgcaagtaataaggaactgaatgttaatcaccaagacaatggggaaaatattttcaaagaatgtcagagacattcattgcagcctcttccatcacaggcccagaggactatgagggaaaaatggtttcatgggctgggctcagggcctcactgatatatgcagcctctgaacatggtgccctgcatcccagcttcttcagctttagctatggctaacagggattaacgtatacctcaggctattgcttcagtagatgcaagccccaagccttggcatcttacatgtggtgttgggcctgtgggtacacagaagtcaagaattgaggtttgggaacctccgcctggatttcagaggatgtatggaaatgcctggatctccaggcagaagtttcctgcaggtgcagtgccttcacggagaacctctaccagggcagcgtggaaagaggagtatggggtgcaagcctccacacagagtttccaattgggcactgcctacaggagttgtgagaaaagggccactatcctccagaccccagaatgacagatccactgataacttgcatcatgcacctggaaaagctgcagacactcaacgctagccttgaaagcagccaggaaggcagctgtatcctgcaagtcaaaggggcagatctgcccaagcctgtggaaagccatctcttgcattagtgtgacctggatgtgagagatgtagttaaaggaaatcattctggaactttaagttttaatgactgccctattagattttgcacttgcgtggggcctatagccccttccttttggctaatttctcccatttggaacagctgtatttacccaatggctgtacacccattgtatctaagaggtaagtaacttgcctttgattttacaggctcataggcagaagggtcttgccttgtctcagatgagactttggactgtggacttttggggttaatgctgaaatgagttaagactttgagggactgttgagaaggcatgattagttttgaaatgtgaggacatgagagttgggagtggccaggggtggaatggtgtggtttggctctgtgtccccacctaaatctcacctctaattgtaataatctccatatcttgtgggagggacccagtgagaggtaattgaatcatggaggtggatttttcccatgctgttctcgttaaagtgaataagtctcacaagatctgatggttttataaaggggagttcccctgcacatgctctcctgtctgctgccatgtaagatgtacctttctcctccttgccttccacaataattgtgaggcctcccaagccatgtggaactgtgagtcaattaaacctctttcctttataaattacccagttctaggtatgtgtttaatagcagcatgagaatagactaatacattactggagcagaggcagggtgtcagagtgttgaggatgtaatttcagcacagggtatgaacgtgtctgtataaatgctatcaattgtcatgtgtgtgtgttcatttttagaatgctagtaaattatagatattgaaaatctggctttagaaatgagctcttggtagatctaaattttaccacttcttgtatatgataatttaagccacattactatgttgagaaagacttcaccagatcactgttcttttacataaatgtgtgtgtgtgtggtgtcttgaacaaaatgaacaaaatacacaagatactctgtccatttattttgtacctaacaaccttagtaattaaatgcaagtcaactgctttaagtcaattatttaacccttttgccaattctattaaaggaatgctgattgagcatatactgtgtgcttcaacttctcctgaattgtgtagagatcagatacaatatgatctacacatttgagagtctgcaatttagttaatattgaatatatatgtccataaaaataccatatgggatatgacttctaagttcttccatatatgtttgaaaatatgaagatttcacagtggaatgacatagccattatgttatcatacaatagataattttataggaagggtgatacctgatgacaaaaaaagttgtttgtcaatattaatagtttttacaagcttgtgcagatggatattagcatggcatttagggggaaactaggtcaaagtgggatcattggaaagataattatttaagcagttgggccatggagagttcctatttgaagttttagtcagtgaagaggcactgcatatatatatatatatatgtgtgtgtgtatatatatatatatatatatatatatatatatatatatatgtttttttttttttttagattgagtctcactctgttgcccaggctggagtgcagtggcacaatctcagctcactgcaaccaacctccacaccctggtttcaagcgattctcctgcctcagcctccccctgcgtagctgagattacaggtgtccaccaccacgtctggctaatttttgtatttttagtagatatgcggtttcaccatgttggccaggctagttttgaacccctgacctcaagtgatctgcccgcctcggcctctgcacccggcaggagccgctgaaatgtttgaaagtcagtaagtacagtttagtgtttgcttctcagccatacagtctgggtaaaaatcctgactcgttcactagctttgtaactgcaaattgtttaatttttctgaacctcagatgtgtctttagaatgaaaatataatagttattacttcaccggactgtgtgaaaatcaatggaagtaacacatatttatctcttaccatgctgtctgggatggattaaatgctccataattggtagctgttgttattattaatagcatgagcctagcagttagaagaagaatttcagagcagcgtaactaaaggatgcaaagttactttcaggcttagtgtagtgatccaaactgtattaatgtacaataaaatataaatgtgaaataggttaagcctattgattatcaaaacctattgcaaatgcttttttgtagggagaatagagcaaagctgtgctttcagtacaactcataggttatttttggatttgaataatttttgtataatgttctggattaccgtaatgtaaattgtgtactgttttaggggataaaagtgcatattgaatatcaggtcataaaaatgttattcagatctgtctcataaaactatgaaatcttcagagccagggatttgtacagcaccgaggacaaggccactgagaggaatgcaaagatacatgtgggcagggaactgccgtagtgacaatgttcccagaccccgacatggtgtctgacttaaagtaagtactccattaatgtttctttgtggtagtgccttacttttattttctaaaggaatccatgcgtattgttgagataacaaagtggtaccaacagacataacaacatatagcagtcccttgtcacagccctcttcaatctaagccacatacctcagagacttttgactctttcttctggtatgtacttctagtttttgtaaagaataagcatgtgctgatatttctggaattatcaatcattatttttattttattttattatttttttatatttttaattttggtgggtacatggtaggtgtatatatttacaggatacatgagatgttctgatactactggcaagaatgtggacaaaagggaacctttgtacactgttgatagaaatataaattatttttatttttatataaattgacaatttgaaattttgtatatatggggtacaaagcaatgtgatgacttatgaatacaataggaaataagccaagctaattagcatatccgacacatcacatcttttttttgtgatgagaacatttgaaatgtactctcttagcttgaaatgcacaatacactgttatgaactgtattcaccacattatgcaatagatcctaaaaaccttaattccttaagtctgaggctttgcaccttttgaccaatatctccctattctccccactccccagcctctgtaaccagcattatattctctgcttctactggtttcattgttttagattctacatataaatgagataatgtagtaattgtctctctgtgcctggcttctttcatttagcataatgttcttgaattccatccatgttgtcacaaatgacagaattttcttcacttgtaaggctgaatagtactctattgtgtatatgtaccacatgttctttatccattcttttgttgaaagacacttaggttgatttcaattcttcaccatttgagtagtgctgcaatgaatattccagaatgtgcagacatctcttagacaaattaatctttctggcaaatacccaaacacaggattactagatcatatgaaaattatattattaaactttaaaaacctcttcgctgtttctctagtgactgtactaatttacattcttaccatccgtttacaagggttcagttattggcataatctgtacaattctttatgttacaacctccactcctcacctttatcttcccaaaatacttatgtcaaaatttttggttaaagtagcagtgaattattacatttttaccatgtaaatattactcactgctgaactatgaagtgtacaattattttattccttttcatgtatcattttgtgttgtctggtatggaatatgcctgatttttttttactagcttaattttccatgtacctttacctaattttccaaaatcccaaacattaccgtagcattctgctcaaaattgtattcaaattcatgaatagtttgtcactctatcagttcttcttttctactttttaggaattcttcctcacaactcaagctcaccatctcttgggcttcagtctgtattagttgctccctaaacctgcaaccaaactgttattctgacacttcccttcaccaccacctgggacttctctcatctcactcttaggttggatggcctcttgcctagatctcatgtgttcctattgcctagtttattatcttgttagggttaagccatatgctcagtggaagtggggaaggtgaatttctagagattttgcagctctaaaaatctcttaatttataggttgactgagcatgaaattctacttcagagtctttctccccacttccaggtttcagtagtacagttgcaagttctgatgatgttcagatttctggttcttattacattttttgaccatctatcccatccctagaaggctttaaaaatatttttcattatggctgtatggtaggctgaataatgctctctaaaagttgcccacatcctgattcctgaatcatgtaactgttatcatattaaatatatgataaaagggacttgcagaggtgatttaattaaggatattgagatggggagattattctagattatctaggagggtccaatataatcacaaggatccttataagaggtaattagagggatttttaatttagcttaatttcttttttatttttcatttttatagagatagggtcttactattttgtccaggcttatcttgatgattttgaactcctggcctcaagtgactctcccaccttggcctcccaaagtgctgggattccagttttgagctgccacacccagtcaaagagatgtgcctagagaaataggagatgtgattacagaagcaagaagttggagttaaggaagaaaagggtcatgagggaaggaatgtaaacagcatccagaagctagaaaagctacggaaacaaattttctctgagagactccagaaggtaaaagtcctgccaatatcttgaacttagcccagtgtaaccgatttcaattgcttcccagcagagatatgagagaataatttttttttgttttaagccatcaggtttgtgacactttgttacaattaaagtaggaaactaatagaagtggtgatctaaaattcctcaatgtgcctatctataagccttttggatttattacattggccactttcaatctgaaaaggcaagcccttcagttctaggaaatactctcaattatatatgtttgacagtttccactcctccgttttctttcacctctctagacttattaggaagatattgtggctcacaaattgatcctttaattttttaatcttttctctcctgttacccaggcttatatttttaccctactttttggcaaaaaatttgaactttattgtcttatatttcgaagaaattttcaatttatatatataatatatattaaataaaaaataaatagtataataataaattaaataatatatattaaatacacacattgacatacatgcaaatacacacaagcacacacattcctaagagttatttcttgttctctgatcactttttatatcatcctgttctagtttcatgaatgatttatacaatatcttctactctttcttcgagaatagcattaataggttgcttttttacctttgaaatgttctgttttgaagtccttttctttgtctctttcatgtgagataatttcatttcattttatacttaaaataattattaaaacatgaattgggagttctgtgggcatgggcaagctttgtcgaatggtgtttttcattctaggatgatcgtgtgtgaactttgctctttatttaaagggtacccccaagtcagtatgtatagtaatcctgtccaagggaagggtgtgtgagttgaagagtagaacaggatatgtgaggagcttaactctgctgtacacaaaatttcatacaattctcctactttcagccctgttccttataccaccttctgctataggtgttgccatgaaatctgagcttctcggggttctgcagtcaaattgactgacttcttgctgctgctctttcttgtctgcagatatttcaatttcagctccctggtctttactaaatcactaaccactttgctaccaatctttaaaatgcagtgccatctttatctgttgtctcctttaccatgttctttgtctttgtggatttgtaccatttccatttgtgtgtaccataactttagtgagatttcaaggagcagaaacaaacacaagagctcagtctgctatgactaaatgaatgttgtacaatgaatatttgatgagtaaatgaatagcataccaataaatggtgacatgattaaatattatgaagctatacagctgataattgactatggttcataatgtccttcatgcatattaagtttttatttcttaaacagtagaagacagttaatggtatcaaggaaacattacatgtcattatgtaattgcaaattgttccttcagagaaaatttcagtcccacacatttgctggtgaagcaaagttaataaaatatatttattactcttactttttattcaaatagaaaccttagaaggtagatattagtaaccccattttagagacaagtaaacagaatccaagagttagagcaatctgttaaatgttacatgtgaaggcaggggcaggcctagacattgaaaccaagtattctttctgactcttggctaattattttttcctctcattacaccctgaagacccctcagaagaacatatctggctgcaactactttatctgcatgattgttagcattccccaaaagaaataagaaatgtattaataagccagaatagtgtaaagattggagacaattttattaatttgaaggaaaagtttaatgatttttcagttttatctaatacaaattggctgacaattataatttttattaaaatagtaatatatttgcaattatgctttgccacactgcttcatctattcttataacaattaatattaaaagacattttccttcaaaaggaaggtataaatgttgtaccgcaattgccgcattattctgtgattaaaatgaaatatgtattcaggcaaaatcatacaatatttagtggttccaataagagctatttggatcaaactagttagtaatatgctatttaagcatcttttctctctatatttttcatggattttctcctggttattaatatcatttgagaactattattttaatttcatcatatgataatatacggctttaaaatagaaagtgatgtggcatgctctgaatattaggcttacttcatttgcataatgagctgagtgtcccaaggctggtaactatagtcatttacttagcttgctactcaaaactttctagacaaatatgatagaggtgcagaagggagagaagattatgatatgaaagcacaatacggtacattctttgggatctgagaaatgtttgtagttattaaaagatgtctcccagagtcatggaacaaagcaaaaatgtagttttagcatgtaagaaagaggatgaaattgaattaatatcactatagcttaatcaattttttaatttataaacttctttattcctgctgtgacttacttcagtcattggcttattttattcactcattcatttaacaaatatttcttgagcatttgttacgtgctaggcagcataataggaattggggatatggtgctgtaaaatggacatggactctgtcttcatgaatatcacattatagtaggaagactcatgagaaacaagtaaattatttaaaaatataatctcagaggatgttaaactctatgatagtaataaatcagagtaagacaatatagtgtactaccggagggaggagctattaggatgatctgggaagatatatgaggcaatgaatgacatttgagcagaactgaatgatgagaagttatcaatcgtgaaaatcttggagaagagctatccatgaaggaagactgtgtacaaaggccctaaggtaggaatgaacttgttatgtatggagaacagcaagaaagccatggtggctagagtggagtgagtgaggggtatagtaggagatgatgtcagattagggagtcaggggccagactgtgtggggacttgtaggtcatagttagggcttggaattttcttctatggtgttagaggactttgagcaaagaaatggattgctatgactgtttgaaatggtaattttgatatctgtgttaagagaggaaaatataagtatggagataagttaggtagcttctgtagtatttcaagtaagagacgaagatggttcagaccagggtaatagtgatgcacgtggtgagaaaagggcagattagtaataaagttgaaggtagaactgacaaaatctcctattatttgtttgctttagggtttgggggcacacaggaaaggaggcagtatgtgatgattaagaacgcagtaaataaaactgatttattttctatgtttaatctagttgctgggtgagtatttgaaagaagtgcagaaaacttatttgtactttatcaagtcattaaatagggctctcataatcttatagataagataaagatatgcaatctgagtgcttatacaattggctacttactggaaaataactggaaagttactggaacataactgatagaaaatacaatgacaccatggggcaaggtttttagtagcatgatgtaggacattgatcttggtttggttgtggttattgacgttatcaatgacttgaatgaagatacagaaataacattgctggtttttatgggtgacaggtaaagcaggattacactagaagacaaaatctatggtttttcttttgattaagagttttatactgaattatgtagctacatgtagctatgccgtcctttatgcattcttggtcttctgtgttgtgtttaaaaagttcatcagtaggccgggagcggtggctcacacctgtaatcccagcactttgggaggccgaggcaggcggatcacgaggtcaggagatcaagaccatcctggctaacatggtgaaaccccgtctctactaaaaatacataaaaattagccaggcatggtggcgggcgcctgtagtcccagctacttgggaggctgaggcaggagaatggtatgaacctgggaggtgaggcttgcagtgagctgagatcgcgccactgcactccagcctgggtgacagagcgagactccatctcaaaaaaaaaattaaataaataaataaaaataaataaaaagttcgtattttaaaaccacacattgttttctagcattttattagttgtatgctagtataagtagtgaggtaagaattcgttttatttgcttcttaaattattagtcacttctaccaacaccacttagtaagaaattcctttccctctctgatttaaaatgccactttcaacataatctaaattcctatatatatagtgaatcaagttacatatatgtctcaatgatttatgctgcactattgctctgcctattcttgtgtgtgcactcattattttaaatttttatttgtatatcacaattttatttttttctatttttaatttttattttttatttcagtaggtttttggggaacaggcggtgtttggttacatgaacaaattctttactggtgattcctgagattttggtgcacccatcactctagcagtatacactctacccaatgtttagtcttatccctcatcccgctcccaccctttcccctgagtcccccaagtccactgtatcattcttatgcctttgcatcctcatagcttagctcccacatataagagagaacatacaatgttttttttttatccaattcctgagttactttacttagaataatagcctccaattccatccaggaatgctgtgaaagctattacattgttcctttttatggctgagtagcattcgatggtatatacatataccacacattctttatctacttgttgattgatgggaatttgggctggttccatatttttgcaattgtgaattctgctgctataaacatgcatgtgcaagtatattttttgtatactggcttcttttcctctggataaatacccagtagtgggattgctggatcaaatggtagatctacttttagttatttaacgaatctccacactgttttccatagtggttgtattaccagcagtgtaaaagtgttctttttttttttttttttctccacaaccacaccaacatctattattttttgatcttttgattagggctattcttgcaggaataaggtggtatcacattgtggttttgatttgcatttccctgataattagtgatgttgaacattttttatacacttgtttgccattttttaaatcttgttttgagaattgtctattcttgtcctttgctcactttttgatgagattgtttttttcttgctgatttgtttgggttccttgtagattctgaatattagtactttgtcagacgcatagtttgcaaagattttctcccactctgtgggttgtctgttaactctgctgattatatcttttactgtgcagaagctttttagtttaattaagtctcatctatttatctttgtttttgttgcatttgcttttgggtccttggtcatgaagtctttggctaagccaatgtctagtagggtttttccaatgttatcttctagaattttttggtttcaggtgttagatttaagtctttgatccatcttgagttggttttttgataaggtgagagatgaggatccagtttcattcttctgaatatggcttgccaattatcccggcaccatttgttgaatagggtgtcctttcctccactttatgtttttgtttgctttgtggaagatgagttggctgtaagtatttggctttatttcttagttctctatgctgttccattggtctatgtgcctgtttttatatcagtaccatgctattttggtgactatagacttatagcatagtttgaagtcaggtaatgtgatgcctccagatttgttctttttcttagttttgctttggctatgtaggctctttttcggatccatatgaattctaggattgtctgtttctagttctgtgaagaataattgtggtatttttatgggaattacatggaatttgtagattgcttttggcagtatagtcattttcacagtattgattctatccacccatgagcatgggatgtgttttcatttggttgtatattctatgattttgtcagcagaggtttgtagttttctttgtagacatctttcacctccttgattaggtatattcctaagtttgtttgtttgtttatttagcaactattgtaaaaggagttgtgttccttatttttttctcaggttggttgctgttgttgtataacagtgctactgatttttgtacgttaattttgtatcctgaaactttactgaattcatttatcagttctatgagctttttggatgagtctttagggttttctaggtataagaccttgtaatcagtgaacagcaacagtttgacttccgctttacctcatgtggatgtattttattttgttcctttgtctgattgctctggctagaacttccagtactacactgaatagaagtggtgaaagtgggcatccttgtcttgtttcagttctcaggggaaatgctttcaacttttctattcaatataatgttgactgtggggttgtcatagtcggcttttactaccttaaggtatatccattttatgcctattttgctgagggttttaattataaatcaatgctggattttgtcaaaagctttttctgcatctattgagataattatgtgatttttgtttttcattctctttatgtggtgtattacatttattgactggcatatgttaaatgatccctgcatccctggtatgaaacccacttgatcatggtggattatctttttgatatgctgttggatttggttagctagtattttattgaggatttttgcatctatgttcatgagggatattggtctgtagttttgtttgttatgtcctttgctggttttggtgttagggtggtactggcttcatagaataatttaggaaggattccctttttctctatcttgtgggaaagtgtcaataggattggtaccaatacgtccttgaatatctgacaattcagatgtgaatccctctggtcctggtttgttggcaaatttttattgcaatttcagtgttgctgcttcttattggtctactcaaagtttctatttcttcctggattactctagaactagagttttatctttccaggaatttatcaatctcctctaagttttctggtttgtgtgcataaaggtgttcatagtagccttgaatgatctttgtatttctatggtatcagttgtagtatctatctcccattttgtttttaattgagcttattttgatctctcttcttttcttggttaatctcactaatgatctatcaattttgtttatcgtttccaagaaccagcaatttttcctttatcttttttactattattttttgtttgtttcaatttcatttaatcctgccctgatctttgttatttcttttcttctgttgggtttgggtttgatttgttcttgtttctctagttcctcgaggtgtgactatagattttccatttgtgttcttttagactttttgatgtaggcattcgatgctatgaactttcctcttagcactccttttgctgtatcctagaggttttgataggttctgtcactattattgttcagttcaaagcattttttcaattctatgttgatttcattgctgaccccatgatcattcaggagcaagttatttaattttcatgtatttgcctggttttgagatttccttttggagtttatttccaattttattccactgcagtctgagatagtacttgatataatttcaattttttaaaatttatttagacttgttttgtggcctatcatatggtctatcttggagaatgagccatgtgcttatgattagaatgtatattctgcagttgtatagaatgttctgtaaatatctgttaaatcaatttgttctagagtatagtttaagtccattgtttgtttactttctgccttgatgatctatctttctgccttgatgatctgtctagtgctatcaatggaatattgaagtttcccactattattgtgttgctgtcgattagaaattgttctataaatttgggagttccagtgtgttaggtgcatatttatttaggattgtgatattttcctgttggactagtccttttatcattatataatgtctctctttgtcattttcaactgttgttgctttaatgtctgttttgtttgatataagagtagctactctttcttgattttggtgtccatttgcatggaatacttttttctgcccctttatcttaagtttatgtgagcccttatgtgttcggcaagtctccgctgaagacagcggatacttgattgaggaattcttatccattccgtcactctgtatctttcaagttgagcatttagaccatttacagtcaatgttagtattgagaattaaggtactattatatgaattgtgctagttgtttcctgaatacctttttttttaaattatgtcatgtttttataggtcctgtgagatttatactttaaggaggttttattttggtgtattttgagaatttgtttcaagatttagagctccttttaacagttcttgtagtgctggctaggtagtggtgaattctctttttcttttcttttcttttttttttttttttttttgacagagtttcactcttcttgtccaggctggaatacaatggcatgatctcagctcactgcaacctctgcctcccggattcaggtgattctcctgcctcaccctcctgagtagctggggttacaggcatgtggcaccatgcctggctaatttttttgtatttttagtagagacaggtttcaccatgttggtcaggctggtctcgaactcctgatctcaggtggtccacccaccactgcctcccaaagtgctggaattacaggcataagccactgcgaccggcccatgactgtatctttccttcatttatgaagcttagtttattctggatataaaattctttgctgatcattgttttgtttaaggaggctaaagataggaccacaataaacactagcttataatgtttctgcttagaaatctgctattaatcttctaggttttcctttatagtttacctgatacttttgcctcacagctcttaagattctttcttcatcttgactttagataacctgatgactatgtgcctaagcaatgatctttttgtgatgaatttcccaggtattctttgagcttcttgtatttggatgtctagatctctagaaaggccagggaagtatttctcaattattccctcaaatatgctttccaaacttttagatttcttttcttccttgggaacaccaattatgcttgggtttggtcatttaacataatcccaaacttcttggaggctttgttcatttttttaaattcttttttctttgtctttggcatattgggttactttgaaagccttgtctttgagctctcaagttatttcttctatttgtacaattctattgcggagattttccagtatattttgcatttctctaagtgtgtccttcatttccagaatttgtgattgttttttatttatggtatctattcttctggagatttttcggtccatatcctctatcttttaaatttctttaagttggtattcacctttctcttgtgcctctttgagtaacttaataatccaccttctgaattatgattattattttttttggcaattcagagacttcttcttggtttggatccattgcttgtgaacttgtgtgatctttcagttgtgtaaaataaccttcttttgtcatattaacataattgtttttccggttccttctcatttgggtagactatgtcaaagggaagatctaggactcaagggctgttgttcagattcttttgtcccacagggtgccctcttgatgtggtactctccccatccccctagggatgtagctgtctgagagctgaactgcagtgattatttatcttgtgggtctagcctcccagtgaagctacagggctctgggctggtactggggagtatctgcaaagagtcctatgatatgatccatcttcaggtctctaagcatggataccagcacctgctctggtggaggtagcagggagtacagtggactctgtgagggcctttgggtgtagttttgtttagtgtgctagttttgtgttggttggtctccagccaggaggtggtactttcaagaaagcaccagctgtggtagcatagggaggatataagcttgccctagggtctcctggataagtatttgggtttctcagacagtgggcaaggctgtagagctcccaagagattatgttctttatgtttggttaccagggtgggtagagaaagaccatcacgtggaggcaggtttccgtatgtctgttctcaggctctttttgggtggggcttgctgcggctgctgtaggggaggggttgtgtttctcaggagttatgttctgagggggattatggatgcttctgctgcatcatacaggtcacaagggaagtgggataaagccagcagtgacaggcctcacccagctcccacacagcctgaatagctggtctcactgccactgtgctcgctcctccaacagcaccaagtttatttccaggcagctgctaagcagggctgagaatttgccctggtctacaagcctccctgctgagaagcaagcgtggctttcaggtttcatgcctccctttttgccgtggtttctgtactcatatctgtaccctctattcaccctctactcaggattctgtctaggaaactttgtgttcagtcaaaactgttacaaagttgagctgcaagtttctttctccctctggtcttcctccaattccactggcaggcctccccagggacccctatgagacaagtcaggaatggcttccctggggacggagagtgtccacagagctctttccactgcttcctctacccttatatttcgctcaggtctctaaattcatctcagctccaggtaaggtccaatccttctcccatgatctaaaccttcaggctttgcagtgaagatgtgtgttcgagatagactttcccctttcaaacttgggcattcgtggttttttggctgtctcatggagcctgcagtgggaagccacttcctcgaaaggatctgtggattctctcggctttcctgatatgttcctgcagtagttcttggaacaatagtttacgatgtgagtctatacagcccataaggagacttaaacattctaaggaatttgacagtttggaatcattgacagattagaagccagagagtgacacaatcagacctctgtgtagaaagattattcctggttgagttgggcagattacaaggtcaagagatcgagaccatcctggccaacatggtgaaaccctgtctctactaaaaatacaaaaattagctgggcatggtggcatgtgcctgcagtctcagctacttgggaggctgaggcaggagaattacttgaacccaggaggtggaggttgcagtgagctgagatcgcgccactgcactctggcctggcaacagtgcgagactccttctcaaaaaaaaaaaaaaaaaaaaaaaaaagaaagaaaaagattattcttgtggcaaagtaaaggattgagattggctgaatataatgaaaaaattgcagaataaaagttctgtcagtgtgtgtgcatgcgtgtgtgttccattttaaaaaattcttattaggaaacaaatatttcatgtatataatcattaagtgactttggacattttgatttctgtctttgcccatagaattataattatctcttcagaagatagtgcttttttgacattagaaagactttttaaaaatgtgagctaacttgatgacccgtaaaagtaagaacaagatcgtgtcctttgcagggacatggctggagttggaggccattatccttagcaaactaacacaggaacagaaaaccaaatacctcatgttttcacttatacatgggggctaaatgatgaggacgcatggacacatagagggaaacaacatacactggggcctattggagggtcggaggaaggagatgatcagaaaagtaactaacgagtcctaggcttaatacctgggtgacaaaataatgtgtacaacaaacccctaagacacaagtttacctatataacaaacctgcacatgtacccatgaacttgaaataaaagttaaaaaaaagtaggttctttggcaaagtagaatatactctctctctcttttttttttttttttttttggttcagaattgccttttgctcaatgtgtcaggaaaatccttctgggattttcatagcatggtgggctatcacctcaatagtgctctgaaggaaacctgctagaacagaaaatttgaaatgcctttcaaaaggggatggcttttcataactaaatgtgacatcacaaactggttttttatcttcatattcccaaggtagcaatgtcaaaaatatttttttttcaaagtctctatctggaaagcaagaacacaattatcaggtaggataggagctgtaaattacatattgaaaatctctcagaacatgagttttatttcagaggaaatttataatatctggctttattgacatttcaacaatgcgtattttagtttcatggctacagtatttaactaagatattttattctaatacctcagaaaacagcattaacactttagttttaaaaataagatttttttaatgaacaaataataatggtatatacttatgagatataatatgacatttttatctatgtatacattgaagaaagagtcaaccaagctaataatgtgtccattatcacgctaactgatctctttttgtgatgaaaatatttaaaatatgttattctagcaactttgaaatatacatttttattaaccatggtctctcccactgagtgtgagctaaacttattgactcactcctaacaaaatatagcagaagttatggtatgttacttctgaggctaagttattaaaatattgtgacttctgacttagttgatttatctccatgcagtgcaatatatttaccttactcctccagtcaaactgagagtttgtactcttgattaacagcttctctttcctcagccctctccattccccactcctcagcaactggtaatcacttttctagactctgtttcaattagatcagcatttttaggttctgcatatgagatcattgatatggtttggctctgtgttcccacccaaatctcatctcaaattgtaatccccacatgttgagggagggacctggtgggaggtgattggatcatggggacagtttcccccatgctgttctcctgatagtgagtgatttctcatgaggtatgatggtttaaaagtgtggtacttccctcctcttgctctcctgctgccatgtaagatgtgtcttgcttccccttagccttctgacatgattgtaattttcctgaacacccccccgccccccgcagtgccatgcagaaatatacttcaattaaatgtctttcctttacaaattacccagtatcaggtagttctttatagcagtgtgaaaacagactaataattggtactggagtttggggcactgctctaaagacacctgaaaatatggaggcaactttggaactgggtaatgggcagaggtcggaacagtttggagggttcagaagaacacagggagatgtgggaaagtttggaacttcccagagacgtatcggatggttttgaccaaaatgataatagtgaaatggacaatgacatccaggctgaggtggtctcagatggagatgaggaagttattgggcactgcggtaaaggtcacacttgctatgttttagcaaagagactggcagcattttgcctcagccttgaatatctgtggaactttgaacttgagagagatgatttagggtatctggcagaagaaatttctttttcttttttaattttaagttctggaatacatgcgtaggacgtgcaggtttgttacataggtatatatgtaccatagtggtttgctgcaactatcaacccgtcatctaggttttaagccccacatgccttaggtatttgtcctattgctgtccctccccttgccccctaccccccgacaggccccagtgtgtgatgtccccctccctgtgtccatgtgttctcattgttttactcccacttacgagtgggaacgtgcagtgtttggttttctgttcctgtgttagtttgctaagaatgatggcttccagcttcatccatgtccctgcaaaggacatgaactcattcttttttatggctgcatagtattccatggtgtatatgtgccacagtttctttatccagtctatcactgatggacattttggttggttccaagtcttttctattgtaaatagtgcttcaataaacatacatgtgcatatgtctttatagtagaatgatttataatcttttgggtatatacccagcaatgggattgccgggtcaaatggtatttcttgttctagatacttgaggaattgctacactgtcttccaaaatggttgaactaatttacactcccaccaacagtgtaaaagcgttcctattctcctcagcctcggcagcatctgttgtttcctgacttcttaataattgccattctaactggagtgagatggtatctcactgtggttttaatttgcatttctgtaatgaccagtgataatgaggttttttttcatatgtttgttggctgcataaatgtcttcttttgagaagtttctgttcatatcctttgcccacttttggatggagttttttgttttttttttcttgtaaacttgtttaaaagttccttgtagattctggatattagacctttgtcaaacgggtagattgcaaaaaaaattctcccattctgcaggttgccttttcactctgatgatagtttcttttgctgtgtggaagctctctagtttaattagagccttgtcaattttggcttttgttgccattgcttttggtgttttggtcatgaagtcttttcccatgcctatgttctgaatggtattgtctaggttttattctagggtttttatggtttggggttttacatttaagtctttaatccatcttgagttaatttttgtataaggtgtaaggaaggggtccagtttcagttttctgcatatggctagccaggtttcccagcaccatttattaaataggtaagcagcaaagtgtttaagatttcacctggctttctctgaatgtatacagtcatatgaattcacaaagagatggtgtgaaactgagacttatgtttaaaaggggagcagagcataaaagttgggaaaatttgcagcctgaccatgtggtagaaaagaaaataccatttttctggggagaaattcaagccagctgaagaaatttgcatgaatcaagagaagccgaatgttaatagccaagacaatggggaaagtgtctcccaggcatttcagaggtcttcacagcagcccctcccatcacaagcccagaggcctaggtggaaaaaatgttttcctcagctgggtgcctcactgctctgtgcagtcttgggacatggtgctctgtgtcccagtcactccagctacagccatggcttatagggggctaaggtacagctcaggcctttgcttcagatgcaagccccaagccttggtggggggttgtatcttggaagtagctaacttgttttttattttacaggctcataggcagcagcaaggacttcccttgtctcagatgagaatttggacttgtactttcgagttaatgaataagttaagactttaagggactgctgagaaggcatgatcagtttgaaatgtgcgaaggacatgagatttgggagaggtcaggggcagaataatatggtttggttctgtgtacccacccaaatctcttgaattgtaatccccaagtgttgggggaggggcctggtgtgaggtgattggatcactggagcagtttcccccatggtatcctcgtgagagtaagttctcatgagatctgatggtttaaaagtgtgacacattctccatctcactctctgtctcctgccaccacataagacatgccttgcttccccttagccttctgatgtaattgcaggtttcctgaggcctccccagccatgtagaactgtgagtcaattaaacctctttagtttataaattacccagtctcaggtagttctatatagcagtatggaaatggactaatacaattgtatactgtgcctggcttatttcacttagcataatgtcctccagtttcatccatgtcattgtaaatgacaaactttttctctattattaatcctggatagtactccattgtataaatataccacatgttctttatccattcatccattgatggacaattaggttgattccataacttggctattgtgaaaaatgctgaaataaacatgacataaacatgaaataaaaatgcacacatctcttcagcatattgactttaatacctttggatatataccctgaagtgggattgctccatgatatggtaattctattttgaattttttgaggaatgcccataccattttccaaagtgtctgcgctattttacattcccactaacagtgtgcaagggttcccttttctccacatcctcacaaacacttgttattacttgtgctttttatcatagccattctaacagttgtgaggtgatatctcatggttttaattttcatttctctgatgactagagatgttgagcattttttcatatatctgttgatcatgtctatctcttcttttgagaaacgtctgctcagatagtttgccaattttctaattggtttttgttttcttgccgttgcgctgagttccttatgtattttagatattacctctttctcagatgtgtaatctgcatatattttctcccagtccatgagttttctcttcactttgttaattgcttactttgttgtatagagctttttggtttgatacaattccctttgtctatttttgcttttctttcctgtgcttttggggtcttatccaaaacatacttgctcagtccaatgtcataaagaattttccctggtttcttctagtggctttacagtttcaagtggtacataaatttttaaaaaaattttgtaaagattttgttttaaaaattactaatatacagcctccaagatatatctccaatgaccccatcctcctagcattaattttcatgtgttataatctcctgttgtgtgtgggctggacttattgtttcacttctaacaaataaaatatggtatacattatggtatatcgcttctgagattaagttatttaaatactatgacttctgacttagttgatttatctcattgtcttggatcagtcaccctcagggaagccagttgccctgttgtgatttagccctgcagaaaggtttatagtttcaaacaattaagtactgccaacaatcacatgagtgagcttacaaatatcttaggctctttccctgatcaaacattcagctaagactcccaatcccagctaacagcttgactgcaaccccatggaatagttgaatcataagcacccagttgttgccagatttttgggccacagaaactttaagatgtttgtttactcaacctgttaaattttggaataatttgttacatagcagtagacaactaaaacattgatcttaaggtggttgtcaattattttactttcattttcttaaactgccattttctctccatcacatatagagagagtgggacacactggttcatacttaaatttgattgtgaaagatattaaataagatttagaaaatctttcttacaacattgtaataaacaataaataaaatcacattttaataagaaaataacagtaaaataacattgacagaaactcaaaaatatcttgttctctaccgtatttctatgacaaaggcaagtctattcatgaatcatattcttggcctctccttgtctcatgtgaaagggaatgttagtgctcactgataaccatcttcacttttacatttttaagtctcctttgcaattagattggccatgtgcctggttctggccattagaatgtgagtggaagttataaatgtcacatacaggccaaagttgatgggactggtgtggctcgtccgcatactgctgcaacctcccactggctatatgatgccagggaaaccgcaagccccaggatagaagcagcttgagctcctacgtaactgcttatcagaaaactttctagcttgcaattaactggtctgagagcagatcatatttgttagcaacattgcctctcctatcttgactaatccacccctgtcccatccttcactccaatctcttaagtataaaggatcttttgttattctagcaaataaattgtcttagcatttgttgcaactgataggggcaatgtgcttgagctattaaattgtggccggtaaagaaaacctagaattacctggagttattttcttaagagtggaaggtctaaaataggaaagaaggcagagaagacacaaaggagaaaaacagatgtagattgcttggttggttgcttggttttggtttagttaggattatttgcttttcttgtgcaaaacaaaaggagaatagtgaacattaaacattgattagtgatactcaggacagttgtgtgaagatttttagaacatagttctgaatggtatgcaacataattccctatcacttcttttagggcttcagttaatattctctttgttttccggtattcctttagatagcaaagtaatatagcttttgaattagaaaataatttggttacactattactgttttattgatgacccactgtgattcaaagataatgctaggagttgcataatcaaaactaaacaagacagatgtagtttttgaaacagacatgccctcatcctctagaagtttatagtctagaggaagacaaaaattaaataattacagtaaagtgtgataagtgctatgataagtgaaaaagatactaaggaaacataaaggttgggctggcaggcaggacttctaaggggaaatgacaggtaagctggaaccagatatgtatgtaggagctttccaggcaaagcgtgaagggagtagggtagacagctcaggggaaatgtttgtgcctggtgcacaggagctcttcatggaacaattattttaatttcttcctgcagactatccatagggctcaatctagagtccatggatccaggataagacataaatgcagatttttatgctatcctttttgggaacttgtccctcttcaaaatttccaggcaaatatatcttcagaaagccctcttgagtgtatataattcaactgactcattcaaagagacaccaaatagtacctaccctaccacctcctgagacatttttaaattcccatagtgggctaaatgtagcttcaaactggtactatcccacacatgaagtatttgttcataacataccatgtaatctgaatacatgtaaatcaagaggatgatacgcttcagtcaagagaagccgaatgttaatagctaagacaatggggaaagtgtctccagggcatttcagagatcttcaccgcagcccctcccgtcacaggccaggaggcctaggaggaacaaaatagtttcctgggctgggcccagggccctgatagtttcatattaaaccatcacaatagagttgatagtttaatattttattatatcaatatattctgatttatttaaccattcttctgtttggatacctttaaattgttgctgaaatttcccaattatagtgaatatgttaatgaatgccttcagacatctattttgtgtaactttattttctcacacaaagccctaataatgaaattactagattgctcaagcttcaaggccccatggaaggagtatgactaagattgttgtacaatttctccttggccagattacctcacgtatctgagcatttatttcattatctgtaaaatgggaagaaaagtagaacttatctcatagggttgtatcaaaattgagttaatgtcggtaaagcacgtagaacagagtcttacgtgtagaaaacactactgcaaaaagaatgctgtttagatggccggaacgcaagctagaaatcagtggtagagttaattgcagttgtccagatgacagataatggtaggttgggctcacatcctagtggtgagaatagtgagaaatttatggactcaagaaatatctcatttgtagaattgagaatgtttgttcatgagttaacatgcaggggagtggtgggaaaagaagagtcaggatgactaaggattttggacagatcaatggaaaggatgcagttgcaaattctgaagtaggaaagattgagaaaggagcagatttgaagggaaaatcaggaacttggtttgaatattttatgtttgagatacctattggatgttcaagcagaggtgttaactaggctattgggtatactagcttggtgtttaggagaacaactggcaagattataaatgtgggagtctttcaactatagattattcttaaagccatgcaattggacaagatcaccaaaggagcaagtgtagataaaaaagcaaagaggtccagggagtgagctctgggcccttcaaacacttattgtgcaggcatatgaggagaagccagcaaaggacactgaggaggaactggtgagataggaaaagagccaggtaaacttagtgtcacagaaaccttggaaagcaaattaacgtcgcactttgaggcttgactatgaatgccttggaggagattgtaggctctcaagttaggggaagtcattgacactgataggtggttgttggaagtatggactctaaagtcagcagaattggatttgaatccaggctctaccagtcaccagatgtattattaataccttaagcaagacactaaacatctgtctacttcattttttctcatgcaattaagcagacatagtgacagtacataacacagaatgtagttttgaagattaatgacataattcatgcagagcagagcacttactataacacaagatgcagagtaagcacttaagaaacattgacacttgctattttactaacagtcattgttattatcagtataatcccttttattatgcagttgaataaaattatctgtgaacaaatcattagtgaatagtgaacaaaatcatttgttacattttaaacatagtgcctggtgtatgacaggttatcaagaaacagtttgtatgtatgtgtatgtgcacaagcacacatgtaggtactcttgtaaaattcttgaggtaatttctgggtcagtagtgattatgtaataattatggttatagctgacaatgcagtcatgtgttatccatgattctaatcaactaatatgtaaaaacagattaataggcttaattactcttaggaactcattactgccccttttcatagataaagaaactaaagcaaagagaagttaaatttcttgcccaattttgtattgctagcaagacttaaatcccaccttctggctctagcaccatactcttaccccctacattgtagtatccctcaatagtaatgtcagtgttcataacaagctataaatatccaaaaaaacaatgggtaaactttcagaaatgggaggtggttgtgactatggcaggaagcttgcttatcatggtaacagtgtctttggggaccatctctgtgttttcccgcccagtaaattctctcttcttgatgtgtgttgaccattaacacaagcctgtgctgagatctcagaccttgtaagaaatgaatctttgtcttaacatgaaaagtagtgctctgctcattgcttctattctttactcaatttttcagtgagatttgttttcttgcttactacagatctcagatttccaaccatctgcttgtatttttacagtaagtcacctaacagtctccagaaacaataagacatgtttcatcacctcctgcctgaaatcttcagaataagtgatgtcttgtcttttattcattgtttcgtattttgaatttcttctaatgttttgattgtagtttgctgagccatgttttactgaattagtattatttcactgatataatttatgctgtttcgtatatgtccagaaaaagatggatattttttctgtgctcataataaacctttttacaaagtaaaagtacacattttgaagtctttgcagtacacttttccaaatcagaagaaaaataaatcctcagaccttcattatatgtgtacaactcttcagaaacagttcataatgaataatccaaaaaagttgccagttatgtcctttgtttctctattatattggaataataatgaggtcatggcaaattagaaggaagtgaataactattcaaagatgtattgaagaagaaactatatttaacatatactaaatatacactaccttctgccctttgaaatgttggataatttagttcacatctaaacacctttatggaaatttcttttataatccatatattaaaccaaatatatgtcatgtttttctatttcctaaacaagacaaaacacagtacaacaaaatccttattgtttcactgacagtttgcaatgactttatatttatagctactgagagttttatacaaaatattctttgatgcataccacagtctgtggttgtggaaagaactcaagagtaggatgagagacaattgggttttgattctgacttttcctctaactgagtgggtacttgaggcaactgcctttgcttcccacggccttctcatctggaaaagggagcaaaaattaaactagattaatggcttttaaattgttgtttgatagtgcggcctcttttaaacagtggatacttacattataaataactgaaattgaagtccctatggtaatagaatgatgaaaggaaagaatcacgggaattacaggaatccattttaggagtagaaatcaaattctactttttatatgaggtagatgaagccagaaagtatagtgcaaaggctctggattttaccagttccctttggtttggaatattctctgtccagtgccattttgtcccaacaaggaatctggagtggggctgggttgactgatgcacttgaaattacaccatcagggaaagaggtgacatttaagctaagactgaaatcactaggagtcactccgtggatttctgaggggagaaccttccaggcagagatccagcacttacacccagatccaaggatgtgaataactgtgttatgtttcatgaagagcaagaaagtctgtgtagctggaaaagagtaaccaagttagagaagggtgggtgatgagatgggatagatgacaacacactgaatctcatagcagcttatagtctactttcaggcttttgtgatttattctaagtttacctataagtcattggagggttttagacacagaactactttgagcttattgccctttttaaaaggtcactttgaactgagcatgaatgtatgcctgtagtcccagctactcagtaggctgatgtgggagggttgcttcagcccaggagttcaagggtgagcctgggcaacataaagagaccttgtctcttaaaaacaacaacaacaaaaaatccctcttcctgctatataaagaatagacttctggccaggcgcagtggctcacgcctgtaatcccagcactttgggaggctgatgtgggcggatcacctcaggttgggagttcaaggccagtctgaccagcatggagaaatcccgtctctacccaaaatacaaaattagtcaggcatggtggcacatacctgtaatcccagctactagggaggctgaggcaggagaatcacttgaacccaggaggtggaggttgtggtgagccaagagcgcgccattgcaacaagagcgaaacttcgtctcaaaaaaaaaagaatagactgcttcagggtgggggtaggggacgatagaaacaaggagaccagttgaaaaggctactgccatggtcctgatagtcaggaggtaatttttccatccacgattcctgcatactatatttcttatgggctggcagaggctgtgaacacacgtggaataagttgagagttgccctctctgcatctctggaagaaatgtgactatcattactgataagctactcctttggtaaccgaaggcctgccaggagctgtttcttagtccaatcacagccgtgtcctactttgcattatcatatcgacacctaattcaggccagtgaaagcagaatggaaaaaataaaccaaaaagaaatctgtcaccgtgtacaaccctactcaaaccacctaactatcctgaatcacactctctaactaccctatctcctgtcatatttattatgtgaattcaaagtcagctcaggaacatctctgttgatttgcttttgttaacttggcttgatcttgctgtgagtatccctgaactctctgtaaaagttactcattcctaaatgtgtgctcctcctagaagaaggtcgcaaccagaccgtgctcaagccttagcacttttagagcacaacagagaggcaggtcccagtgaatgctacacaggcttcccttggctaaaggagggagttccccgaccccttgcacttcctgggtgaggcgacgccccaccctgcttctgctcaccctctgtgagccgcacccactgtctaaccagtcccaatgagatgaacctggtacctcagttggaaatgcagaaaccacccaccttctgccttgatctcgctgggagctgcagaccggagctgttcctatttggccatcttgcccaggaatcccatgaaatctttatttagatgatatgcgatgacatcatttggctttcatttggcaagaaggcatcaacaaagcatcaattctgccttattcctctgctctactatttgggctattacagttaaagttggtgccaatgacataatgaccacaaacccacacaggagggctgacataatatggccatacctaggtataagattatatagataataagtagtggagtataattacatggcatgcttaaattatttattcatagataaccatagaaataaacacacacacaaacacaaacacacatacacacacaatcttacagcacattttgaggcccatgagaataaaatgtgagagtgtaattttataaatctgatattatacagttgacaattatgcctgtaagacatagtgttattaaatttcatccttgcagaatgtcatagaatttcaggtctgtgacactttaggaaatcagagtgttagggtagaattgcttaacaaaataacattgtaagcactgtacgttatttgttatgttcaagcactgtgataatggtccatattttggagtgctagtcttggcctcagtcccgattgtcacattaaacaaatgaacttctggagcttcagtgtttcttttctgtgaaataaggaccttaaactcttttctgccatacttgagagagaatatagaagccagttgaaacagtagatgtgaaacggctttgcaagtcataaaggactgtgtacatgtgaggcctcattatttctttaccttattgataaaatttttcttggaaatagaaacaagcaatgaaaaaaaaggtttcaatcttggttttgccagttatccaacatctgagatgatcaacaagaggactggagtttactcagtactaatatttagcatcaccttcttcaaagggtaagtaaactttacactggaatgaagtttattttgtttctatccacttgagtttgctaaaatatacataggagaatttgccaaatggctacctagccctgaggttttaagttttgctctgaaaggctcttataaccatattgactttgaaataacaaatgagagaaggtaacaaggaaaaggataaataattctctaaccaccatcatcaacattgctttattaaaaacttttaatatccctatatttgagaggttttgtgtgttagtgaattctgctcagtccaaatgattcgggctggtatccacatatattaatttttcccggaagcatttcagaaatttaatgaagctggcgggttgtgtccccttcgtgatatttcttgaatataattccatttgcaaaagttaaaggcaagttgaaaattatcttggcacaatacaatgaatcaaaatatttttgtctaaatgctagtttttaacgtacctaataaaaatggttgtactcctactcttgtttcctaaaatactccatactctctgtgtctcttcctagaacttccacaaattaatacattgacttgaatagttcccttcttcacattaccacccctccaatctttatatagcaaaattatccttattctctacattaaggtagatagatataccctctttcaattagctttcaacagcacttctgattttacccaatgagtggttatgtattctttcatgtgtttctttctattcatatatttctttatttttctccatccatgggtaaatgtaaaatacaaagtatcattcatccttgtatccagcatgtctagcactgcattctggtgtttagaaagtatgcgatgtataagtaattaaaataaatgtattataatgtctagagatgatcttaaaactatggcttggaaaataattatgtatcccctgaaaagcaaaaaggaaataagaaaggcccataatcttaatctcccttggcctttactagcactataaaatatctattcttgatcattgtttacatagccccattacaactgagaccattgtctaccttggtttatcttaattcagagcaagactataaactttccaaacatgtgagaaaaaaatatgacaagccaaatcataatgtagcctctggtaagtagcttcgtgtctggaatctagtccagaaactattgcttttctccatgaactttatatgttggtggatgatccacatatttgtaactttcaccgaagcacagaaaatttgagttgagagtcgtgatgtttaaagagtctatccccttcccttcttatttgtgtaaattacgttcccatagaaaataattttccggataacacaatgtgaattacagtgggatctctaatcacagccccaatttcctgactgagtccagtgagctttctattttgctgcagattttcgattcccacaatattttcagaaaatgagctagaaaatgaaaagctaatctggattttattctgttttgattaccacctctgtgctgatgattcccaactttacatttccaggactggtttttcctcatagctgtggacctatgtatctagtactctctcaatatcctttcttttcctcaaatttaacatatccttttttaaatctaagatttcccccaccttcaaccctgaccctctcccaccgtttctcatctttgtgaatgatacctatatctatccattgactcaatccagaaaactgagtcatcttttgccatccttctcattcagtcttaacattaaatctgttatcatattatcacaattttacctcttaaatatttcttaaatctatctactgttctctatcttctattatttctgcactattacaagctactcttacgatctcttacaatagttttttaatcccttgtcatgcttctaatttggttcttcagtgatcaattttcttcactacagccagagcgatcttccaaaataaaaatatcacactacatatcctccccaaaccccttcagtagaatctcattctcttaagataaagattgaaagtcttcgtgtagcctggaagctatttgttaccttcctgcttccaaccttgcaacatgccccttctgtttctctaagcttcagttatactaaaaactcaggttcttgactgtactttggcacatgcggttacatctgtctagaactttcttcttttcacctagctcccatttcagtctttccataattaatacctactcactctttagatataattcaactagtttccagggaagacttctctcatctcaatctaggtcaagttctcgagttacaaacacttatctaattattactttttttctttcagagaacttaccttggtttaaaattatccatttatagatgtaattttttgtttcacttgattaaatacaagctctatgaaaagagtagtatggtttattttaccactatttgaatcactagtccttaacacagtgcatggtacttagcctgtgttctgtaaatatattttgagtaaatgaatgtttcaaaaagagttatactgccagcctcctgttcttgctttaggaagataattcaggactagctatgagtgggaaaagtatagtatgttggttaacagcaaggcttctggtgtcaaatatatctgaatcctagtccaagctctgctagtttactgcccctgtgatcttaaatattttgagtctcagtattctcacatagaaaataagaatagcaatactaacctcgcagagttattgcgaggattaaatgacataatgcaccattttgagttgaattctttcctcctaaaaatgtttatgttgatgttctaacccccagaacctcagaacatgactgtatttggagatattgtctttacagagataatcacgttaaaatgaggtctttagtgtgggccctaatccagtacaactggtgcccttataaaaagtgtaaatttggacacagatatgcatagagggaagatgacataaggagacacaggttgaagaggaccatctacaagccaaggagacctagaacagatccttttctctcagccctcagacgaactctatcctgctgacaccttgatcttggaaatccagccgctagttaaggagacaataaatttttgttgtttgagccacccaatttgtggaagtttgttacagaaagttctagtaaactaatacatgtatgttaagcttatggtatggtgttgttggcaaatgggtccaattggtttgaaagtgatctttacagtgaagcctttcctgaccttccttcttagagatacaatctcatattctgtcagtctgccacctccttccctgctttatttttcttcattgcatttatcaacatttatgtacaacctcttttacttcttttttgtttgttttcttagctccctcaatgtaatctccatgaggcagatatttgtgtctgtttcattcattgtatcatagacaaggatgccttggcacatagtaggcatttgataaatatacattaagtaattgatagctatcactgctgttgttgctgttaaaaataaattgtcttccactaccccatccctaaatacatacattttattcattcagctttctaagtaccagtcacttggccaggtgctaggcacacagagataaatagatacagtatctctttacaaggggattaatttcagtaaatggagaaagatacataaacaaatcaatgttccaaagatgtttctttgcctttaaaagagtctgtccaaggtagaatggtggcatattaacccttgaggatccttcaaaaagtgagtggttgtcttctgacgctcacgacttcatgctctatttattttattttaaactgtccacaaactagattaatagattttaagttcccacattgaagggatccttgttgcctctacactgctttcagtgttatgtttctagtcttacaagtgttcatagtattctcttctctaccactagcttttggtttgcacagagaaagctatagtgaaaagtcagtcacagaaaatagcaataattatattttcgtatacgtgaatatagaccttaatcacataagagagtactattatagagcccagacaataacagattgagcttcagagggttctggttcagaatctttgcttctctgcttcctagctgtgccactaagtcccaattttcttatctataaagtatagttataatatctgcccaattactttcatggtagttgtttttattggtagttgttttattgggggtctacagaatgttagagctgataaagaagtcatctagtcatactcctcattttgcaaatgaggaaattgagattcagagtgatgaaacatatttaccctggacgtacagctaatgagtttggaatttagtcacacatttcttcaaacactccaatgactgtccatgctctaccaacaattcaaatggcaataagaagcaggtttagatatttttaaaaatcctatctaagactgagttgaaagtgcctcttggtaactggtaagaaaaccacaaaacagtaaatctgccttttttagtctacaatgattgaatgtttatactgagccaagttttgaaaggtttaatttggtttcaggccaataacatgacttacaaatactaaaattaatccccaaatttacagattggatagatcaaaacaagggattttttttaaaagtctttgtcccttattgctcatatttaaatgacaaattcccttgtatcccaaaggaggatttagctgaaagaaaggtattccctattcgtaacagggaatatgttctattcataaaacaatgtttgaaattgaattaaaataatttaattacactatataattaccttccacaatctttacagtcaagaggcccatgggatctggctatttgtagagatgtttaatccgattttactttagtattcattaaacaatggtaatttcttcgtaattcccctctgacacatattatgcttctgaagaagaaaagaccttaaacagagtcatttctttaaacagagctgctgagtatgtcaaattattcaggcaaggactcactgaacaaccaaaacaatagtttcaaacagatgacactgtgtttcaagaaccaaaaaaaatgttaaataaactattggcgcatgaaataagctaccaatgggaagtcttagtgagctgcaaatgcatgcctaactgagatttcaacattatttccaagtttggcaatcagttgaaaagccctttatgcaaatctatgcccaactaaaggaaagaaaagtagaggtgactatttgagagatgcatattcagttttgaaaaacatagttcacaatttcaaaacctcttagtatccaacagattcacatgagtagtaatgttttttcttttagatctattgcccctagccactgaaactgtactttggttaggtgcctaatctagctccttctttagctacaaaacctagatagaccaggtcagaggaaatctgaaggagaacattctaggaagatgacagccataatagagtgtgtgtgtgtttgttgtgtctgtgaacaaggaatcgtttcacaaggcagggtaacttggacacgaatatttgaaactcacaaacaaaatctataataaaatcaggtgacaggacttaccatgaaacccaaaataagagtgggtgggaagagccatctcatgaagaaacatttgataaggcaaactctgcaggagtaagcagaaaaatgtccctgatcaccaaagggtagtcattacaatgctgaactcagtaaactaattaatactgaccaggagctacattggctccaattcacaggtgagagtgcaaagggaccatagaaagatcttattgtgctagagtgatataagccctatgaaatctcaaaaataagcaatcaatatgttcactaacaacaataacaaaaagctacacactgagaaggaacttctggaagtagaatccaaattgaataggacagagattatagtgacaaagaaaacagtatatccaatccaagagggaaagaggaacagagtcagcagttatcagaaaggatgggtttacatctaatgtttttctatttgttttacatgtatcttatgcctgttcattctcattccagtactgccttatttcatatttattttttgcagtatgccatttttattctcattcctttgtgcataattttagatactttatttgtggttaccttggagattaatgttaacattctaagttgataaagacataactggcattgatattaacttagcttcaatagctacaaaatatactttcatacacctcaatccttcctttcccttcatactgtggttgtcgcgaattacatcattacatattgtgtacccactgacatggatttataattatttgtatgcattgtattttaaatcacttggggaatacaaagagttatgaaccaaaaaatacgatagtattggcttttatatttacccattagttaccttttgctacagttttacattttttcctataacttcaaatttctctttagtgtaggctaaaaaacactccttttagcatttcttatagggcagctctactagcaattaccttcctcatcttttgcttatctgggaatgccttcgtttcttcatttttgaaggacagttttgtggaacaaagaatttctggttcagaggttcattttttttttctttttcagcactttaaaaatgtccttttcattgttcaattcccacctatgagtgagaacatgcggtgtttggttttttgtccttgtgatagtttgctcagaatgatggtttccagcttcatccatgtccctacaaaggacatgaactcatccttttttatggctgcctagtattccatggtgtatatgtgccacattttcttaatccagtctatcattgttggacatttgggttttgtgcacatgtaccctaaaacttaaagtataataaaaaaaaaatgtccttttactgccttctggtctccattgtttctgataagaaatctgctgttaatattattgaggatggtttgtaagtggtaaattgcttctctcttacagatgtcaagatcttttttgagcatagcctttgacactttttaaagtaactttttagttttgggggggttacactgtaggtatatatatttgtggggtacatgagatgttttgatataggcatgcaacgcatgataatcacactatggaaaatggggtatccatcccctcaagcgtttctcaagcgtctatcattgatgttacaaataatccaattatattcttttagttattttaaaatgtacaattaaaatattattgactatggacaccctgttgtgttatcaaatactaggccccgttcattccttctaactattttttgtacccattaaccattcccgcctccccgccatacccctttgattataatgtgtcttgttgtagatctcataatgtttatccttgttggagttcattaagtttcttgagtgtgtggccttttatacaattttgcaattttctcactaaaatattttaaagtattctttcttcttctatttgtctctcctctcttacctggattcctattgtgcatgtaagagtgtgcttgatgatgtaccaaaggtctttcagcctttgtttatttctctttattcatttctttttaatgtctgtgcctcagactgaacaaagtcaattgtcgaatcacatatttcactgtttctttattctccatactcaaatctgttgttgaaaccttcctgtgattttccacttcagttatagaacttttaagctccagaatatattttgatttatttgtataatttctatcttattaatattctctgtttgctcatacagcatctgcctggtggtttcctttagctctttgtacatagtttagtttagctaattcagcatatttaagacagctgacttgaaatatttgccacatacgtcaaatgggtgtgcttcctcaagaacagtttctattcattcttctgcaaatgggccacactttcttgcatcttagtaggcttcataaagatttgttgaagagcaagcatttttaatatcataatgttgtatgtgtgtaaatcagatcctctatttatttatttatttatttattgctttttgtagactgtagctgactatttagaaatattctaaaatgtcttcgtgaagtctgcatgttttattactcatgatttccaaagtctctgttcctttgtcttaaattcaactagtattttgatggagatttcactgaataccagaaaggaaagatacacacacacacacacacacaccccaaaacagatgaaaggctgtacagattggctctgtgtaggggcaacctctcaggacattcacaactttgctatagccttcccttctttgaatccagcctagaaatcagccagaggtgaaagcctagagtcttctcgggtttattgtgacaatgcttcctgtgctggacgtgggcatggctttctcaatttcctggcttacgtgggtgtttttcagtgccccaatatctgcaaaaacattatctccacagattttcctcccaggcttttggtgctcaggaatagtttttaaccaaggcagctgcagattgttcatttccctcacagtatttttgagaaatgaccactgattttctgccctgaaggaggtcttaatttggcagaacaaattagtctggaaggagaggagagacaaaaaagagaagacagaatgtttaaaaagataatcgtgagaaacctcaagataatgacttagctgagcagaaggacagggcaaggcaaaattagaacgctaaaaatatttcccactgttttaaaagtggctttttaaattgattcagcacatgcttggttggtctaaatctttgattattttccaaagttgtgacaaagttgattctgagggtttttatttaattttctaatgcttttgtaatgggatggccccttggagttgcctactctacctttttcttcatctttccattttttcttttaagaaaaaaagaccatcacttaaacatcagcaacagaaatttagtatggtagaatcacataagatgctatttataagaaaaaaagataatagtgagcagaataatgtccctgtggacaatgaaggcacactaagaaggcatgctcacagaacagataaagtataagcaattttcaaaaaaaaaaatctgtagaaaatatttttaaaacaacataaggtagaattttcaaaagcagatataacatatttaagaaaggaaaattagtaaaagctatcataaagtaattcaaaatgaaaaagaaaactatactagaattgaataattaactggaaataatagaaaagaagtcataaaaatcctttaagaaaaagaaaatatgaaaatgaggatttttttcttttaaaagaaagcaagataaaaacattttcaagaaacagtgatacatatagacaataataacagatattttatgtataagattcttccacatctccacaacaaatggagaaaattaatataaatcaagataaaccagcaaaaattttaaatcgagagattttatataataaattaagatttgaaattattattgaaaagacacatagtttacataggaaaatcaactgaaagtggtcaggaacataatacacactagtaaaaatgagaagacattaagaggaaataaaataatcagatatccaggtagcaagatctctagtaagaacaagaaaattgaactgtcatcaaacttctcaacagtaattgtttataacagacagtaagaaagtaatatatttcttatacttgagaaaagaaaatatgacctgggcactttgtacccaaccaaactgatcttcaatgaaaaaggccaaagtaaactttttatggccatggaagaaatcatagaatattgtttccatgagcccttaaagaacctattagagaaaagctgtaacaaacaaaataaatggaaaggcattgagatgaaaacaagaaatttgtctttggaattatgtaaatggtttacataattaataaatcattaacattttcaaagtttttaaatcaaggtataatttacatatattcaaatgcagagactgtaagtgtatagttagataaatttggggaacgcttgcatttgaataataatcacccacatcaatatataaaaccttcatttttcttccatcttttaggttcagggagttcatgtatgggtttgtgtaaattgcatgtcacgggtgcttggtgtacagattattttgtcacccgggtgataaccatagtacccgataggtcatttttcaaacctcattctcctcccaccctccaccctcaagtaggccctggtgtctattttacccttctttgtgtccatgtgtattcaatgttttcttccaacttaaaagtgagaacatgtagtatttggttttcttctcctacattaattcacttagaataatggtctccggctccatccatgttgctgcaaaagacatgagctcattctcttatatggctgcatagtatttcatggtgtatccgtatcaagttttcattatccaatcaactgttgatggaggtttatgttgattccatgtctttgctcttgtgaatagtgctgcaatgaacatgcatgtgcatatgtctttatggtagaataatcagtatttctttgggtatgtacccagtaattggattgtttggctggatagtagttctgtcttaaattttgtaagaaatctccaaaccgatttccccaggggctgaactagtttacattcccaccatcagtgtctgtgttccctttttcccacaaccttgcccacaacagttatttttggctttttagtaatagcccttctgaatagtgtgagatggtagctcattgtggttttaacttgcattagtctaatgattagtgatgttagatttttttcatatgcttgatgactgcatgcatgtctccatttgagaagtgtctattcatatcctgtgcccattttttaatggattttttttttgcttattaatttaagattcttatagattctggatattagatctttgtcagatgcatagtttccaaatattttcttccattctgtagactgtctgtttgctctgttgatagtttgtttgttttgttttgtttttctgtggagacactcttgaatttaattaggtaccacttgtcaatttttgtttttgttgcaattgcttttggtgtctttgtcatgaaatctttgcagggcctgtgtccagaatagcatgtcctaggttttcttctaaggtttttatagtattaggttttacattgaagtctttaatgcatcttgagttaatttttgtatatgttgaaagtaagtgagccagtttcaatcttctgtacatggctagccagttattctagtgccatttattcaataggaagtcttttccggattgtttgtttttgttaactatgtcgaatatcaaatgtttgtaggtgtgtggctttacttctgtgttcttcaacctattcccttggtctatgtgtctgcttttgtgccagtaccatgtagttttggttattgcagcgttgtactatagtttgaaatcaggtaatttgatgccttcagctttgttctttttgcttaagtttgctttgactattaagccacctttatggttccatatgaattttagcatagtttttaattcttttcattaccatactttaatttctgggatatatatgcagaacatgcagatttgttacatagatatacatgtgtcatggtggcttgctgcacccatcaacctgtcatgtaggttttaagccccgcatgcattaggtatttgtcctaatgctatccctccccttccccccgactccccgacaggccccggtgtatgatgttcccctccttgtgtccatgtgttctcattgttcaactcccacttaggagtgagaacatgaggtgtttgggatagtatttttctaactttgtgaaaagtgtcattagtagttttatagaaaccacattgaatgtataaattgctttgggaagtatggccattttaacaatcttgattcttcctatccatgagcataaaatgtttttccatttatgtcatctctgatatctctcatcagtattttgtaattctcattgtacagatcttttacctctcttattagctgtattcctaggtatttcattccatgtgcgtgtgcctgttgtgaatgttgtgattgggattgcattatgatttttctgtcaccttgtacattattcctgtatagaaatgcaactgatttttgtacatcgattttgtatccagaaacattaccaaagttgtatatcagatctaggagctttcaggcagaaaccatggggttttcaagatataaataaacattttctgtgaagagagagagtttgacttcttcttctcctatttagatgccttttatttcattctcttgcctgattgctctggctaggacttccagtactatgttgagtatgagtcgtaagagtggtcatccttgtcttgttccagttcttaacagaaatgcctccagctttcgctaattcagtatgatattggctgtgggtttgtcatagatggctcctattattttgaggtattccttcaatacctattttgttgagggttcttatcatgaagagatgttaaattttttccaaaccttttctgcatctattgatatcatgtggtttttgttgttagttctgttcacatgatgaatcacatttattgatttgtgtatgttgaaccgatcttgaataaagatcgagtaggaataaagcgcctacttgatcatggtggattagctttgtgatgtgctgctggattcagtttgctagtattttgttgctgatttttgcatctatgttcatcaaggatattggcctgaagttttctttcttgtgtctctgccaggttttgttataagaatgatgatgccctcgtagaatgagttaggcaagagtctctccttctcaattttttgaaatagcttcactaggattagtgccaacttttctttatatgtctggtagaatttggctgtgaatccatctgggccagggctttttctttttggtaagcattttattactgattcaaattcagaacacattattgaactattcagggtttcagttcttccatgttcaatcttgggaggttgtgtattttcaagaatttatccatttattctaggtattctagtttgtgtgcatagagatgtttgtaatagtctctgagggattttgtatttctgtggagttggtaatgtcccctttgccatttatgattgtagttatttgtattttgtctttttctttattaatctaactagtgttctatcaatctcatttattatttcaaagaccagctgaggctcacctgtgcttgcattctcaaagcaattgttggggggtgggggggcgggcgctgtgggcaaatgcatgccagcaaagaagtggtgataggctgcagtgagggtaggctgtgggtgatttggtgcacattggacagagcctgtctgttggagccctccaatggtgatatgcttgggctttgtatccccacccaaatctcatcttgaattgtaatccgcataatcttcataatccccacatgtcaagggagagaaaaggtgaaggtaattgaatcacgtgggcagtttcccctatgccgttctcatgatagtgagtgaattcacgagatctgatggtttcataagtgtccagcaattcccctgaatgtagttcttcctgctgccttctgaagaaggtgcctttctttctcttcgccatctaccataattataagtttcctaaggcctcccgagccatgctgaactgtgagtcaattaaacctgtttcctttataaattacctagtctttggtagtatctttatagcagtgtgaaaacagactaatacagtaaattggtaccacggagtgcggtactgctatattgatacttgaaaatgtggaagcgactttggaactgggtaacaagcagaggttggaacagtttggagggctcagaagaagacaggaagatgtgagaaagtttggaacttcctagagacttgttgaatggttttgaccaaaatgctgataatgatctggacagtgaagtctgggctgaggtggcctcagatggaaatgaggaacttgtcagaaactggaggttcctcccctttcagtccaaggtcagcatctttcctccatccactctcaatgccctccttccgatgttctgcttggagtgtgccagtcttcttgatggtctggtctctcagtgggagatgttctttttgctgcatctggtcagccaatttggttcttttcttagaaactttctaatgctacagaaatgtatttctgtctttttacggtcaaccactgtccccagaaagagctactgttatattcattgccataaattagatgcatcttttcttgaactttaataaaatcatggcatatgtacttcattattttgtttcctttgcttagagtaaaattttgtgattcattcatgtatgattactttgttattttactgctgagtggtattcaattccatgaacgcaccagatggacatttgcgctgttttcagtttggggctattatgagtaatactgccataaatatttctgcacaagtctctagaactatatcggcattcacttctcctgggaggagagctgctgtcataatgtcagatatagctttaactttatttgaaattgctaaacatttttttccaatatggactcccagtagcaatgtatgaaagtttcacttattccatgtctttgccaaaatcttctatttttattaattttaatgtgtgtcattccaatgtgggtatagtgatatctttttgtggttcaacttacattttcctaaattaatataatcttaaatatttgttgataaacttatgggctattcttctatattattttttaaagtgttcaaactttttttccatttttgttgttattaattttcaagaattttttaaacattcatacactttgtcagatgcaagaatttcaaatattttgcctagtttatgatttaactttttcttttccttttttttttttttttttttttttttgagatggagtctcatcctgttgcccaggccagagtgcactggcaagaccttggctcactgcaacctctgcctcctggctcaagcgatcttcctgcctcagccacccaaatagctgtgattacaggcatgcaccaccacacccagctaattgttgtatttttagtagagacagggtttcatcatgttggccaggctggtctcaaacttctgacctcaagggatccacctgtcttggcttcccaaagtgctagaaacagcttttttttttttcttaatgacatccttctataagcagggattttttttttttttactgtgtccaatttatttctttttatattattttcagcacaatgccatttgtgtcctaataaagatttgctaatcataatatcaaatatgtattttcttctaacaactttattttaacttttacatgtaagtttgtaatccatcttaaactaagttttctataaggtgtaaggtaggtgatgttgttgattcattaattttttagcattaatatccagttcatccagcaccatttgttgaaaacactttcctcttcccatttaattttattaggactattgttggaaatcaattgactgtgtatgtgtgggtctgcttcaagaatgtctattctcttctttaatctatttgtttatccttacgccagtgctacattttctatattattatgcctttaaaatatatattgaagatggatggatgaagtcctctaactttcttcttccttgtcaaaatgggtttggctgttctaggcccttgaattttaatttgaattttaaagtgagtttgttaatctctgtaaaaatgcctgcctaggctttggctgggaatacattgaagctacagattaatttgggaagaatagaaatcttaagaagattgtcttccaatccatgtatattttatatacagctaatttttctaagtaacatttgtaatcttgcatgtagagttctgccacattttttccttaattttcttttttttatttttcatttattactcatataattatttctaatatatcgatattgttataaatgtactttttaagatttcattttctaatatcttattgactatttataaaaaagcaatttttggccgggcatggtggctcacacctgtaatcccagcactttgggaggccgaggtgggcggatcacgaggtcaggagatcgagaccatggtgaaaccccgtctctactaaaaacagaatacaaaaaattagccgggcgcagtggcgggcgcctgtagtcccagctactcgggaggctgaggcaggagaatgacatgaacccgggaggtggagcttgcagtgagccgagatcacgccactgcactccagcctgggcgacaaagcgagactccgtctcaaaaaaaaaaaaaggaatttttatattgaccttgtatcaagtgagcatgcaaaagtttattagtctagtattttgtttgtagatatctttaaattttctatgtatacagtcatttcttctgtaattaacgacagtgttaattaaccctgttccatccctatgtcatctatctctttttcttgctgtttaagccatccaataaaatgctaaagttgggaaattagacattcttgtcctatttctgatattataagaaatcattaaataagttatcattgtcaagttaagctgaacatttttatagatatatttcatcaaatttaggaagttaacgtttattctaagtttactgagaattttatcacaaagaggtgttcaatttcataacaatctttttctgcatctattaaaatcatcatatggcttttctcctttattctgttcatctggtcaattaattcattttcaaatatatatatatatatatatatatatatatatatatatatatatatatatatttttttttttttttttttttttttttttttttttttgagacggagtgtcgccctttcgcccaggctggtgtgcagtggcacgatctcggctcactgcaagctccgcctcctgagttcacgccattctcctgcctcagcctcccgagtagctgggactgtaggtgcccgccaccacgcccagctaattttttgtatttttagtagagatggggggtttcaccgtgttagccgggatggtctcgatctcctgacgttgcgatctgcccacctcagcctcccaaagtgctgtgattacaggcatgagcaactgcgcccggcctcattttcaaatattaagcaaacttctcattcctgggatcatcctacttggtcataacatattgtccttttagtagattgctgcattcaattttctaacattttaaatggatgtttgtggctatcttaatgtgatgaatttattttaaattttcttttcttaattggattgtgtaaaacttatttggttactgttagaaacttaagataaaagaaacattttgcagataagtgggaaaattgaaaactgactgaatttctgacgatattaaaaatcaaatatttttacactttcatttcttcttgtgttacattgtggttcagcctttaaaaacaaccatttttttctgaagtgttttgattattctagttcctttacctttctgtatatatttcagaatcagcttgtctatatctacaaaaaaaatcctattgggacttcgagattgtgttaaactataatcaatttggggacattgacatcttaactatattaagttttacaatgtttgagcacagaatttctcttcagatagctcccagtactagtgatgacaggcagaaactggatcattcagacattgctgacagaaaggcaaaatgatccagtgattctagaaaaaatcagcttcttaaaaaggtaaacacacaattactgaatgactggacaatcccaaaaatgtgaacaaatgtttagagcagctctattcataactgccaaaactggaaaaaacatctcatttccatcacttgttgaagggatcaactgactagtacgtctattagtggaactctaaccactcagcaataaaagggaacaggcaattgatatatacaactagttggataaaccttaaaatattattctaagtgaaagaaaccagtttcgaaaggatatatactgtatgattttgtttatatgccattctggaaaaggcaagactgtagggaatggaagagattagcaatctccagagataactgcaaagaacccgcataagggaaattttatggcattgcatacataagtcaattatatagtatttagcacataatgcaaaaaaatgcttttttattttttaacataaaaggtttgggcatgtttcaagtaaccttgatactttgtccatgcaagaagggagtatcataacaacttgatattgcaggccaacagctcccctttgttttaatttatgtgtaagattcatggaagcagtcctttcctaaattatttaagtactttgccttctgacacaacgtccaaggattattagccttctgcacagatcttgtgaaaaaaagtagcatcaagcagtctaggagttggccctttaggaagacaaactaatctaaaccataaagtaagaaaagctctgattctagaaggaatacatggaaaaacaaaagaacacattattaagaaagagcagcaggtagagtactatttttgaaaacataaatcaaattatgttaatgtttttctcaaactctcccatggtttcccatcacatttaataaaaaatttaaataccttatcatgtctataaaattcaactcggtctgttccccttttacctcactgactttaccttggcagcttttgctcctttttcactacacttagttcatcttgattgcttcatttattaaacacctcgaactctttgttaactttcagtttcaggtcaaatattacttatctaaagattttctttgattgtctaattttgcgtcctccctcccgttgttcatgatcttatcacctatttacttctttcgtaacattttctcacagtctgtaattaccagtttttttattcattgtcttccagtagctagtggtcattgccttttttcctctccactccacttcctttaaaaatgatgtttcttctgggtagcaaaataagatgtatctattatcacagtgtgttgggtgagtcagtagtccttgaatatggatttaaaatttactgcagaaaaggccacataagtcatttcattcctgacttctacttttgtggttagcttgctttagagcaatggagcatagttatgtgaatagtagtaaaaattaacctcttttacataccctgccacatcacaacctactttacattcaaagtaattattgatagatcacaacttactattgacattttgtttattattttttgttttgtaaatctcttgttcctttatttctcttgtatttttctacaatttcacatgcattatttcaattacccttcataataactctgtgagatgggctctattattatcccatttaacagatgaagaaacgatgaaactattcaagatcatattacaaccagaaaacagcaagttgaagattcaacctagggctctctgtgtgcctatgaagcttaaacttctttttttacttttaagtatttcatctaaaaacaatcaaagaaataaaaacaaataaacaaagaaaacttaatcacaaaaagagaagcccacaggaaattcacaaaaggaaataaagtaaaaagagaactaccatagtaactacaattcataattttttgatttttcacaatgatcctctagcccctgatctgtgcatgatgtggtagtatgtactaaagatgtcacaccagggaaaatcaagaattaaggtgtctattcacataggctggaatttttttcgaagtcaccctgagtgtgtgatattcaggggcacgtacagtgaagggaatagagcaatttgagaaggcttaatatggaggacttttagatttgtgtgcagatataaatatgcatattgggaatggctttaaactcagctgatggattctttgctcctcaaagtttttaatttttaaccagccactacctttgagataatatgttggtgggacaggaacaatggatttttacccccatatctttttatgaaatcctctcttcaaaagatatctaccaacgaagcacctattgttgacataacttgggcagttaggaaaattatttttaatttttacatatggatgacacacgtcatatgcacacacacacaaagacacacaaccacattaagctttgtaaaaatcaatgttgcatttgcgttgagtgtatgaatacaggatgttctgaacttttaattctcctgatcatattgcacatccatacttttgaaatcattctttggtctgctcactttaagaataaactgagcattgatttttttattgtattgatttccctgtgcatttaagtttctatttgtgaggcatataagtaattgagatatcatcttattgggcattgtaattgtctatctacaaacatttatttcacatgtgttactggcaacattgttattatattgataaaacatgggaggaagctaaaattatgagtttactaaatgtcttcatttccaggtttaggcaatctggggtaggtttaacgttgtgtgtaagacggtctacacaatggcaaataaatgtagttttgtgaaattgctctgtaaggacaattgcttcatttcttttctatgtcattttctgaagatggaagtacccaaatttggctctcagttactctgattctcacttggatatagtattattatgtaactttctagcttgcttcaaataattagttttaatcttccaactgtaaatttgggaatacttgttaaatttggagccagagacctggcctaaacctgtcctttgacccagtgctgggggcctcagcctctgtgaatacagaagaactaataaagcaatgtttctccaaccttgataagccctagttcattcaagggacatgatgtagagctgcacatagagatggaccgctaagacagtgacttgtactgacagtgctgagggtctgtcccgcagctgacgtattagaatggagagggggtatacttattaggaagtcccaagaacacaagcaccctcttatatcattaaaggaaacgtgaattgctacatatatttttttagaaagaatctggcagtttctattaaaaggtaaaaatgcacataatttttgactcagcattttcactgttgcatatctatcacacaaacataagaaaaatgttacgtatgttgtctaaccgtgttctttgtagtggcccaaactcacacagaacaacagcgacaacaacaacaaacaaaacaactgccaaagacttaaaattaggaaaaattgatatgatactatgtaggtatttttaaaatgagctaaatctgcagctatcgactaaaagggctctctgtgaagcatgatttagtgcaaactcagtgaataaaaaggaaaataggctgggcgcgggggctcacgcctctaattccaccactttgggaggcggaggcaggtggatcatgaggtcaggtgttcaagaccagcctggccaagatggtgaaaccccgtctctactaaaaatacaaaaattagccaggtgtgatggtgagtggctgtaatcccagctactcaagaggctgaagcagggaattacttgcctgggaggcagaggttgcagtgagccgatattgtgccgttgcactccagcctaggcgacagagcgagactccatctcagaaaaaaaaaaaaaaaaaaaaaggaaaagagtgtacggtgcacacgtagatagatagattgataggcaaataaaaatctatatctgtatacaatcatttaaaaagttgtttttttttttttttttttgagatggagtcttgctctgtcgcccaggctggagtgcagtggcatgatctcggctcactgcaagctccgcctcccaggttcacacccttctctcacctcagcctcccgagtagctgggactacaggcgcccgccaccgtgcctggctaattttttgtatttttagtagagatgggatttcactgtgttagccaggatggtctcgatctcctgacctcatgatccgcctgtctcagcctcccaaagtgctgggattataggcgtgagccactgctcctggctaaaaaagtatttatagtgatacagaaggagattgggtttttttgtttatatatctgtgaatttttttaacttgataggctaagcttatattaatttggaatttaaaagtaaattaaaaaggatagcagcctccatagtattctgcactacctcctttactatgccccacatgctgtatcagaatgtgtttggaaaagactccaaatgtttaggaggctattcataaaagaatatagtatttatcaatcctcctactgaaaacaggtttacagattatttcatgaaatcctcttaatatccagatgaggatgtagagtttcctttttgctataacagtctctatgattttagaggcattctctctcaaattcactctcaatgttcctatctatgatggctgtcttccaatagtatatatccagcccaatcatttcacctgaatttcagactactttaaaagctcactcatgttacctagaactcctcaaaagagttgtcttctaccccctcaccacttctttcttgaaaccactaccatcagattttttttcttcacaatccactgaaattattcttgttgtggtcatcaaggatttttgtctttaaatccaataatcagttctcatatcccattttgcttgaacaatgattaatatttagtacagtttatcactcccttttcctgaaacattctctttctctgcttttaatatgttcatctgcatatgacacaactactgtagtcatcttttaactatggcactataaatcaccacattgaatatggtaaagcagaaaaaaagaaacttggatcttgatgattcggtgaattgctgaacttattaaatctgaaacttctcatctcttaatttcttgttgtacaagagagtaacttctcctgattgttagaaatatgttcagttggctattctgttacttgcagctgaagttacgttaattgatacacttccaaatatatccttctggcccagtcttccctgctatacttcacactctgtattcagctgtctacttgatattcccacttggatgtctaataagcattttaaatttaacatgttcaaaactactgtttaacacagccttttgaaacgtacccctcccccagcttccgttcatttaataatggtaccaacatttacctggatatcggagtttcttttctttattgcctcatgtacaattcatcggcaaccctgttgactttatatttaaattataatactcctctcttgttcccatgggataaatcccaggacccccatgagatgcctgaaaccacagatagttacaaactttatatacaccatgttttttcctgtacatacacacctatgatagtgtaatttataaattaggcatgctgagatgaacagcataaccaataataaaatagaacaattatagcaatatattgtaatgcaagttatgtgaatgtggtatcactctctctctctctcaaaatatcttattgtactctactcaccctttttcttgtgatgatgtgagatggttaaatgactacatgataagattgaggtgaatgacataggcattatgatataaatggaaaattccagaaataaacatctcataaattttcagttgagtggcattcttagtagcacatttaaatttaacaccaccctgctctgtcctgctcagattgtcattaatcacttattaacagtcttggtttatcagattgactgtgatgggctcacagtgtttttagtcaagtaacttatattttacttaataatagatggtcccgaagcacaaaagtagtaatgtaatatttttgactgtgattgactgctggtaacagaagctgtggaaagtggaactgaggataagggaaaactactgtatgtcctgagtcaaatcacttgtcatcatgtttattaccattatattttagtcaaaagctatatgatctccagcccatgatcatagaatgtgtttccatgtttgtgtgtgtgtgtgtgtgtgtgtgtttgtctcctcttcaattttttcatcagtgttttatagctcatattgtagaaatctttcacctccttagctagacttattactagttattatttaagatattggaaatgtgattactttcttgatttctttttcagcaagtttactattgttatatagaaatgctactgatttttgtatgtttattttgtatcctgcaactttactgaattaatgtatcagttctaacaatatttttggtagagattttagattttttatatataagatcatattcctctgttgatggaccttaggttacttccaaatctttgctattgtgaatagtgctacaagaaacacgaaagtgcagatacatattcaaagaactgttttccgttctttcaagtatacacctagcaatgggatttcttgatcatatggtagttctatttttagttttttgaggaacctccaactgttctccatagtggttgtactaacttccattcctaccaagagtctgcaagggttcccttttctccacatcctcaccagcatttattgcctatcttttggctaaaagccattttaaatggggtgataatatctcattatagttttgactagcatttctctggtaataaatgatgctgaggaccttttcatatacctgtttgccatgtgtttgtcttctttagagaaatgtctattcagaaattttgcctatttttaaattgaattattatatttttgtagttgtttaaatgccatatatattctggttattaaactcttgtcagatggagaatttgtaaatatattcccccattctatgaattgtttcttcactttgtctcctttgctttgccagagcttcttaatttcatgtaatcccatttgtccatttgtgctttgcttgcctgtgattgcagggttttactgaagaaatctttagccagtacaatgtgctggagtgtttccccatattttttttggcattttcatactttgaggtcatctatttaagtatctaaatcactttgatttttgtttatgatgaatgatagggcactagtttcattcttctgcatatgcatatcctgttttctcagcacaatttgctaaaaagactgtccttttcacaacgtgtgttcttggtatctttgtcaaaaatgggttcactgcagatgcatgtacttattatttttgtttagttcatcatttaatttttctgcttaaaatatgagtagtttatacaccacaattacactattatactattctgtgtttttctgcatcttactattaccaatgagtgttatatattcagattgtttcttattgctcattgtattagtctgttctcacacatctaagaaagacatacccagtactgagtaatttatgaaggaaagagtttaactgactcacagttccacatggctggggaggcctcacaatcatgggggaaggcaaagaggagaaaagcacgtcttctatggtggcaggcaagagaccatgtgcaggagaactcccctttataaaaccatcagatcttgtgagacttactcactaccacaagaacactatgtgggaaactgcccccatgattcaattactgctacctggccccgcccttgacacatgggaattattgcaattcaaggtgagatttgggtatggtcacagccaaaccctatcactcaatgtccatttatttcagactataaatttcctttagcatttcttttaatatgggtctcatggtgataaagtaactcagcatttgtttgtctgggaaatactttatttctccttcatatctgaaggatattttcaccagatatactcttctgggttataagttttgtttttcttcagcactttaaataggttgatacagtttggatctgcgtctgcacccaaatctcatgtcaaattgtaaaccccaatgtggtctgatgggaggtgattggatcacagggacagtttctgatggtttagcaccatccctactgctgttctcataatagagttctcatgagatctggttgtttataagtgtgtagcaccttcccactctccgtctttctcctgcacatgtgataagtgctggctcctccttcaccttctgccatgattgtaagtttcctgaggcctccccagaagcaaagcagatgatcatccttcctgtacagactgctaaactgtgaatcaattaaacctcttgtctttattaattatccagtctcaggtattttttatagtagtatcaggatggattaatacagaaaattcataccaaggagagggacattattataaagatacctgaaaatgtggaagcaacttggcaattttgtagcaggcagaagttggaaaagcttagaggaatcagaggaatacaggaacatgagggagaatttggaacttcctagagacttgttgaatagtgaccaaaatactgatagtgatatagacaatgaagtccatgctgtggaggtctcagatgaaaatgagaaacttattaaaaactggagtgaaggtcacttttgctatgcttcagcaaagagactggtagcattgtgcccctgctctagggatctgtgggacttttaccttgagagtgataatttagggtttctggtggaagacgtttctaagcagcagagtgttcaagatgtagcctggttgcttataacaacctatgcttatataagtgagcaaagacattaccagaaactggaacttatattgaaaacggaagcagagtgtagaaatttggaaaatttgtagcctggccatgtattagaaaagaaaagctcatttttatatgaagagtttaggctggctgagaaattcgcataagttaaaaagccaaatacctatttccaagataatggggaggcctagaaggctttttagagaactttgtagcagcccctcccattacacgcctggaggccttaaagggtagaatggttttgtgggccaggcctagggcctgctgtcctatgcatcctcgagacaccgctccctgcattccatccactatagctctagccagggctcaaaagcgcccaggtatagctcaggctgctgcttcagacaatgcaagccctaagtcttggaggcttccatgtggtgttaagtctggttgtgccaaattcaagagttgaggcttggaagcctagattttagaggatgtatggaaaagcatggatgtccatacagatgcctgcttcagggatgtccagatagatgcctacctacttcagagaacctctactagggcagtgcgaagggaaaatgtgaagaatccctgcatagagttcccactggggcactgcctagtgaagctacaagaagagggccactgtcctccagaaattgaaatggtagagccaccaacagcttgcacctggaaaagctgtaggcactcaatgccagccaatgaaactgccatggaggaagtactctacaagtcctcacggtgaagcttcccaaggccttgggaaatcactgtgacctgaatgtgagacatggaatcaaagaagattagtttggcgctttgagatgtaattattgtcctgcttcattttggacttgaacacggcctgtagcccctttattttggccaactgcttccttttgtaataagagtacttacccaatgcctgtatgcctgtattggtctgttctcatgctgctaatgaagacatacccgagactgagtaatttacaaagaaaagaggttaaattgactcacaattttgcatggttggggaggtctcaggaaacttatagtgattgcagaaggggaagcaagcacatctttcttcatatcatgacaggagggaaaaaattgtgccaagcaaaggggggagccgcttataaaaccaacagatctcatgaaaactaactcactatcatgagaacagggtggaagaaacctcccccttgattcaattatcttgactttgtctctcccatgacacataggaattatgggagctacaattcaaaatgagatttgggtagggacacagccaaatcttattattctgccttgggcccctccaaaatctcatgtcctcaccatttaagacacaatcatgcccttccaacagtcccaagaaatattatctcattccagcattaactaaaaagtccaagtctgaagtctcatctgagacaggacaagtcccttttgtttgtgattctgtgaagtcaaaagcaagttagttacttcctagataaaatgagggtacaagctttgggtaaatacaactgtcccaaataggagaaattgtccaaaacaaaggggctacaggccccctgcaggtccaaaatccaatagagcagtcattaaaacttaaagtttcgaagtgatctcctttgactccatgtctcaaatccaagtaactctgatgcaagaggtaagctctcacggccttgggaagcttcacccctgtggatttggatgctacagcccccatcctgtctacttttctgggctggcattcagtgtctgtagtttttccaggtgcacagtacaagctgtctgtggatctaccatactggagtgtggcggacaatggccctcttctcatagctccatgaggcagtaccccagtgggaactttgtgtaggggctcacacctcaatttcccttctgtactgccctagcaaaggatcttcatgagggctctgcccctgcagcaaactcttgcttggacatccaggcatttccatacatcctctgaaatctaggtggaggaactccaacctcagttcttgaattctgtgtacctgcatggccagattcaagtgtaagccaccttctggcttgggacttggggcttgcacccactgaagcaatgggctgagctgtatcttggccccttttagccacagctggagctgaagcagctgggaagcagaataccatgtccccaggctgcatagagcaggggtccccttggcccgacccacaaaaccatatttttccttctaggcctctaggcctctgatgggagtggctgccgtgaaggcctccaacatgccttggagacattttccccattgtcttggtgattcacattcatctcctcgttaataatgcaaatttctgcagctggcttgaatttctctccagaaaattgggttttcttttttatcacattgttaggttgcaaagtttccaaacttttatgctctgcttcctcttggatgctttgctgcttagaaatttcttctgccagataccctaaatcatctctctcaagttcaaagttccacagatctctagggcaaggggaaaattccatcagtctctttggtaacacataagaagagtcacctttgctccagttcccaacaagtttctcatctccatgtgagaccacctcagccaggactttattttccatatctctagcaacattttggtgaaagcaattcaaaaagtctctaggaagtcccaaactatcccacattttcctgtcttcttctgagccttccaaaaccttccaacctcatcctgttacccagttccaaagttgcttccacattttcagatatctttccaacagaacttcactacctggtaccaatttactgtattagtcaaatctcacgctgctaatgaagacatatctgacactgggtaacttgaaaagaggtttaattgactcacagttctgcatggctggggatgcttcaggaaacttacagctatggcagaagtggaggcaaacacgtccttcttcacttggcagcaggagaaagaaaaatgagtgcccagtgaagggagaagcccccaataagctatcagatctcttgagaactaactcactgtcaaaagaacaggatgggggaaaccacccccatcattcaattatttctacctggtgctgccaagacacatggggattatgggaactacaattcaagatgagatatgggtagagacacagccaaaccatatcaacctacatgacatcttggaagtaactaacttgtttttgattttacaggttcatgggtagaaaggactttccttgtctcagatgagactttggactgtggacttttgagttaatgctttactgacttaagactttggagggttgttgggaaggcatgattgtcctttgaaatgtgagaaggacatgagatttgggaggagctaggggcaaaataatatggttttgatctgtgtccctgcccaatcttatatcaaattgtaatcatcaatgttggaggtggggcctggtgggaggtgattgggtcactggggtggtttctaatggttttgcaccatccctctagtgctgttctcacgacagagttctgacaaaatctggttgtttaaaagtgtgtagcacctcggccgggcgcagtggctcacgcctgtaatcctagcactttgggaggctgaggcgggcagatcacgagctcaggaaattaagaccatcctggctaacatggtgaaaccccgtctctgctaaaaaaaaaaatacaaaaaattagccaggcatggtggcaggcacttgtaatcccagctacttgggaggctgaggcaggagaatggcatgaacccgggaggcgaagcttgcagtgagccgagattgtgccactgcactccagcctgggcagcagagtgaggctccgcctcaaaaaaaaaaaaaaagtgtgtagcacctcatccctcactctcctgctctgacaatgtgagaagagaattgctggcttccccttcaccttctgccatgattgtaagtcttcggaggcctttccagaagccaagcagatgccagcatcatgcttcctgtacagttgtatagcctgcagaaccatgagccaattaagcctctttttgtataaattacccagtctcaggtatttctttatagcagtgtgagaatgaacttattcatatgtcatgccactctatcatggcctgtaagatttccagtaaaaactctacttccagacatattggagctccattgtatttgatttctttcatatatcttgctacttttaggatcatctttcaatccttgatcttcgtgagtttgatcgttaaatgccttgaagtagtcttctttgggttaaatctgcttggtgttctatagccttcttgagcttgaatattgatatctttctctaggtttatgacgttctctattattcaccctttgaatactctctatgctgacttctctccccaccttcacttcaaggccaataactcttagatttgcccttttgaagctgttttctagatcgtgtagttgtactttgttgttttctattcttattcttttgtctccactgactgtattttcaaatagcctgtctttgagcttactacctctttcttcacttcatcaattctgttaagagactttgatgtattattaagtatgtgaattacatttttcttttcctttttttttttttaggcagggtctcactttgttacccaagctgtagtgctatggcacgatcttggctgactacagcctcaaccttccagattcaagtgattctcccacctcagacctctaagtagctggcactacaggcacccaccaccacgcctggctaatttttgtagcttttgtagagactgggtttctccatgttggccaggctgctctcaaacttgagctcaagcaatccaccagtctcagcctctcaaagtgttgtgattacaggcatgactcactgcacccagattaattacatttttcaactccagaatttctggaaaatttctgttttagtctctttgttaaatgtatctgataggattctcaattctttcactgtgttgtcttgaattacactgtttcctcaaaatagctattttgaatcctatgtctgaaaggtcagataactctgtctttccaggactggttgctagtggcatatatagtttattttgtgaagtcatgctttcctggatggtctcgatgattatggatgttcaatggtgtctggacatttaagagttaggtattcactgtagtcttcacagtctaggcttccttctttggaaggttttccaggtatttgaagggacttgggcgttgtgagctaagtttctggtcactgctggcatatctgcattaaggggcaccccaaacctagtaatatagcttttgcagacctgtaaatgtactgccttagtagtattggataaaatctggaagaattttctggattagcaggcaagcactcttgttctctcccattactttctccaaaacagatgagtctctctcctctctcttctctcctctctcttctctcttctttcttcttctcttctcttctcttctctcttcttctcttctcttcttttctcttcttctcttctcttccctttccctctccctctccctctccctccccctctctatctctctctccctcttgagctgtttggagcttggggaggaatgatacaaatacctctgtgggtaccactactaggactgtgctgaatcaggccagaagagagcagagtaatggatcttgcccaaggcccactataaccaaaagttggctaccactttcgtttgctcaaggaactcagggtctacaatgagcatgtggtaaatccatacaggattgtgtcgttcccttcagggcagaaagcttccacaggcccaggcaagtccagaggtaccatcgggaatccagggcctgcagtcagaaaccttaggtatctacctggtaaataaaatcattttttatattatctatataaaccttaggtatctacctggtaaataaaatcattttttattttattttatcataaaaaaataaataaaatcatttatttcggtgtgttagaattgggatccaaaccataagacaaagtccttccactcttcccacccctttcaacaggcagaggagtctctccccatgtccactatcacacaggcccatggggcatatagctaggctaccaccgatgttcacttaaggcccaaaggcacttctctcaaattgtggtaaattctgccaggcctgggactctcccttcagggcagtggccttccctctggcccaggacaggtccagaaatgccatccaaaatccaaggcctggaatcagggacccagtattctgcatgggctctaccccactatggctgagctggaacctcagctgcctgacaaagttccctttctgctccccactgcttatctcacataggggagtccttcctcatagccacctcatctgtgattatgcctagtcatacttgaagtcagcatgtctcagagtctcatccaaggcatatggcagactacctgcatatcactgctaattattccaggtcccaagaactctttagttaaaggtgatgaatcctgccaggtctgagtcctttctttaaaggccaaagtttcctttctggcccagggtgtgtctagaaatgttgtctagtaggtaagacttggaatgggagcctcatgactccagctggtgccctatcttactgtagttgaactggtatccaagttgcaagacaaagtactctttactctgccctctcctctcctcaagtggaaagaaggagtcacttgtgttcctgcaagctgaactgcctggggctggggaaggagtggcacaagcactcccatggccacctcaagtaatatctcactaggttgtatgcccttcatgtccactgggtctgagccgagaacaccagcagaacttgcctaggagttgctgtccttatggtctagacagcctttcaagtttacttaggaccccagagcactttagcctgttgtggcaatgctagacaaaactcacatttgtaccactggtatgaaagattcccctctggtgagcgctgacctaaatgctcctactgggggtatttgctgtgttgttttgagtgttgccttcctctatgatagggtagcactgagttccaacacaaagtcctacaatcactgcattctccctaccgtaagtacaccaattctccacaccacatggttgctgacaggagatgtaaagaggagttgcaaaagcaattgaagactgtctttcctacacgtttcagtgctgattttagtgatatgtagtttaaaccaagtattgtgattgctcacctattttttggttctcataaatgtgatttttctgtgtgtgtgtgtgtgtgtagatggttatttaatctggcgttcctatggggaggaggatacatggaagcttctctatttagccatcttgctctggctcctctcctttttctaacaatttgcttcagtttatttttccatagaacttataatcatctgagatatttatcttttgtacacccttccaactagaatatgagtactatgggggcagaaattttgtttattgctgactgtctagctttttcagtttctagcacatattaagcattcatgaaattatacaaacaaaagatggtggaggctttcatagattctaatttgcacttttcaataactcttttgtgtcaactaaagaagttttaagtgttagatattttataatttgcaatatttttaaactcctaatatctcagcaaacagtgttttttttaatctgaaacatgaaggtaataaataagatggctcttatgcaatcatttacattttaagaagataaatatttcaaaaggccaagataattcttataaaagtatgggcctggattgaaaagctggtgttactcctcagtgaatgatatcttttccacagttatacaagtatccaagttgagaagagccattattatcggccactcaaaaattctaatttttatttatcagcaatttttagaccttggtgcacaaaagaacgcacctgggaaactaaaaaaataaaagatccttgtgctcatgtctaaatccagacagttaagtcataatctgtaggatgaagtctaggcattagtattttcaaaaaaataagttaatttaaatttacacacactgcacagataatttaaaaagcaagagaatcattactctacgattacatcttcattttttatgtttctgtatgactgatgtttattgtttattccagcctaacagtagcaacacttggcttaaaaaagtatcaaatgcacattacacatgctgatctacaagacataaagaaacctgagttaaagatagagtcttcaaagaattatgaacgtgagtgatgtatttactagtggttaaaacagcatttaccaatcacagcatgtgtaagtgctgcctgtacctacttttattctgggcgtgagctagtggcattttttttttcaatcacaaagtattattgttatagcactttttatttatttgtaattggcaaataataattgtgtttatttatagggtacaatttgatgttttgatctatgtatacatttgtagagtcaatgaagctaagtgatatagttgggctgtgtccccaaccaaatctcatcttgagttttaactcccacaattatgatgtgtcatggggagggaccaagtgggaggtagttgaatcatgggggttgggtctttctccttctgttctcatgataatgaataagtctcatgagatctgatggttttataaagaggagttcccccacacaagctctctctctgtctgccaccatccatgtaagatgtaacttgctcctccttccttgtcttccatcataattgtgaggcctccccatctatgtggaactgtaagtccattaaacctcttttttttttttaagtttcccagtctcaggtatgtctttattagcagcatgaaaacagactaatacactaagtaagatacctttcacctcagtaacatcatttttttttatggtgagaatatcaaaaatctattattggccaggtgtggtggcccatgcctataatcctagcactttgggaggccaagacatgtagatcacttgaggtcagcagtttgagaccagcctggccaacgtggcaaaaccccgtctctactaaaaataataatatgaaaaaaatagctgggcatggtgttgcatgcctgtattcccagctgcttgggtggctgaggcagcagaattccttgaacctggcatgtggaggttgcagtgagctgagattacaccactgcactctagccagagtgatggagtgagacactgtctcaaaaaaacaattctattattttagcaattttgaaatatatgataccttattattaactgtgattatcatgcagtacaatagatcagtacaacttatgactccagtctaactgaaaccttctatcttttaatcaacatctgccattttcccatccctttgcttcccactaacctctgggacacctttctcttatctgtttttatgagataaacatttttacattcacatataagtgacattatggagcatttgtctttctgcacctggcttacttcacttagcatgtcttccagttccaaccatgttattatgaatgacgtattttctccttttgtaaggctagattgtattccattgagaatgcacatatcactttttaaaaaacattcacatattgatgggcactttggatgattccatatcttggctattgtgaatagtgctgcaataattatgagagtgcagatatctctttggcataccaatttcaattcctttggatatataccctgaagtgggactactatttcatattgtaattctatttttagtttatttgacaaaatatcatactttttccaagtggctggactaatttactttcccaccaacactgtacaaagattcccttttctccacatccacataaacacttattatttttattttagataatagccattccaacaggtgttaggtaatatctcgctgtggttttgatttgaattttcctgatgattattgatgtcgggcatttttttcatatctctcctggctatttttatcttttcttttgagaaatgtctgttcagatcctttgcctgttttttaattgggttatttgtttgcttgctattgaattgtttgtgtttttttctattcctatgaaaaatgatataggaaatttgatagagattgcattgaatctgtagatagctttgggtagtacagacatcttaacaatattatttttttcagtccaagaacatgggatatttttccatttatttgtgtcttcttcaatttctttcatcaatgttttatagtttttattgtacaggtcttttaccggtttacatttacttctgagtattttatttctttagatgttgttgtaaattaattgtctccttaattgtacctacttagtttttcagtactttagcgtggtagaatcatgcactatacatcaaaagtaaggtgcaaatttaatgtagaaaagttaaattgaaaaaccactctttacagatatcagctgtataagttatattttacagactacttcaactatatttcctttttttctgtgtgtcttggtaaataatcagcacaaaaggggaagctgaactctttatgttctatattttatctttttctaggaattttctactcatttataatccaaatgcatagatacatttcaattataagactcattaaataacagatataaatgcaaattagtcataaaccaacctaaagtagttttaatattatctacccaaacatatacatatacacacacacacatgcatactggtttggggtaatatgaatttaatcaagcagttcttatacactattactaaaacagtttctaactactttttttaattcaactgatatcttcataataaatgaatggctgaacttatattttccaatgtattcatttgtatagatacagtctcaattttactttaggaatagtttttgtggtcagttcttcctttctgcaagtcagacctctgtaagttggttatttttgccttctcttctagtctttctggctatccattcagttccttgtctagagctttacacagggtatatgctgaataaatgcctgttgactgatagtcaatgactcacagtcttttttgcagagtttgaggaataatacagcatattggctaacatcccagtctgatctttgcttaggaatttggactgctttattttgcagacacattggctctgtatttctgtatagtcttcttggcagaataattgtcttgaacattagttgagacctgaggcattagaatcagagtcttgagtttgaacacctgctctgactcttatagttgtatgaaatatgttgacacgctgtgcctcagtttttatatctgtcaactatcaatgaaaataaataatggtacctctccctgtgggattttctatgaggattaaatgaagcaatgcatatcaagtacaactcatagtggccgatgtataataagagcttataacagtagtggtattatcattattattatatcctgaatcaaaattatcattccatccatgtgtcaactcaggttttaagtgctctccaagtgctcagcactggaatttattctaaatatgtttataaagaaccaaaaaggtcaaataagatgagtgagggagtcaaattgaactgtataaaataggaattgtagtctgttttcagacttgtatctctttcttttttttaaattttactttaagatctgggatacatgtgcagaacatgcaggtttgttacataggtatacatgtgccatggtggtttgctgcacctatcaacccgtcatctaggttttaagacccacatgcattagggatttgtcctaatgctctccctccccttgtcccccaccccctgacaggcttgtgtttcagtggcagaaagaaaaaggaatttggcctgatgcttgggtttctataatagcactttatttattattcacatttgggactctgatggacaatgaatatttattctggacatacctcttccaaacttcagaacatgagtagggaatatcttgataaaatcacttgtagaaaaaactaattaatttgtgaaattcaagttcaggctcatcttgaatagtcagttccctccccaaactttgaatgactgtcatagaaacaaagctaccttttttcattttgtgaagcatatatttttatcatatcttacttacaaggaataattaccctatgtggctggtttgtgtatttcagtattttgtgtttgatgtggaatgttctcgacaggaagttgaaagaacagtccaaagctgtttggttcttcctagctctgtaactaatgtctcagtgatgctggacaagtcacttcaactttctttggctcagtttcctcatctatcaagaggctgatattgcagtctgtgttcttcaaagggctgttgagggagttgattaaatatcgaaccagcttttgccagtgtctatgtagcacttttattttccctgattctaaacctaggtgagtttcgttagttggttggctcctagtgattatgagggacatgataagttgtgtgcacataggggagtactgcactctgttataaagccacaaactgcacctctccccatctgttaaatgtgtgccttcaatcacaaaagctaaggaggatcagctgagagagcccagatgatttggcattgtgtagtggaaggagcaaaggcttctaaagtcatatgatagctttgtcataattggctgttggattctaggtgtcttagtttgttttctgctgctgtaacagactttctgaaactaggtaatttatatggaaaaggagtttatttagcttatggttctggaggctgggaagtcttaagggcagggcactggaatcttgtgaaggccctcttgcttacatggcagaaggcatcagatggccaaagggtaagaaaatgcatatgagctcaggcctttctctcacttcttgtaaggccaccaggcttggcatgatggatccaccctgatgatcatagctaatcttaattatcttcaaatggtcccatcttcaatcaacatatgaatttggtaattaagtttttaacacataaaatttggaagacacatttaaattacagcaatgggcaagttggtaaatgctatgctccttattaatttcatctgcaaaatgaagacaaaagtacccataatgcagggctgtttttggataaaaatctgattaattttgtgaagaaccttgtggagttccctctggcatctcgggatgcttaacaagtttatgtttctacctgccccacatttaatgctatctaccacccttttaatggtgtatatcagatttttcattgatactagtgtggatagttgttggtagtacaacctatcatctagttctataacacaaattctacttagaaggaaattgtttcttagtagtctacaagatagcctgctttctttgttctcttccgcaggaagacatggataaagagttatttgccatctttggtaattttgcccattctgctttatgagatcaaccccaccaattttcagcagtaatctcattgttattgcagtcaacttacaattatcacagctaatgcaagagaatattagcatatatgacacaattaatgaaacaatctgtttagggctttcttcacttctactctactaaccaaattccagagggctcactaatgatgacagactcagggaataaaactaatatgtataagaagaagggactgtaggtatcaaattctgatattttcctcttgccctgattgatataactctctgagggattttttctctgtaattatcctacaagcctgtgggaagtaattcaaccttttttttttttattaattcttattccaaaagtatttaaagatcatgctggtgaaatgagagaaatagaagccaatgaacatcatgggctgtgttgaaaaggaagtgaagtgacacataaaatgacaagtggacaggggaacaagcaaacaatcattaaaaggctgatttccctaagatcaaccattgagtcaataaaagagctgaaacctgtattagttcattcttacacttctataaaaaactacccatgactgggtaatttatgaagaaaagaggtgtaagtgatgcacgattccacaggctgtacaggaagcatggctggaaggcttcaagaaacttacaattatggtacaaggcaaaaaggaagcaagtacatattcacattgtgacaggagagagagtgagcaaatggggaagtgctacacacatttaaagaaccagatctcatgagaactcacttgctatcagaagaacagcaaggggaaatgtgtccccaggatccaaataactcccaccaggtccccttggcaaacattgggaattacaatttgacatatttgggtggagacacagagccaaatgatatcattcaacctctggcccctcccaaatctcatgtccttctcacatttaagaacacaatcatgccttcttatatggtttggttgtgtccccgcccaaatctcatcttgaattgtagttgccataatccgcacacgtgatgggagggacctggtgggaggtaattaaatcatggggttgatggttttataaggttttataagagccccctttgctcagccctcattctctctcttgctgccctatgaagaggtaccttctgccatgattgtacatttcctgaggccttcccagccgtgtggagctgtgagtcaattaagcctcttttcttttttctttttcttttttttaataaataaacatttttaattttgagagagttgtagattagcctcttttctttatcaactacccagtcttggatatttcttcatagcagtgtgaaaatggactaatatagtaaactggtagcagatagtggagtactgctgtaaaaattcctgaaaatgtggaagtgattgtggaactgggtaacaggcagaggttggaacggtttggagggctcagaagcagacaggaagatttgggaacttttggaagttccttgtctttgggaacatttggaacttcctagagacttgttgaatggctttgacaaaaatgctgaaagtaatatggacaataaaatctaggttgaggtggtctcagatggagatgaggaactttttggggactggaataaaggtgactcttgctatgttttagcaaagagactggtggcattttgaccctgccctagagttctgtggaactttgtatttgagggagatgatttaggtgtctggcggaagaaatttccaagcaccaaagtgttcaagaggtgacttgagtggctgcagaaatttgcataagtaatgaggaaccaaatgttagtcaccaagacaatggggaaaatgtctccaggacatgtcagaggtttttaaggtatcacaggccaggaggcctatgaggaaaacatgattttgtgggccgatccgagagccttgctgctttatgcagtctcagtacttggtgctaagaggccaatgtagagctcaggtcattgcttcagagggtgcaagccccaagccttggtgacttccatgtggtgtggcattttcatacctcctctgaaatctacgcagatgctcccaaacctcaacccttgccttctgtgcaccggtaggcccaccatgtggaagccgccaaggctttggacttgcaccctctgaagtaacagtttgagccgtatcttggccccttttagctgtggttggagctgaacctggagcggctggaatgcagggcatcatgtcctgaggctgcacagagcagcaggacactggccctggccaatgaaaccatttttctcttatacacttctgggactgtgatgggaggggttgcctcgaatgtttccgaaataccctggaggcattgtcgccattgtcttggtgattaacatttggctcttggttacttatgcaaatttctgcagtgttaaatttctccccagagaatatgtttttcttttctaccacatggtcaagctgcaaatttttccaacttttatgctttgcttttcttttcaatataagttttagtttcaggtaatttttaatgcaaacgagcataaaggcgcttagaaacagccaggccacagcttgaacgctttgctgcttagaaattttttcctccagatacaggaaattatctctctgaagttcaaagttgcagatacctagaacaggggaacgatgccaccattctctttgctaaagcatagcaagagtgacttttactccatttcccaataagttcctcttctccatctaagaccacctgaacctggacttcaatgtccatatcactatcagcattttggtcacaaccattcaacaagtctttaggaagttccatactccctcattttcctgtcttctgattcctccaaactgttaacaacctctgcctgttacccagttccaaagtcacttccacattttcaggtatctgtatagtaatgccccacttttctggtaccaattttctgttttagtttgttctcactttgttataaagaactatctgacactgagtaatttacgaagaaaagagacttaattgactcacagttcttcaggctatacagaaagcatggctgggaggccccaggaaacttacagtcatggtagtgttataaataatgtttcggtgccacaaaacaaatagcactcaaatataaaattttctttttaattctcagcaaggcaagttacttctgtagaagggtgcacccttgcagatggagcaatggtgagtgcacacttggacaagggatgagaaggggttcttatccctgatgcatgtggcccctgctgctgtgtctttcccctattggctagggttagacagcacaggctaaactaattctgattggctaatttaaagagattgacgggttgagtggtttggcgggaaaaatggttatgacatagcaggtaatcggaatgagtcagggtggagcaggtgatcggattgagtcagggtggagcaggtgatcagaatgagtcagggtggagcaggtgattgaaatgagtcagggtggagcaggtaatcgaaaaaggttgctttatgaggaagttaagtttaaaagtagaaggcaaagaatcgagcatactgacattgattcttcaaaaagaaatttagaactcatatctaacagtagaaggtgaaggggaagcaaacacatcttcacatggtgacagagagatagagagcaaagtgctaagtcctccacactttgaaagaaccagatctcatgggaactcactcactatcacaagaacagcaagggtgaaatttgcccccatgatccaatcacctcctaacaggtccctcccccaacactgggagttacaattcaacatgagatttgggtggagacacagagtcaaattatatcacactagactccaggttcagactcttgtctttatgccagtattcttacagagtcattgtacaatgggggtaaccatgtaggctttgtaaatatctgacaaacctagggagaattcttattctccaattctgtactgtgtgacctttggcaagttgcttaagcaccctgatggttagctttcatatccacaaaatggacactatttaattgaacaatgtattaaaagtacctgaataaaaacacttttacaagccttaaaggaaatgcaggataaggtggtcacgtaactctcatacagctgcattgccatggtcaccatactctagcaagtccacagatctgacagtctggcatcaaaatacttgtatgtcttagaagccacattacatttaagtcaaaaaagagatgttccatatgtcaggtataatagactcaaaacactgtacaataccaccaatgtatgaattgacctaaggcatggctgttattaaacactgttagctgtctaaagactcttacagggcctgttaatgggcagcttttgatttttcaaaaaaaataatgttttcaggagtacaagctataaaaaagcaaaggactctaattttccaatgtgcgctcttctaatcaagctggttttcccttgtctctgtattgaaatgacaagcacatgtctttcccagatatctggcacctcttgtgatttttttcttcatgtcaaaatgacagactcttaattagtagggctacttaatcctttcttgcagcaatgcatcgtgacagtttcatcctcatatcattcttcccaagctattatttagtgttcagtcggcaatgagaatgcaggactatgcttaagagtttttacattatggttttgcagtttttttctatcagttagacacatatgattcattggtctccaagacctatgatacgttttgtttatttttaaagattagtatctctatcaggaccattctggctgtgcatagggtctatccttttaaatccagtccccttgggataccaaatgagagcccatacagggatgaaaagtgtaatttaattgtaggtgtgcagtgaagcagggtgaagagtgttcacaataaccccagttgccaggcagggaaatgtgtggatgcatttcttggtaagcatttacattattgacatttgtaaggctgccttcaagaatccatcctctgaagctgcttacttgattaaaatgaactcaacttattctaatatgtcctttactatatgtgggaagagcagtttctttttgacttgctatcaagcaccccttactaatctgatatttgcagatttacttcaattaaataaattcactttccaagagataaaacagcagatctaagcattttcaatggactttgacttaaagaactattcatctgtgcattgctttatccattttatttttatattttaaaataatatttcaaagataaaaatccctaaggatccaagtgcaatcactgtagcattgacctctttcaaacactcaccagcaatgtgagccaaatgtcccaacagagcagtcagtggcttcactctgtgggtcagctaggagtaggtctctgtgtaagggaaattacttatctaaccatcacctttttcaaattgtgttaattctaaatgccagaatcaaaggatatgagcaggtgaaaggctcatgtatgttttgtcatttttttcacagtaactttctattggttggcattcccataagtgatatataaaagtgcccttcttatctcccccttgccaacaaaacgtgttttttttttaatttttgctaatttgatcaatgaaaaatgatatattgcttttattttcaattccttttatgattactgaggactgaacatttttccatccgtaatagcaattcttatttcttgttctgtgaattgtctcttagtttccattgtacttctacatgttttgctcaagtgcagctatacttattcctgatctaagaagcagaaactgtcaccattattccttcttgggattcaaccaaatcaaatttaaaattcacaaagaaaaacaatacaggcaggacctccagtccccagttccccagagtctcagtcaagaatcagttcttcttcatggctgtgcagattttgagaatgtgcatgctcccgttctcagtcctttagcatatgcaaaagcacttaaacagatctgttaataacttgcctgcttcttaaggggtgttcaagaaagggccattcgtttattttcttttcgagtagctcaaatgcactgaaggtagtacacatttgaatgccggtcacttaaaaacacacacagcctagagtaatttttttgcaactggcctcatgtggagaagaaaagaaaaatgaaccagctggattggttgctagtttctaagaaggaatatttcccatttaaaattgtatttctcagtgaatcaaaattaggaaatatgaacaagccgatcatgaatatactccctaattaagcctattatatttgaaaatctttatatcgatcattattctagatcctatgggatttcatgtggattaacctcgggttttggaaattggtcatatttgaggaacagccaagtactgaaacaagaccagcactcatagagtttgagagttcaatagctaaacagatgcttgtcaatcttatcttactggccaccaaagacaaagtgactttacctagagaaaaagtcttgattatttgggttttattagcacttcaggtaggcagaaaccctcttcacttgtcatttgtggggcattcttgtctatcatatttagtattccttggtagcatgaagcaggtggagatttgcttctttaggaaaaaattttgtttcatcttagcaaaatgtaaggcatatggaaaataaaataaataaaacacttcaggtttcattagtaattttttttaaaaaaacatgtatttaaaatattttactgtggatatctgagtaatagatattattaggggaagtttattcaagactatttgcaacaataaaataatttgtgtctacacataagaagttaaataagtattaatctagataattcaggccatctacatttgatatatccaggcttttgaacaaaaaagttattgcttagtctgaatagtattgtaagcttccattcaagatgtacatttcaatgagtggtaaaaagtcaactgttgtgaataaaaagacagtgcattctattaaatatttgatgaaagtttgagggtagtggtaggtcttactgtattgactagttgtttgatcttaattaattttaagtaaagagtctaggattcctaaaaggttttgtgctttctttacggtttaatagaaattaatttttacctgcttcaaattctatgatatgtcattaataatttgttccttatttcattttgttataataattattaaatcacatggtacatgccagactccaaagaactactagaatggctaactaagatacatttctggattccctctctattcttatttaccagtgtgttctatactatctctaattgataccaaagagtcctagatctttccactgatttatatgctataattttagatagacaattatgcaatttgccatctgtcaagccatagacagcggaaacaaagtacacacgttagaagttctctctatatttgctaaattaatgaaataaaggaagaggggaaaaataagtgaatagtattttttgttaccaggaaacaaaaaggaagtattagctcgttcttaatgtggttcaatgtctttcacagctttgtatttttcccttacctctgagccccatctccatttcatcctctgcaaatgattaaaatccgtctcttcttaaaaagatacagatgttgttgtcatagaatatttagaaaggggtaaacgttactttacttctagttataagtacattcaagcttttctccccactgtggcctttacattcttttcctggtggtgtcgaagttttcaggtggttacacaatgtgttctcttcaacaggaagttttgcctggcctgactttgcctccatataatgtgtgaatggtatgatatttgttacatcaattgatttttaactgtttaccttatggggttgtggccttcttttaaaagcttctcatgctgaaatagaaagccagcagggattccggtggtgctagctaaagcaacatcacacattttatcgaaggataacatggacacatagtgggaaacaacactctgtggcctactggagggtggaggctggtaggagggagaggatcaggaaaaataactaatgggtactaggcttaatacctgggtgatgaaataatctattcaacaaacccccatgatacaaatttacctatgtaacacacctgtacttgtacccctgaacttaaaatataagtttaaaaaaaagaattagtaacatgcatgagaaggaactgtatctcttgacaaaattccttgtgtcttgcttttaaaaaccatgaaaaaatgttaacctgccagactctacaatatactgctggaaagccatgttttaacagtacatgtttaacctttctctatcaggagaaatctaccccatccttactactctgtctcccacagaagcaaaaaaaaaaaaaaaaaaaacaaaacagcaatgagaaaaatggctgaaaagttttaacgtttttatccaatggtcataatctaacttgcacttttaaattttacatgcattttaatttttattttttggataaaaagttataagaaagagcagagagatgttataaactcttcacctagcttcctataaagttagcatcacatacaattatagtacagcaattaaaaaaaacagaaaattaacctcaatagcaattctattaactgttatacagatcttatttaaatttcaccaattgcactactgaggccttttttaggttgttttggactagtatatcagattgcattttattttgatgttccctctagcattcttcattctataagaattccccagagttactttgtttttttgtgatcttggcattttcaagagcactggccaattgttttgtagcatagtactcactttgatttgtctaatgtgttttcatgattctagtgagcttttgcatttttaataaaaatattacaaaatgatgttgcgcccatatcagtacatcatatcagcaggtgcatgatgttaatccatcttggtactggtgatgttaacctgtatcatttgattacaatgatgtctgccaagttgctctattgtggagttattattttttcttggtaatttgatttacatttttaagggttttctggatttaacctagagaatagattggtgaaaagcaagatatgagttaggcaaaatagagaagagactgttaaattagatgacataagagctaatgtgacttaaactagatagtcataaaaagtaaataaatatttgctatatattggaataaaagtcaataaaattggtgatgaattgaatatggttgggtgagaaaatatgagatataaggaagaactccaaggtttctgccttgtaggatggggtgaagggtagtgatatactttgggatgagaaacattggatgagttctgtcagtcagttattttaagaggaagtatggataatgagttggagaaatacaagagtgggaggaaagaaactagttcggaagctattgcattagtttagattaccagtgatggtttctttagattagaagggatgacaaaatggagaaaactatctccctgatgtgggagatgatttaagaattataattaataggcgttaagccttaattgattaaggggatttgctgagcaaaagaggcgacaaaggataacttctaggtttcttgctttgcacaactggatgaattgtggttccatttattcagatgggaagccatgatgggaaactaggtttagaatggtagttatttacccattcactactaataatacaaaacaattggctagtgctcttgaaaatgccaagatcacaaaaaacaaagtagctctgaggaactcttatagaatgcagaatactaaagggaacatcaaaataaaatgcaatgtgagatcctagaccaaaacaacctaaaaaaggccttagtagtttaattggtgatatttaaataagatctgtataacagttaatagtattgctattgaggttaattttctggtattttttattgctgtactataattgtatgtgatgctaactttataggaagctaggtgaagagtttataagaactctctgttctttttttataactcttttattcaaaaaataaaaaataaaatgcatgtaaaatttaaaagtgcaagttagattatgatcattggataaaaacttttcagccatttcctattgctgtttttttgtctaaaaaatataaattcactctctagtgtaagagtagtatgcataacttgttgtaaatggaaatgtgtgtacacaaaaacagcaaaggaaaaataaaaataattctcctcattcttcccctttcccccaacctgctcatatcttttattgttcttttaaaataaaaacagaaaatctaaacttgttctactgatccctatataatctggtctctgactctttgtctaatcttatctgatgatagcacactcccccttactaaccacacttgaggcaaacaggcacctttctgttttttaaccgagctccttattaccttgggacctttgttcttgctatttcctcatactagactgtccccactcctgtatttcaatggctacctctatctacttggactccttatgcaccctgtgtaacaacctattctcctcatagaagcgaatataatctattaaaaatattaattggatcagatgtttcttctacttaaaactttttcataggttactactgtgcttaaagtttaaactctttaccataacccacaggtaccgtatattctgatccctccctgtctctccagcctcatcccaagccactatctcagcctagcactatctcctccctgcccagtccactttatctggataacttttattcatctttcaattataagacttgagatcattttctgagaatgcttttctgatagtcttcttcccatatctggggaaacgcttctatttttttttttttttgagacagagtctcgctctgtcgtccaggctggagtgcagtggtgcaatctcggctcactacaacctctgcctcccgggttcaagcgattctcctgcctcagcctcctgagtagctggcactacaggcgtgtgccaccatgcctggctaatttttgtatttttagtggagatggggtttcactatgttggccaggctggtcttgaactcctgacgtcaggtgatcgacccggctgggcttcccagagtgctaggattacaggcgtgaaccacctcgccctgccacgcttcttatggttattcccatagctgcttatatttcctcatcatagcacgtatcaaattctaatgtcatgttgtgtggtgtttataacatatgtacaagtaacatctataacaataatagcacaaaaactagaacaaacgaaattatactgtgctattataaggttcttaaactatatgtggaatagtataatatcacttgaaagtagtttgtgataagttaaaggtgtacaccaaaggatttccagcttctgttatgagaactagagagctggatggaaggagcatcactcctaaatttacaatgaaaaagagacaagtttactttaaattgatattcaaacagagagagccaaggttgcagagcaaccaccctactcaaaacctgaggatacaaggtgacttcagcgtctgtagtcatgaactctttcacaactggggtagatctaatcagatagtgggaagaagaattcagggagaatgtctgtcaaattaatgaaggccaagatcagattggtgggagagtgcgaattctctaagagggtcagaaaaattgatggagttcaaatccacttatagcctctttcaccaccaaccgcactggtccaaacagaaaagactggaaagagatctaaagaaatggctattgtgttgcagacttgggacgcaaaaagggtagttcagttccacaggggaaaaactgcccccagatgcttttctcttctctcaacagtagaacaaaagccttaatctgcgggggaagacaaaaagcactgctttcattggggcattactgaaaactccttatatttgtgggaaggcaacaaagaaaaggaacccctaagtatatcaaaaatcatatccaatataaatgttctaaacagtccagttgaaaagcagagactatcagactggatgtaaaagcaagacttgactatatgcttcttataagaaacacactttatgtataaagacattaattaattaccaaacactaaagaataaatattaattcatcacaatctcttccagaaaactgcagaagaggaaacaattcccaactccttctataaggcctttattaccttaatatcaacccaatcaaagatatgacaagaaaagcaaactacatgccaatgcaattgccataattctagcaactaaaatcagaatacatatgaaaaagacactatccagtacagtttattcctgaaatacaagattggtttaatatttgaaaaccgatgaacttgccatattaacaaactaagagggggaaaactgaggtcatatcaatatatgtggataaaatccatttgacaaagtccaataatgtctttgtgtggttcctttgaatatagtgtgtcttctcttctcttcagaaaccacatcaacagtgcaactccatgagttttagtgtgtattcattttgaaagtagtgaaaatttaaatgaatcaatgtgaatgtaaaatccttctgggtgttgacactatttttactaagattttaaacttgtctgaaccacattaaatttgatagtatcttttttctaaaataacttgcttctagaaggtttttccaaagcattatattcagttactatagaaacaaccccttttcataaagctaatataattgattaatttagatacagtaattacaagaagaacagatgaaacaggttttggatcaaacgcaactgacccttggcaacacacaaatgaatagtggtgagctaaagtatatgggcaaagtagagaatggtctgttagatacacaagtgtgtatgtgctgtggttatcaaccaaaaattgaaagattttacggcaggaaagagaaatatcagttaatctaaaagttaaataggtaaaacagaatatctacattgttttaggtgttgtacttctatcgtcaatttttaaaaattacttgtgtgtttttcttctggttttttatgatttcctttcacacctttttttcttatgtctcattccttctttaggagttcacttttctttatgttagagtaaaactgtttctttttatttttgttttattttgtacattttcctagttagagttgcttggtcttgtatatctgctgaaatattcttcattatatcttcattcttgaatgacagattagctgaatatacaattatattttgcgagatatttccctgcagcattttgaaggcatgtttctgtcttctgacatataccgccgtgaatgagaagtctgctgtcagtctgagtgatgtttctttggagctaatctcttttgatactctgcctgtttttaaaattttccatgtggatttattctgccatcttgaaaataagtctagatttttttatgtgtgctgaaagttataaccaagtagaaaaataataataaacaaatttgctactaagatgtaactgctgttaacatcttgccaacatttttatgctttttatattgtatcatagtcaggatcatactgtacacacaattgtatcttatattttttagatggtataataacataaggacttttaatgttattactattttttgtaaatactatgttaatactgagtagtattctatcataggatatactttaatatatgtaaccttttttctatgtttagtattctctggtttcttgactttttaattttatcagtaatgttttaatagccaattttgcctgtaagttattcgttttatctctaattattattactttttatttcaatagcttttgaggtacaggtggttgttattgattatatgggtgagttcttaatgattaattctgagattttagtgcactcatcacctgagcagtatacattgtacccaacatatagtcttttgtccctcactcccctctcactcttcccctctcagtccccagagtccattatatcactctgtatgtctttgcatcctcatagcttagttcccacttaaaagtgagaacatacaatttttggttttccgttcctgatttacttcatttagaataatggcttccagctccttccaagttgctgcaaaagacattatttcattcctttttatggctgagtagctttccatgatatatatataccacattttctttatctgcccattggtctatgggcacttaggttggttccatatctttgcaattatgaattgtgctgctataaacaagcatgtgcgtgtgtcttttttatataatgacttcttttcctttgggtagatacccattagtgggattgctggatcaaatggtagatctacttttagttctttaaggaatctctgtattgctttccatagtggttgtgctagtttacattcctaccagcagtgcataagtgttccctgttcaccacatccactccaacatcttttttttttgactttttaattatggccattcttgtaggagtaaggtggtatttcattgtgatttttatttatttatttatttttgttgttttgttttttgagacagagtcttgctctgtcacccaggatggagtgcagtggcacgatctcagctcactgcaacccccgtctcccgggttcaagcaattctcctgcctcggcctcctgagtagctgggattataggcgtgcactactacgcccagctaatttttgtattgttagtagagatggggtttcacctggctggtctcgaactcttgacctcaggtgatccacctgcctcggcctcccaaagtgctgggattacaaacgtgagccactgcacccggcctcattgtggttttaatttgcatttccctgatgattagtgatattgagcatttgtttcatgtgtttgttgcttgtttgtatatctttgttaaaagaaaaactttagcccaattaaattttttaaaagtttaattgaggaaagaacaattcccaatttgggcagcctcccaagccatagtaggctcagagactccagcacagccacctgctggaagaagatttatggacataaaaaggaaagtgacatacagaaaatggaagtgagctacagaaacagctgaattggttacagctcggcatttgccttgtttgaatgtggtttaaatagttggccacctctgattggccaaaacttggggattggcacaagagtaggctacagtttgtttacaaatctgtttaggttatagttcatgagaagtgtacagcaaaatttttaggccacagttaaaatatgtggggaggcagctttatgctaaacttggcttaacaatttctcccttttggtcatcctctaaattttgagaaattggcccaaaatgtagtcactgatgtcactatcatcattgtaagtgtacttatttggtcttgaagcccatggggaaatagcagaacagtgggttttgtaaggtgggaacaaggacttcattttaattttttgtcagggttagagtaggaggtaccctccttatgctggaatatcctgtttacaggaggaaaacaaaactctgtctgttctaggatctatgtgttctcttaaagtcttagtttgatcgtcacatttagtataagtgagtccatttggttttgtgtggtctgatggggcctagtgcatgagctcagctcaaaacaatggcttcccataattttctttaaaaatttccccctttggacaggttctagcttaagggagagcgtgaccaaaacagagggccttagtgctgctctcagttaccatcattttgagtttccagtctcagcacgtcattcataggttatggtgacctcatggtcatacatttctttcagctcttgttattccagttgaagagagaccatttgacattctagagatggctgtattaagaaattgaaaccttctgaaagaatatagcataccagggtgactattattatgactatcaggaggataatatcaagagtttggagtatgcttctcagccagtgtccacataaaccaaaccaactaaaatcaaagtgatcaatgaatgagttagataaagagtctacttgctttaattaagcagtttcttcattaatattctataactgaatttctataataaccaatgtaatgtatttctccatgggcaacaaggagggccagcagctgcatagacacttctctgtttaaccagtaagtaatctagagagattttgttatttaacacaactttcataatagaattcaaaatctgtcatgtaagcttagcctttacagtagaatctgctataaagcctatcatgagtgatacattcctaattgtctcatttacttcaacccaaggaaaaaggacctagcaaatgatgctcttctagaatagtgaagacgtcctggcagtgttctctttaaccatgatgtgggttaagaggagtggactaatgttctgcttctgactgattatcaggcgtaatatgtaccattataatttctcacctacattgtgccttcatcttccatctatcaaggtatgttttccatgtgtaaggttggctgcaaaattattcacaaataaaattataccccattaatgcacacaacagacccccttttctttttttattattattatactttaagttctagggtacatatgcacaatgtgcaggttggttacatatgtatacatgcgccatgttggtgtgctgcacccattaactcatcatttacattaggtatatctcctaatgctatccctccccactccccccaccccacgacaggccctggtgtgtgacgttccccgccctgtgtccaagtgttctcattgttcaattctcacctatgagtgagaacatgcggtgtttggttttttgtccgtgcgatagtctgctgagaatgatggtttccagcttcatccatgtccctacaaaggacatgaactcatcccttttttatggctgcatagtattccatggtgtgtatgtgccacattttcttaatccagtctatcattgttggacatttgggttggttccaagtctttgctattgtgaatagtgccgcaataaacatacgtgtgcatatgtctttatagcagcatgatttataatcctttgggtatatacccagtaatgggatggctgaacagacccccttttcatttctattgttcacacatgcataagcaagaggaaaaaatggaagataagagtctcaggatagtagagaagtcttgttctgtgatcttgggaaaaagacgtccacctcctggatgccatcttcttctggagagaaacttccctggttaggttaaccttaaggtttccaatggatatacagttccaagagtgtggagggacccttctgagttgtgagactatgagcctaaggttcaaggtcctgaagttttccagcagtgtggatggcaagggcagtctttcttggatgttctcagaagatccagcctttgggttctagaatgtgaaggggttgattgtcctcaatcagtgaatcatgaaaatttttctttgctggagtaaatacagtgtggcataatgagctactgttataacagccctcttgcatgagaaagcttttatacaaccagaaaaaaaccattcatttaaaatgacaatggaatagaatctctctataaatatttaaatagcccatcaggtattggaatgtactacctgattgtggataggagttttgattgtctgctcgggaatatggttttaacaaaccaaacattggtcataaaatattttagcaatttagaagtaactatatatatatatatatatatatatatatatatatatatatacacacacacacacacacatacacacacacatatatacacacatatatacatatacatacacacacatatactcatatacatatgtttaatttagatcattttatcttctccatgatgagtcatggaatggagaactttcaataaaaagttttcgggactcagaaaggacaaggcaaccatcagggttctacatgagtccacgcttaacattggatttatgtcctctcgaataccggttgtttctccaatttaggtacatagcactgataactgataggttatcattaggtaatttgacttaaagcatgaagttcattcaaactgtatatttaaacaattttagtactgactgatctagcatgaaaatatggcaaattatttccttggaattcaattaatgtttctattgcttgggttagctgttttataaaccagtaagtcttttcatgaaagttccaggaattcttatccagtccaaattatgtgatttctaaagttatcaaaaacgtgtattcaaaagtgtttctcaggatcctttctgtcctttcatgaaccttaaagacaccatattctaggattctaggcaagaaccatctagtcaaatttaggcatggaaaggcgaaagacatctggtcgaccttaggcatgggaaagggagagccatttggtcaaccataagcataggaaggcaagagacatctgggagaccttagacatggcaaagggaaagccatcagctcagtctcagtcatagaaagagagctatctggtcaatcttaggcatgggaaggcaagaaacatctggtagaccttagacaaggcaaagagagagccatcagctcaatctcaggcatggaaaggggagagccttctgatgaaccttaggcatgggaagggaagagacctctggtagaccttagacgtggcaaagggagaaccatcagatcaatctgagacatggaaagaggagagccatctggtcaaccttagggatgggaaggcaagagacatctggtagacctcagacatggcaaggagagagccatcagctcaatctcaggcatgggaaggggagagccttctggttaaccttaggcatgggaaggcaagagatatctgaaagaacttagacatggcacaggtagagtcatcttgtcaacttttggcatgggaaggcgagagacatctggtccaccttagacgttgcaaggggacagccacctcgtcaacctcagatatgggaaggcgagagacatctggtcaaccttagacattgcaaggagacaaccacctggttgacctcaggcatgggaaggcaagagacaactggtccaccttagactttgcaaggggatagcccccttgtcgacctcaggcatgggaagtcaagagatatatggtcgagctcaggcatgggaatgcgagagacatctggtcaaccatagatatgggaaggtgagagaaatgtggtagaccttcgtcatgggaaggggagagacatctggtatgcttagatagggcaagaggcgagccatctcatcgatctttggctttgggaggcaaaaaatatgtggtggtttttcgatatggcaacacgtgagccatcttgtcaatcagtggctttggaaggtgaaagacgtagtagtctttagccatggcaaggggagagccatctggtcaaccttatgcacgggaaggtgagagacatctggtagatctcagacatggcatgcagagagccaacttgtcaacctttggcatgggaaagagagagacatctggtcgaccttagacattgcaaggggacagccatctggtctacctcagccatgggaaggcgagagatatctggtcgaccttagccttttcaagtggacagccagctggtcgacctcaggcatgggaaggggagagacatatggtcgacctcagtcgtgggaaggcgaggcacatctcgtcgactttagacattgcaagggaatagccacctggtcaatctcaggcatgggaaggcaaaagacatctggtcgaccttagacattgcaaggggacagccacctggtcgacctcaggtatgagatggcgagagacatatgatagatctttgacatgaggaggcctgagctatctggttgaccttagatatgggaaggtgagaaacatctcatagaccttagtcaagggaaggcgagagacatctggtccaccttagacattgcaagggtacagccacctggtcaacctcaggtatgggaaggcgagagacatctggtccaccttagacattgcaaggagacagccacctggttgacctcaggcatgggaaagagagagacatctggtcgaccttagacattgcaaggggacagccacctggtggacctcaggcataggaaggcgagagacttctggtcaacgttagacgttgaaggggacagccacctggtctacctcaggcatgggaaggcgagagacatctggtcgaccttagacattgcaaggggatagccacctggtcgacctcaggtatgggtcagcgagagacatatggtagatctttcacgtgaaaaggcctgagctatctggttgaccttagatatgggaaggtgagagaaatctggtagaacttagtcaagggaaggcgagagacctctggtccaccttagacattgcaagaggacagccacctggtcgacctcaggcatggggcgtcgagagacatatggccaagctcaggcatgggaaggcgagagacatatggtagatctttgacgtgagaaggcctgaactatctggtcgaccttagatatgggcaggtgagagacatctggtagaccttagtcaaaggaaggcgagagatatctggtcaaccttagacattgcaaggggacagccacctggttgacctcaggtgagggaagacgagaaacaaaaatttgcgaattgggcagctttctgatccaaagtcgtcttagagactccagcacagctacatggaggaaaaacatttatagacagaaaaaggaaagtgaggtataaaactagaactgaagtacagaaacgactggattggttatagctcagtgtttgccttatttgaatatggtttgaatatgtggccaccttcggccaaaactcagtgactggcacaagagtaggctacagtctgtttttaactctatttaggtatagtttacgatgtatagagaaacctttaggccaaacataaaatatgtaaggaggaagctttaggctaaacttgatttaaatcttcttttgaggaatgtctattcacatcctttggccgctttttgatgggattatttgctttttttttttcttgctgatttgagttccttgtagactctggatactagtcattttttttggatgcataatttgcaaatattttctcctgctctgtgggtagtctgtttattctgatgattatttattttgctatgcagaagctttttggtttaatgaggtcccatttatatttgtttttgttgcctttgcttttggagtcttagtcatgaattctttgcctaggccaatgttcagaagagattttccaatattatcttcggagatttttatggtttaaggtcttagatttaagtctttgatccacctggagttgatttttatgtacagtgagagacggagatccagttttattcttctacatgtgacatgtggctagccagttttcctagcagcatttaatgaatcgggtgtcctttctccaatttatgtttttttaggctttgttgaagatcagttggcaatatgtatttgggtatatttctgggttctctattctgttctattcgtctaagtgcctatttttatagcactacagtgctgctttggtaactatacccttgtagtacaatttgaagtttgataatgtgattcctccagatttgttctttttgcttagtattgcttaggctttataggcttttgtggttttatataaattttagattttttaaaaaacgaggatggtattttgatataaatttcataaaatctatagattgcttttggcactgtggtcattttcacaatattgattcttcccatccatgagcatgagatgtatttccatttgtttctgtcatccatgtttactttcaatagtgttttgtagttttccttgtagatatctttcacctccttggttaagcattttcctatatatttttatttttcggcagctgttgtaaaagggatggaattattgatttgattgattgcccacttggttgttgttggtgtatagcagtgctactgatctgtgtactttgaatttgtagcctaagacttcgctgaatttgtttatcagatctaggagccttttggatgagtcttcatggttttctaggtatacgaatgtatcagcagcaaacagcaacagtttgactttctcttttccaatttggatgccctttatttccttctcttgccagatttctctgactaggacttccagtactatgttgattagtagggacatggatgaagctggaaaccatcattctcagcaaactatcacaaggacaaaaaaaaccaaacgtagcatgttctcactcataggtgggaattgaacaatgagaacacttggacacaggaaggggaacatcacacaccggggcccgttgtggggtggggggaggggggagggatagcattaggagatacacctaatgtaaatgacgagttaatgggtgcagcacaccaacatggcgcatgtgtacatatgtaacaaacctgcacgttgtgcacaggtaccctagaacttaaagtataattaaaaattaaaaaaaaggaaatggtaaaaatgagaattattgacttgttccaggtctcagggggaatgctttcaatttttccccattcagaataatgttgactgtgggtttgtcatacatgccttttattactttgaagtaaatcgtttctatgcctattttgttgaagtattttatcataacaagattctggattttatcaactgttttttctgcatttattaagaggatcatatggtttttgtctttaattttgtttttgtgatgtattacatttattaacttgcatatgtcaacccatctctgcatgcctgggatgatgagacccacttaatcatgatgtactatttttttgaggtgttgtttgattcagcttatgtcctttcctggttttggtattagagtgatactggctttatagaatactttagcgagtattgtttctttttctttcttttgaaatagtgtctgtagaattggtaccaattcttctttgaatatctggtaaaattcagctgtgaacacatctggtcctggcctttttttgttgactatttttattttatttttactgattgaatcttgctgcttattattggtctattcagggtttctatttcttcctgatttaatctatgtgggttgtacgtttccaggactttatccatttcctctagattttctagtccatgcacgtaaaggtgttcctactagccttgaaaaatattttgtatttctgtggtatttgctgtaatatccccagttttatttttaattgagcatatttggatcttttctcttattttcttggttaatctcacaaatggtctatcaattttatcttttaaaaaatacctttttgtttaatttgcttttgtatttttttgtttcaaattcatttacttctgctctgatctttgttatttcttttcttctgctcgttttgggtttagtttgttcttgtttctctagttgcttgagatatgacattaggttgtcaacttgtgttctttcagacgtttcgatgtatgcatttcatgctatgaacattcctcttagcactgcttctgctgtatcccagaggttttgataacttttgccactgttatcattcctttcaaataatttttaaatttctatcctcatttcattattaaccccaagtcattcaagagcagattatttaatttccatgtatttgtataattttgagggtttctttttttgatttccagttttattcctctgtggtctgagaagatacttaatatatttttaattttcttaaatgtattgagatttgttttgtggcctatcatatggtctatcttggagaatgttccacgtgctgatgaatagaatgtgtattctgcagttgttggaaagagtgttctgtaaatatttgttaagtccttttgttctagggtataggttaagtccattgtgtctttgttgactttctgtcttgatctatctagtgctgtcagtggattattgaaatcccccgctattattgtgttgctgtctatctcatttctaggtctagtagtacttgttttatatatctgggagttccagtgttaggtgcacattaatttaagactgtaatatcttattggactgatcctttatgattatacaatgtcatcttttttactgttgttgatttaacatattttttgtctgatataagaatagctactcttttttgtttttggtttttaatagcatggcacatctttttctacctatttacattgagtttatatgaatccttaagtgttaggcgagtctcttgaagacagcagatatttggttggtggctttttacccattttgccattctgtatctttttaagtggagcacataggccagctttacctgtaattatttctctcaaagacattcctagaatggatcaagtctacatgaaatagtgtgaatgtttttaatattcttgatatatagtgctatattgcttcccataatgattttacctgtttatcatgtcacctgttatggaagcctatatgttaattggtcttactatcatcttcaaaataattcttgctatttttgttatcaaaattttattttcatttgaatttctttattataaataaagttcagtacttttttttagtaattattaggtctgaatctacaactatgtgagctcttcttgggatagggtactggacacatcatatttcaaatgtcattaaagagacctgttacttaagctctgactgattatttttctctttcctatttttctgtactttggtgtatttctaaagagatttgacatctttgatttggccacatactcccaattctttaaaattcttaatgcttctttcagaaagctgtcctaaattttgagaattagtgaaaatagttgcatgccctttccaagtacagactgttatatttacatatacttcattacttcttgaacttgggaaaccactggtcattgcatattttttattaaaatttggaaagcatatggaatgtacataaccgaagttgccttaacatccaggatttaatttatcttgctttattcatttaaaatgttatgtaaggaccttgccaatgtttaagtagatcaactattgtcatcagttgggctagtttctatttgtgttattcctatcatgcgttcctttataattctctacaaaagaccattcttttaaaaatagacatataagattatttttagcaacagtaggaatgacaaatgagtttcacctattgtgcaaacttcaatcaattgatagtagttgccaagtgcacagtattgaggagaattctgaggcttcttcaaagcttactagaaaagatagccatgattttttaatgacacctattacaattggatgtgtgtatgtgtgtgtgtgtgtgtgtgtgtgtaagatagaagttatgtactttccattcctgaatgataattaacctagaatttttaaaactgtaacatcccttaaaatatactaattataattattgtcagattatatgctaaaaagactagcatattgtacctttcctattgcatggaacttaaaatatgcttaataaattttgactacatatgtgtaacttaaactcacaaaaatatgccctgcatatattttaaaagccctgtgtaatagctgatataattctgcatactgggatatatgattttaaagtgagttaataaacatgagcaagtgaaatcattgatatgtttgtgattccatattattttataattacaagataaaactactttaaataacgcttgaatccctaaggatacttaaaccactcaattgagtgtgctaagcttatagtaagtcaaagttgctactcctttagcataatgtattagaaaaaaattaattttaaataatgttttccaaatacttagtttatgttcagaactacagttttccagtttttgtcttgtttttaaacaagggtaaagtaagacacaattgttgtttgatgtcaatatgaagaacatacatgtgttttaaagaggatattggtagtggagcaggaaaaaggggagtgaacaaggtggattagagaaataaagcctatctgagaaatgagatttttgagtttattgtagaaacatagtcagcttagatgactaaggagacagtgtaatgaaagtcaatggagatgtcagtaactgaatacatatgaaataattataatgtggaaattataattattttaagcagtattttcgtgaagaaataataaagcaataaagcattgtttagagtgggctgtaaatttcaagaatagggtattttctctataagcattaagaagctttaaaatgaataaggtagaatgtgaagataattttgctgatttctggccatttgatgcttagtaaatctcacaaaggtgctacttgtttgccgcatgcacataggtgacacattttttaaaaatatttaagactgggaaaagtaatgtagttagccttaaggttaagggtaagacttctgggttcagattttgcctctgccatttaatagctctgcgaccttggacaagttatttaacttctctttacttcaattttctcatctgtaaattaaggatgtacacatgttttaaggaataagtaagttcttatttagaagtcactgtaggggagacagaacttttcttctatcctctgagggtttgataattgcgtctttgaaataaatggacaatagacatattagcaggacaaaagatcccaaatttattacgtgcatgggggcatcacagaaaaagaaaagtgaataccccaaaacccagtgagatatagaagcttatatgccttcttcataagggaaagtcaatgatttggaggaaagataagggggtcgttagaagaatgggtagcagcccgtctgcgagtggtgtagacatccattttcctcacctttaatccaagttaattcttcctggagaaaggaatcatgacaattgcattcattttgtagaatctgtctataggcagataagggaaattcagaaaaatctcctccatgcgtttgctgtttcctgactgccctcagtttgatattcaaagttgtatattttggggtggcatttcctgaactctttcatcacttagaatagtgactgacatgtgacaattcatctataaataatagcaaacccttcatacacaccctcatgtggttagtccttgtaaataatagtatcacctccacacaccaccaccatccctatatgcttaatctctgttgtcaaagaggaaaaaattacttccttccaccctccttgattctttggctgggctacaggagtaagaacatatttaaatgcttgcatccacatgggagttacataaaacataagactcaaagaagagccagatgattaaaacttacataataacatcctgagctacagaaaggaataggtgattgggacttcggaggttgtggtagccacaagttatgggaggttaaggggagaaatgtatggtgcataaagattatcatgtcatgtagtttaaaaaaaaatctcttaggtaataaaagttgtcttgcagcagccctcttcctgatacagatacttttgctaatgtagatttcttttatacatgcaaattttctttacaaaagggtagtttttcagagttactccggtgtctgtagtttctcagaataactagctaaaaatatgccaaagaactctattttggtgtggtatattctggtcttctagagtcatattttgaggtggtgttttctgagccctggcgctggagaatctcattctaacatgtcagtaaatattgggggttagcaggagtggcacagtaatatgagcaaataagattttctctgacctagttattattatatacatttgaaagctaagaaaacaaagactgagagatataagtaattttccccattcacacagcttgaaaatagcagaggcagtttttgaaaccatatgcaacaccgaagctcaagcttcacacacacagcgatgctttctgcccctccagtaccttttggttcaagagaggccagctgttcctaaaaccattcctatccatgatgcaagtaacactgctgagtgctatctggagaaaagataaataaactggagattagtggaagtatattttcagctttttcctcttcctcaactgcttcctgttccttgccctgcaattgctaaaatactcagaatgcctttcctagcctcatcatagctgctaacagttttcctttagtaatgggatgccccccaaggagtctccccttcctgaggtgctgacttataattatattcctgtatcctgcttactgctgccatcagtgtgtacaggttctgttattgtctctttaggagtagcagtagtagtagcagcaacagcagctcaaaccaaagcagtgtccaattaacaagtctcttttcgcttgttcaaatagccgctgttttagcattcagtcccacttgtctcttcatgaaagtgctcatgactgtaaagaagatgcatttcaaatacatacactggataagttgtggaaagacaccaataaaatgcccagtcaacagtccccggtgtgtgatgttccccttcctgttgtggggtggggggaggggggagggatagcattggagatatacctaatgctaaatgatgagttaatgggtgcagcacaccaacatggcacatgtatacatatgtaactaacctgcacgttgtgcacatgtaccctaaaacttaaagtataataataataaaattaaaaaaaaagaaaaaaagaaataaaaatatcaatattggtaaaaataaataaataaataaaaacaaaaataaatacaatgcccagtcagatgtgatcgttatcatttaaggaataaagtagaaaaataatttccaatttagagaaggagaatgtgtgggtaagaaactagaatcctaggttggagttctgaatttgtcatgtactcggtgtgtgataaaagccagtcacctgctcctttctcctaacctaaaatagcttctcttaatgtaattaggtttcttgcaatgaaaaatgggaatcaatcccaatgtcttccttaatatcctgaaaacatttttgtaaggagcaaacagatgaattgtaaagaattatacacatgcacagtgtgatatgtggttgggctataactattttccaagagtgttttgaaaataggagaatagttttcttcttagtaccagcccacgggctgttttcttctaaaaagtatgagtcaggattgtatcttgaaatcctaaatagaacttgggtaagaaacagacaactcagaggaatatgagtaacataattctcgataagtacttgctttttctccaaagatggctaatggtatattattactattcaaaagtctcctgggagaaaaatgcatagatgtttctctgggtaattaaaatgagagttgccaagtaaaggggataacagaaaggtaaaggtaattcaaaacaaagctattggagtgcctgagtaggcagaaatgtaaggtaacagaggaaccacttttacaataggcaaaatgtgcttctggctggcattctgttatgttaatcatgcatctctgccacaccaggatcactgtcctttaaaaatatcctttggagtatgctttgctttctctaagccatcatggaaatcatacatgcttttattattaatacatgtttttcttactgacaataggagtcaaaaatgctagcatatacaaggcaaattttctcaatgataatgtgagtacagagcagatccttcattttcattttgtcaaagtacacctgcatgacacacacccacacatgcgcatgaacacacacacacacacacacgacaaaacatatccctaccattggcaataataacagaggccagaagtcctgccatatcagaagcgtattcactttgtaattcagctcttctccaatcatttacatctttttttaggttagttcagttgttttgaattgaattgacttcaattcaaattcagaattgaagtatgaggaaaatctgacttgttctagacttgagctgccatatacttataggttaccacctaattccttctggacgtttttactattcttaggcttaaattctgtgacacagtcaactacaaaagacatttattggaaaaaactttccaatgatcaatgacacatgtccattaagtatcacaatttttttaactaagagcaatcaaaaacaattaaacttgattttaatggactttttaatgtggtgaatattctttactcaatacctgctatctgtctaagcaaaagaacaacattttaataacgttgtatttctgagtaaacagaatcataagaatatgctgtaacatattattggaatgaaaagttttaatctcaagattatagttcagacttaaaaaaataattcttatttcatgtatgtcattcaaagataaaatcttctccaataaaattatcagatgtttcaatttgaattttaggtggaaatataaaaccccatgtacaatactaaaaacaaaataaagtaaaaaaaaaaaaaagctatggtgattccactatctatggttatgtagaagcaagctgacttcatttccctttctctcctgcaaaaccaaatacgaattcactctgccaaggttaccaacaacaatatcctggaaataaaatatgagatgagacagttttcaaggctgcaaatgtaaatttgagttaatattagaaactatataatatgtagcatgaataggacaatggaaaaatatgaaaatgtagataattattaaaaggtattaaactttctataaaaccaggaagatgacaatttaaaaatgaatcatttttaaatgactgaaaaatatctttcaggcaattgccacagtacatgtactgtggaaatactatcaacattcctatgcaagtcgggaataagacaaaaacacataccaggactaaacttatttggcattactctgaaaattaaagctaacataagatatcagacatctggagacaatattattattaattgaagatcatttgaatatttaccaaaacaaaatacaacaaaaccaaagcaagataattcattgataaagtacgagaaatcagaaataagacttccactaaggcagcaattcccaaagtgtggtccccagaccagcagcgtcagcatcacctgagcattgttagaataccaattttcattttaactggggtgagatgatagctcattgtagttttgatttgcatttctctgatgatcaatgatgttgagcacattttcgtatacctgtttgcaatgtgtatgtcttgaacttatggacataaagagtagaaggatggttaccagaggctgggaagggtagtggggtattgtaggggaggtgtggatagttaatgggtacaaaaaatataaaggatgaataagatctactacttggtagcacaatagggtgacagtaataaagaataatgtaattatatgttttaaaataacttaaagaatgtaattggatcatttgtaactcaaaggataaatgcttgagggagtggacaccccattctccataatgttcttattttacactgcatccctgtatcaaaatatctcctgtatctccattaatatatatgtgattacctaatatgtacccacaagcaattttaaaaaaatcttaaaaaattttaaaaagaaatctgaacattggtccagaatctaccccaggtctgttgaatcagagactctggggctgaggcccagaaagctatgacttaagaagccccatcacgtgattagggctcatgttaataattccagaaccagtgatctaaagcaatagatataaaaaatgaggaaagccttctctgtttcctcaaaataatcagtgaaaaatataatggaaaatatctcattctcaatgatgtagtattgccagatttaaccaaaaggaaaaaagtcattcaggcaacccaattaaatttgaatttcagaaaatcaatgcataatttcagaaaaacaactctaccaataaaatcaaaatgtaaaattccaagagtaaacataacaaggaatgtgtagagcatatatgaaaaaaaactataaattttactagaggaaagaatgacaaaaaagataacacagtttttgagcacttaccgtatgctggatgctgttcaaactacttcaaactgcatttcaaactacatgtattaactcatttaatcctttcagcaatactgcgaggtgggtacaacttaattgttgagggaatttagtcacagagtatttaaatatcatagcaagctcccatagatacaaaataaaccttatattaataaagatatattatagccttagattgtaagactcaatattgtaaagatatccattcttcacaaatacatttataaatttaacatgactccagagaaaaatcaaaatggaatttctatacttgacaaaaatgtcaaggttcatctaaacaaataaatatattagaccagccaggacatgtttgagaaataataaatgcaaaacttctgtatcatattaataactaaagtaaattgtgatagtgagacttcataagaatacagatacctatcaatggaagaggatactatagaatagaaaaaacaggaagaaatacaccagaaggttagcagtagttttatatggtgaggatttgtgtaatttaaattattttccattgcactttcctggttttcaattgtttaatgaatattttgtatttttgtatcttatatttttagggaagaaaaaaggttttaccctaaagaaagcaaaaccaggccaggcgcggtggctcacgcctgaaatctcagcattttgggaggccgaggcaggtggatcttacttttcaaatcaaatggccttgattttttctgtttttccagggtctctaggaaggcctggagtagagtgatcctgattttaaccaacttctctgtctgggtgtattactggaatctcaaactctcaataagtccaacatatatatcttgagctttttctaaatgagccagtatttgtgcataacatgtaactaacatatatttttctcacttaaattatccatcaatgttgcgagatatttgctctgtattagtacattcttgcattgctatgaagacatatctaagactgggtaatttataaagaaaagggatttaattggctcgcggttctgcaggctatacaggaagtacagtggcatctgcttctgaggaggtctcagggagcttttactcattgcagaaggcaaagggggagccaacacttcacatggaaaaagaagcaggaagagagggtggaggtgctacatatttttaaacaaccagatctcgtgatagctcattcactatcataagaatatcaccaaggggatggtggtaaaccattcagaagaaaccacctccatgattcaatcacctcccgcgaggacccacctccaatattggggattaaaatctgacatgagatttgggcggggacacagatccaaaccatatcatgctctaattagacacttaaagatcaaaaacaagcaaacaaatgaaaagcagaggctcaagatgcttaaataatttgcctaagttgtgaatggcaaaattgggattcagacccaatcaagtcctcagtgtgattccattctgctatcaaaattgtactctctcatctctggacctgcttctgttgatgtattctctctcttgacagatgataccaatgttcagcctgaccaccaagtcagtctaaacagcagtcaccctcaattccttcttccccctccatctcatcctccaaatgcagtcactagatcttgttaagtctattgagattttccaaatttctactctgcttacttctctgttacttccattacttttgctgctgaatttaatcatttctctgcccttgtctagactgtctagatttctacgtggtctttctcccctacttttcattctccacactgaagccgatatataaatcttacttttccacttcatgatccaaacccttcaatagattcccattacctagggaatttaaattcactagcctggcacctaagaccctttgttgtctagcccctatcaacctatcttagtctttttggtctgctacaacaaagtatcataaactgggcagcatataaagaacagaaatgtatttattatctggaagttgaaaagtccaagctcaaagcaccttagatttggtttctgatgagaatccactttctagctcagagataacatcttgtaggagtgtcctcacatggtagaaggagtgacagttctctttggggccttattgtataagatcactaagcccattcatgaaagctcccccttcatgacataatcacccccaaagattccatcttctaataccattgccttgggttaggatttcagcatatgaataggggagagcacaaacattcagaccaaagtatagcctctgcaaccccaagaggccctactctcccatgtgcaacatggatttcagccataccagtcacttgcagatccttgaatgaacacaccagattgtcactccttttccatttacgcatgcaggagtgtttttcaaatacacatatttttgacatccttctgtattagttcattttcccactttcacactgctaataaagacataccggaggttgagtaatttataaaggaaaaaggtgtaactgactcacaattcagcatggctggagaggcctcacaatcatggtggaagatgaaggaagagcaaagggatgtcttacatggcagccagcaaaaagaaaatgagaatgaagtgaaagagattccccttgtaaaactatcagatcttgtgagacttactcattaccatgagaacagcataggggaagccaccgtcatgattcaattacctcccaccgggtccctcgtacgacatatggatattatgggagctataattcaagatgagatttgggtggggacacagccaaaccatatcaccttccctgccctgtcttcttggaaaatcctttttcattctttaagagttaactccaataataacttcttggaaattgctctaacctcctcagacaaaataagacccaccctctcatgtgtttgcacagtagccgacagtttttttttttttccttgcagagtatagtgaaaagagaataggctttccaatatctactctctttcaaatcacaggagtagggcctgtacccagaaattgttgtttactaactgtagcatcttgggcaaattatctctacatgggatttaatgagacttcttaaaagcaatttgaccaaaatgttgatccattggcttctccactttaagactaaaaatgaaatcattcttgactgaataggtagaaagttatttatgttagaagttttttgtttgtttattttccagaagagatagctgcatttctattaagttttcaagacactcatcattcctgaatcctttctatctagccattcacattcctacctgtttttttgtttacaaatgttttcttctatttaacaaaatggatttacaatcatatttctcatagatttcttgctttgaaacactttaattagtactcattatttaccagacacaaaaaaagacagcaataagggccataaaatcaaagagaagtacatttctcaggaagtctaatggagggagactccaaatttttaatccaatggatgctagtggaatattaatgagcctagagggttgtgttaatattgatctagtcccataactcaatttcccatcccacctcatggcttataaaaattcaagacacatagtagttcttaattattctcttggagattttcttccaataaccaaagctatccccaggtcagagaaggattgctccaagaggtatttctcttaattcgccaaaggtagagattcgggggacaagtgagtcagtgtctatctccacatcatacctatgacttctgttttatgtaccagtgtttctcattaaatttcataattgaagcatactgatttttccctttagaatacatttggtaagatagtgagtgtctccatctaaaggtgggagtttcaaaaacacatcaaatgttttcttatatttactagctctgtaatctcataagcatgtggcagtatctcaagttgagacaagattatttcctctgtgttcagacatttatggaaaaggaatagcatagtggtagagaacatacattttagagtcactaagacctctattcaaattttacctctgtagctataatgcccaagagttcagtttacttctctgaacttcatcacacaaaagtctttaaagtatcggccgggtgtggttgctgacgcctataatcccagcactttgggaggccaaggtgggcggatcacctgaggtcgggagttcaagaccagcctgaccaacatggagaaaccccgtcactactaaaaacacaaaattagctgggtgtggtggcacatgcctgtaatcccatctacttgggaggctgaggcaggagaatttcttgaacccgggaggtggaggttgcggtgagctgagatcacatcattgtgctccagcctgggcaacaagagcaaaactcctccatctcaaaaaaaaaaaaaatctttaaagtatccacctacttcatattatattcaatgagggttatgttattgcactcaatgcatggcttcataataatgacagtagctaatatttattgggggttactactatgacctaatgtttggaaaacactggcctaactattccatgagaagtgagaaataagaaaggaacagaaatcccatctggaatgtgttgctgagcaaggttgttcaggagacacatggcataaatgctgcttgtatgagatataatttcagagtgagatattttaggattgtgggaaagaatatgggatagcctcagttttatagataagggctgattgaagctgctgaaaggcaaggtcaaaatatgaaaggagattaagccctgccctgtgccattgctccttggattgtgcacctctgttgagacttccctgaaagttaagtaaaccagtgtcatggtaggcaacattaagtaaccgattccttaagaaaagtgaattccagctgtctagtaacaggggctagggagagagtgattggcaatcaaggtcaggaacaggagtaagttgaaatcccgtcccttaggtgaattactgcgtatgtacagagtacagaaaaaagaaagcaaaagctaatatcctcaggataattggacatgggcgagacagaaggatgagcacatatctgatggaaaatcatttggccgcagattctcttctgaaacatcctgtgaagtaagtactgaaggcattggatcaaattctttcaagtgtgtacttagcatgaggctgctgctggctatgctgtttacagagtaaaccaagaacaaagtagccaatctcaggcctctgcctagtgcagagttttgcatttgaaatgtctagtaatgtatgaggcttggagaggatgtttgacagctagtgcttattgttttagaagggactcactctttcttgggtggtaggcagatctattaacttggaaggaatattccaattatgtcctttagttcaggctgctgctgtaagggttgaagatcagatagataagttacacagacgccaacttcagatttcattttggtagctggacttccctctgctagatggagatatcccctaggaagaatgaatgacaggcagtgaaaagaagatgcctaaagaaaacgtgagcattcacattggaaagagagttcagtatattgctagaaagtcttatgtagagagaagggaatgtattgagattgtagattcacaaataaacacacccaatgtctttctgcatttcagatattaagcttgaaacctcatataacaataaaggtcacaatttctgttttaaacaagtataccacctacgactaatctgagtcgtaggctaattaaaaaaaagcaagctagaaaagagtggcagagaaactcttcctctagacttcgtcttttgaccaaattcacaaccatttagaggcagatggaaaggtaaacaatgtctagtctcattttacacacaggtgacatggggcttaagtgagcacagcacagcagttatgagcatttatgaggcccaggagcctcatgcaaatcccaggtccaaacctcacaaactgtgtgagcttgggaatgccctatgagttttctgatctttgtctctcaggtgggtcaaatgagctagagtctgatgcagtgcctgacaggcaaaggtggcaggtgcctgtcgacagggatctagctgtcagtctttgtttcctcagcgaagcgctgcattctggagttcccgagtctgtgttctttcctctcccctgaacgtccaggaaccacaagcaactccccagcttccttcctgaggccaggttgaggcactgctgcttgtgccacagtcagcaagtgaccagggagcagtgctggatggcctctgcatgggagaataaccttgcccggcactggaatgcagggcttgaatgagccacagtggagcgcttaagtataaaaagagaggcaggtgagtctcggcaatctgaggcagaaactatccctagagagggagttagttgtccaagtcccatgagagaaaagtgacaatgtgcaggtgatagcatggcaaggtaacagtggggaggatagagggagggcagcagtgtattggggtgcaggacgtggtgggtgcatggagaagtgaggtttcaatccactccgcttcaaccacactggactccttactgtccctggatcatgccgggctcagtctctgattagggcctttgcactgcctgcttcttcatcctgggatcattcttccctatacatccatggcactgagcctctttcaagtcaaatgccaccttttcattgaggcctatacgggccaccctttttgttttgttttgtttctttttttttattttactttaagttctgggatacatgtacagaatgtgcaggtttgttttcatacacatacaacatacacacatgcatgtgtatataccaaagcagaatatgtcatcgtaaactttgatattccattgttagtaatgttaattgtgtcacaagaatgacatactccaataatttagaaccactgccattctctagtgcatagagaaacaaattaagcatgcacctctgttctctagaagctcatagtccaccgagggaaacacagacattaatattaaagccaatgcaagcaagaatgtactcagtgctacactagacctacaaacagagccctgtgaaaaaagaatagatgaatcctgactttaaacatctggaaagacttattggaggagataggattttaaccaggacttggtaaatgtgtaggaacttgaaaggtagatagatgatgttatcaacttctttgtatgcctgtcttactttccagtttggacaaaaggcatatctgaatttcaaggtcatggaaacatttttcattgagggaacactggactaaaggttcagacaggagtgattcagagatactgaaattggaatgatcaagtttccttacatattttttactttttttttctttgttgttgttgtttgttttgttcactttcccttagaattggacaggagccagggattctgagtggaagcactttctaggaatcaaaattgcacaggtggttggctttttattcgtcatgaacctcctggtgtttgaacataacaaatgggtacaggagcacaagaaacctcccaggagtttatatacatgagtttatgtctaaagatattgtaccttagattctctgtaagtaacaataaatgaatgtaatgtggtagaatcaaatagaaaaaacatgctgcccggtcaccctgtttgatgaaagctctggaagacctaaagatatttctgtgactagattacattacgggtcaaagaaatataactctaagattctacctatctattactataactgacaatgactaattatacccataactatttataattttatatatatatatatatatatatatatatatatatatatatatatccatgaggaaatacacccattgtcaataataattagtcaaatctatagctaatcaaaacctcaattcttgacttctgtgtactcacaggctcaataccacgtggaagctgccaaggcttgtggcttccaccctctgaagcaacagcccaagctgtaccttggcacattttagtcatggctggagtggctgagacacagggcacaaagtccataggctgtacaaagcatggggaccctgagcttggcccacgaaaccactttttactcccgagcctccaggcctgtgatggaaggggctgccatgaaacctctgacatgccctggagatctttccccattgtcctgaggattaacatttggctcctttttacttttgcaaatttctgcagccagcttggatttctcctcagaaatgggattttcttttttattgcaatatcaggctgcaaattttctgaacttttatgctctgcttcccttataaaattgaatgccttaacagcaccaaagtcacttcttgactgttttgctgcttagaaatttcttctgccagatgtcaaaaataatctctctaaagttcaaagttccacacatctctagggcaggggcagaatgccatagtgtctttgctaaaacataacgggagtcacctttgctccagttcccaacaagttcctcatctccatctgaaaccaactcagcctggactttattgtccatatcactatcagcattttgggcaaagccattcaacaagtctctaggaagttccaaactttcccacattttcctgtcttcttctgagccctccaaactgttccaacctctgcctgttatccagttccaaagtggcttccacattttcaggtatgttttcagcagcccccggctctactggtaccaatttactgtattagtccttattcacgctgctgataaagacatacttgagactgagcaatttatacagggtttaatggacttacagtttcatgtggcttgggaggcctcacaatcgtggtggaaggcaaggaggagaatcttatgtggatgacagcaggcaaagagagagcttgtgcaggagactcccatttttaaaaccatcagatctcgtgagacccattcgctatcacaagaacagcatgggaaagaccagcccccatgattcagtcatttcccactgggtccctcccacaacacatgagaattatgtgatctacaagatgagatttaggtggggacgcagagccaaaccacatcattgagcctctgtgacatgtagcagccctacagggaactgccaacaaaattagttttaaaaaggcttgtccaggaagcatacatgggagctggtcactttgctctttcagccctcatagaggtgcttagacctctggagagagacactgagacaggtaagagggcagaaatgactaagaggtaacacactgtggagtcccaaaaccagcacacgcttcagcccacaaaaagcctaggccacagctctgttcctccttttaagaaagaaaagtgggaaacaaataatctatgaatgaggagaaaacaaggagaatgttccccttttgggcaccctgttgcttttatggttctacctgctggaatttgtgttagatggaaataatgatctttgtgcacatttacaccaagaaaaaagagtcctaaggtcgacccacaaactatagagttcctaagttctctttttctctattttcttttctgcctgctttaaagctgctgttggctttctgcttagatacaatccactatttgcatccaaccatttcttcctgttactattttgcaaaccaatgagtttgtattaatatctcatgactagagttctgaagtaaaagctataggatctttggttgtatgagtatgtatgtgtgtgtttatgtatacatacatgtatttcattgcgttttggccagaaggtacaaatttggcttaaagagttgtcttggtcagttttcacactgctgtaaagaacttcactgaaactggataatttataaaggaaagaggtttaattgactcacagttccatatggctggggtggcctcaggaaaattgcaatcatagtagaaggtgaaaaggaaacaggcaccttcttcacaaggtggcaggagagagaagtgagagtgcgggaaaaaaatactgccacttttaaaaccatcagatctcctgataactcactatcatgagaatagcatgggggaatctgcccccatagtccaatcatctccctccaggtctctccctagacaaagaagattatgggtattataattcaaggtgagatttgggtggagacacaaggcctaaccatattgttccattcctagcccctcccaaatctcatgtcctcacatttcaaaacttatcatgccttcccaacagcccctcaaagtcttaactcattccagcattaacttaaaagtccaagtccaaaatctcatctgagacaagttccttccacctatgatcctgtaaaataaaaataaaaaaccagtaagttacatccaagaaacaaagggggtacaggcattgggtaaatgtttccattccaagtgggagaaatttgtcaaaacaaaggggtcacagacctcaaggaagtctgaaatccaacagggcagtcattaaatcttaaagctccaaaataattttctttgactccatgtcttacatatagggcatgctaatgcaaggggtagacttgcacagccttgagcagctctgtctctgtggctctgcatggtacagcctccatccctggctgctttcatggctggtgttgagtgtctgcagcttttcctagcacacggtgcaaatatcagtggatctaccattttggggtctggaagagggttgcccttttctcacagctctactaggcaatgctgctgtggggactctgtgtgggggctcaaacctcacatttcttttctgcaccaccctagaagagattctccatgagagctctgcctccgtagcagacttctgcctggagatccaggcgtgtccatatagcctctgatacctaggaagttctcgaacctcaattcttgtcttctgtgcacccgcaggctcaacactatatggaggccaccaaggcttggactttgcaccctctgaagcaattgacccaggtgtactttggcaccttttagccacagctggagctggaggggctaggatgcaggacaccaagtcacgaggctgcacagagcaggggggccctgggcttgactgacaaaaccatttttttcctcctatgcctcaatgcctgtggtaggagtggctgctgccaagacctctgacatgccctggagacattttccccattgtcttggcaatttacatttggctcctggttacttatgcaaatttctgcagcaggcttaaatttctccatagaaaataggtttttcttttctatcacataatcaggctgcaaacttttcaaacttttatgctctgcttccttttcgaacataagtcccaatttcagatcatgtctctcaagttctaagttccacaggtctctagggcaagggcaaaatgccaccagtctctttgctaaagcacaacaagagtgacctttgcttcggttctcgagaaattcctcatctcggtctgagactaccccagcctggactttattgtccacatcattatcagcattttagtcaaaaccattcaagaagtttataggaagttccaaactttcccacatcttcctatcttcttttgagccctccaaactgtttcaccctctgactgttatccagttccaatgtaacttccacatgttcaaattatcttttctttatagcagtaccccactctctgcagtaccaatttactttattagtcaattttcacactgctataaagaacttccctgagactgggtagtttatgaaggaaagaggtttaactgactcacagttccatatggctgaggaggcctcagaaaacttacaatcatggtgaaaggcataggggaagcaggcaccttcttctcaaggtggcaggagagagaagtgagagtacaggaaaaaactgtcacttttgaaatgactggatctcgtgagaattcactcactatcatgagaacagcatgggggaaaccatccccatgatccaataacttttctccctcagcccatcaggactgcagttcccttccttgacatgtgggtattacaattcgatgtgagatttgggtggggacacagggccaatccatatcaagagtactcataaattaaataataaacccagatgctcttcaagttcatgtgatgtaagtaaaagttttaataagctagccttaaaattattggtaaagtaatactagaaatgtctcaagaattttcagtatacatttttgtttgcatttattgttcaagcaatttcatactcattcctgccaaacactagaagtgtcaaaatttggcataagggatacaaaactatagaccaagcccaaaacagaaggatcttttcttgtataatttttgataaataagacattaatattggtttaatgaaaatagttaaatattgaattattctgtaaaacaaccatatatttaatcttaaggttgctacataggtaaacacctgaaattcacaggctttaaaatgggtgacaatgaagtaactgtaaccacccaatgagttcaccttgcccactgcctagaaagggctgatttatcaagacaggggaattataataaagaagagtaattcatgcagagccactatgcagtacacctgagttttattattactgaaatcagtatcctcgagaattttgggatcagagtttttatggacactttagtgctcaggggaccagtgaatcaggagttctgactggttgggtcagagatgaaatcatagaaaatagaaactatcctcctacactgattcaagaccagatgagccagatcattcattgatctgggaggtgccagtaggtcagtggagtgcagaatctgtaaaatatctcaagcactgatcttacattttagaatagtgatattatccccaagaacagtttggggagatttagaatctcacagcctccagaggcatagctcctaaaccatgatttctaatcttgtggctttaggcagtctagtccccaggcaggaagagggtttgtttttggaaaggacagttatcatctttgttttaaagcaaaactataaactaagttcctcccaaagttagttggacctatgcccagaaataaaaggacagcctcgtggttagaagcaagatagagtccattaggtcaaatttatttcactgtctcagttttgcatggcattttcataacataaataatgactattatagttttcataaacaatctaagctattaaaataattcagtaaatgtaatgggataaatacttgtagacaaacttgtcctcatttagaatctaaagtgatattaagttaaatcattgatatttcattacttggatattttccaataaaatatattgtagaaaaacatcgtttctagaagaatgtgtgtcctttttaaaaggtgaataactcttgtctaattcaaagcttatttaaaggttatatataaaacaaggtaaaaggaaccgagaagtaagagagatatagagaaaattatggaaataaagaagtatttttggtaagaaagcttaaagaaaaataattttatatgagaaagaatctcgtatggtaaattttgtcctaaaagaaaatgactggttgtttaagaaagagagatgttcaggacaaaccaaaaaatccaagcatgtcatgaatgatctgtataagtcataataagaacatttattaaaaatacttttatatgattgaattgtctagaattaaagggaaattataatggtctttctggagattgggtttgattaaaaaacttatgtgctaaagaattggttcaaactatgaaattttctaagatgttgctttgatcttaataaattaaaagacaatgtaatttttttaatgcaaagttcaacttttattaagtctcactattttcaactttctctcccattttaaaaggcctgaaagaaaaactctattttttaactcactttcagctcctggaatttttttcctttcacgttctaactgttgtggcctaatgctaaaaaacaaacaaacaaaaaaattatgtcttaaaaagtttaaagaaaatgtttccttccaacataatattctccatagggaacagcagtaacactgcagaagatcttttcttttgccttttggtaactggcctaataaacagatcttacactctatcaaaataattgcgatgttattactaagtttgacttgcttagaaataactgaaataaaaaaatacagaagtttattacatccatgtaactttctgtttgtgcttttaaagtctttgtgccattaagttacagggctttgactcctgagtctaaaaagtacattacgtcctgctaaatcttaaactgacagcagttaaagcctcatcttcagacccagtagaagatgccaatcaaaataaactgcattcatgagacacagggccagaaattaaagctattcaacttctgaaagcccagggactatcacggaagaggtgggttcatgagattgtaagggccaattttgagaaataaaataagttcagtttctctataaattaaccattaaggttgaaggcacaatgatgcaagacaaccatatggacttcagagtaatatggcctacgtcaattttccaggattgttctttctttgtttttgtttttctcccttcctccccttattttctctttataggacgtgagacttcacaccctgctaaaaatgagctttcctaacaatgtggggcctacctgtcaaggaaaaaaacatcttagccatgagagatcaggtgaaacctgagagcagagacacattttattctaaaatgctttctctgatagattttaaaaagaaaagaggggaaatgtgaaaggaaaataaatcttgggaccccaaaatcactaaggcaaagggaaaaatcaagcttggagctgcttaaggcaagcctgcctctgattctattcctaaaaaagatagctactaagatttttttaaaaaaggctacataccaccctcacagggaatttccatgtgtacaaaggacagacagacctcaaagttatccctctgctcactgagataaattcatatctggttgtctcctttggaaaggctaatcaaaaactcaaaggaatgtaaccatttatctcttacctatcaatggccagaaagccccctcaccgttttgagttgtcccacctttccagaaggaatcaatgtatatcttacatatatttgattgctgatgtctcatgtctgcctcaaatgtatgaaacgaagttgtgtcctgaccaccttgggcacaggtcattagtacctcctgaggctgtgtcacaagcacacatccttaacattagcaaaataaacttcctaaattgactgagaccttctcagatatttggggttcacagttccctcctccatcttcaacgccaacagtggtgagctgaatccctctcatgatgccatctctcagattctctttctttccttttagggacctatggaactacatggggtctaccagataatctgggataatttcctcatctcttatgattcttaaattaatcgcatctgcaattcctcttctgatatgtaacaacattcacaggctttggggattagggtgtggaaatatttgggtggacattattctgagtaccacaggttcttattaccttacagatgaaaaactggggctcaaagaaatttagcaatttgcccaagtggtaaatattgaggcttcaattcaatcctagtctggcctctagagatgctatagtaatcagttcaaggtgagggtacagtgagagaaccataattctgcccactgattctcattctccctctgttcctgattctctttgcaaccattaatagttatttaagtttccattagattttattgtatctcaccattacaactgaatgtgaatttcactctagcaggacttcaaggattttggtaagcacagaatgtttcctgaggaatattttcaattccaagcaggtctagacaggtacaaaacacctgtgcctgtttaggggattcagaatagattgccaccttcacaaatatctaaaagactaggaaaagaaaaacaggaacataggctctggctctgagtttgctgaagttctcagataacattatcagctttcttggtctttgacagtaccccaagatccatgtcagagcatgaaagcagaggacagaagtctagaaaacccttatctaatgcagtattttaaaaaatatgtattattctttacatgtgtctctctacttagtattcttcagagtcttttcaccagccaggttacaaactcttgagtgtcttctggaattaaaatatctgtgtattttagagcaataaaggaaaaactgaacagccatatctggaaacataatatttgcttaatgaaggttagtctttctctcagtctctggacagtcttctttgtgtctcaacagttgcatttcctggagggcagtcatcattataaattcaagtgacttttataaaaactcatttaagaacaaactcagaaattagtgcacatgtaattcatgtatttacttgaacacaagtagcataatgacgactagtgatgtataactccagagtccagtactacatagttgttagcaatttatacagttgaacaaatgtaagtagaaattaatcatacactatgcagataatctatcccaggcctccttttccacctttactatagggcttaagatgtgcagcctctcaaatccgaagacgtttaaatgatttaactgaatacctatttaagcccacagtagaaataaacctatttaaccctaaaagctggtggaggaactctagtaactatagttaacatatgtgttatggactacctgcatactgaagcatatgctttcaaaataattatctataaaacagatctgattttttcattggttgtcatgataccatcagtgaagcgttctctggggaaatgaaccaactggtgaatgatttctttggttttgttttatttgatgaggaaggcatggtcccaatctagtcctttattttttatttgcaatgtttttagaattggcaatattgcactaaaaattgcaacactacactaaaaaacatagtatatgcatccttcggcatcttctcttgcccctttctgtaagaaagggactaaaatttgtatcagtcattgtcgattcttgtattagcatgggaggaagaagaggttgaaataattgattgaataaatgattggctaaaatcaagtacagtatgtggatttcagctaactggttttttacctcatttaaatactctctgcaagataacctaatacctcccatatataagaattgcttgtgtaaaattgaaagccatatggaaaaatcattgatctatgtgtgttttattatgtaatattttcgtctaactataaaataaaatgtatgggagaaagcttgacacataaaatttcttttgaacataaaagcaagaaatatcaagaatgtttccctaatataaaggctttctgcttttgctttttatcttagaataatgatggaataaattgcagctagagaagtgaagatgaaagagaactaatccataagcgaggagttgtaacatcagaaggactgttgcagattaccctgacccctacagtctgccaaaggaaaatgcagtgcctggataagtgtcctgcatatattcatatgccaatttctcaataatgatttccccagattttaatactggtgtagaataaaatcccttttgtttttttattcaaatagagtcatgaaatattggaagtcacaattagcatgcaggataagttgatagctaaaataatcatagtattttagtttaaattcttccatttgaaaaagtatttagccctgaatcataaaaacttttaaagacatagagaaataggactgtggtggggtgaggggaggggggagggatagcattaggagatatacctaatgctaaatgacgagttaatgggtgcagcacaccaacatggcacatatatacatatgtaacaaacctgcacgttgtgcacatgtactctaaaacttaaagtataataataataataataataataataataaaagagaaatagaagccaagggctcctcacacttttccattatataatgcagctatcttttaaatttgctttcttcttaactagaaggtctagtatggcattcaatctgagaagtaatcggctttcttttcctaagctttttacaaaggaaaacctgtgaacaatggagtttcctaaagatggagttagtgagtgttcaacatatgttttttgataagtgaatgcactggtctaggctctgggataaaagctaagttcacaaatggatatactagcatagttttcatttttaaagaatgtatatgatagtggggagagaaggcacataagacataagcagataactgtaatttctaatgtttcaataaagacacaaggtagatgtctgcagcacagaggagaatttttttttctggagacggagtctcgctgtatttcccaggctggagtgcagtggtttgatctcggctcactgcaacctctgcctctcgggttccggttctcctgcctcagcctcccaagtagctgggagtacaggcatgccccaccacgcccggctaatttttgtatttttagtagagatggggtttcaccatattggccagacttgtttcaaactcctgacttcaaatgacccacccgcctaagcctcgcagagtgctgagattatgagcgtgagccaccgcgcctggttgagaagtacttattcttgatttaaactgaaaaatgagtggtttctaatgaaattaaagtaggtaacattgttaaggtatgttagaaatttgctattttcttttaaagtatctagttataagtagtctttctcttggtaaaagttgagtttaagagttgtaaaataaaactaagcatatgaattatattactattgctcttagttgacttctaaatagtatctatatcaagctaaacaggtatagcaagtgtatattgttgttgttgttgtttgatatgtgtatagatttgatttgtttttgtgagcactgttgaccccaactcattcaagtatccaatcacggtgattttattaatatactaatatatacttattaatatactcactggtgagctgactcatataactttccagccagaaaacagagtgacttgctttttttacactattttctttttactgtcttcgtttttctgttcatgtcctttgattcacatcttaccaccctggtaactcatgagatactcatcattatccaggaaaggatattctacttcctctcttccaaaatgctcaaagtttgagtgtcccagagcttagttctttattcacttctttttgctttctacactgactacctaggcgatttcagattcatagatttaactgttctttatatgctactgcctttcaaatttgacatatcttttgaacacatattcctatgtgcaatttcctacttgacatttcctcttgtcgaaaaatgaactctgagttatttcccccagtactgtttcttcaccttaataaatggcatcaccattcacccagtttctcaggacaaatgtgttgccatcctttatgactttcctcagcaccaccaccactatccagtgcatcagcaaattttgttggctctaacatcaaactatattccatagtatattatgttattcaagattataaacttattgtaaatgtatcatttctataaccatttctactgcctgctcactagtaggagcaaccatcctattttcccttgactattgtaataatccacactgaatactttattcatgttagttcagtctttggagtcaaggagttgtaagtctgatcattttaattgtgaaatgagtgctcaaggtggaatggaggccaagaaaattggaagtgagaaggtcaagtagctaagagtccagggtgtagtagtgtcatctgtatggattttgaaatagccaaattgatgataatcatatgattagagagcaacatagagaacaaggtgctgaaatctagaacatgaaatgagtgagagggaaaacccttggtcccatgtatttgcacttgctctacttccctcataactctcataacgctatacttgttcatgggttctttgcctttcagatttagctctttgttaatgacctcactccctgcattgttttcagttcacattcctcagaacaaggagcagatcagctctgtctattcatgtttaggtggtcattttttcagtgtgtggcaggccatatcacagtttgccctttgctcatgttcctacctctgatctgcttaactgtagccaaacagtgaaaaggaatgacagagcaaggataaagggatcatgactacctagcgttgtaccttcagcaaaaattagattgaggggtttatcttatacactaaagctttgaaagcactttagacacgacacacaataattgaaatctctatataatggggttgtgccagagactgtggtagtgaaacagcagagatgaggtgggcagtatggggaagtcattttataaattcctagcatacatgtactgtcatcttaattgaagaaaacaaaaaacctgataatgtatataattacatatatttaatatatgcatatatatacacacaaactatatacaatttttatttatcaaatgtgtgcccaaaaacgcttaaaataaaaagagagaaaagcaaactgagtatatacatgactttacttggtgcttgatgcatcctagatattaaaatgtgctttgattcctacttccattcaatcaccgagtgtttattacgcagtcactctctgctgggtatttgtatttgatgagtagtgagtccatgtaaggataattaggaattctgtggctctgggaccaaaaccttacttgctttctcaactcaggcaaagataactagatcctcactcattaagaaggatcagcaatgctatataaatgattcctcttactgcacttgcccttaatataaagtaaaaggatggatagcacacttacttcattggaaattagaaagattaattaagtcaggaagcagtgctttgaagacgaaagtgattcctgagtgttaaagtgctagataagtatccagcagttgcagggacgatgcagtctgcaatagtgtgccaggaattgaaggcacaccataatgctttagaattacaaaaggcatttgctgaaaattcaactgagacaatgaacagcttgatagccttgggtttctgataaagtatcattctgttttcaagtatatggtatccaacagaaaatacaaacatacgtcttaaggataaaatgagatttaagtggacaagatgaataaagtgtaaaaccccatcatggtgtatatcctaatgttcagaacatgcgtgaggaaaaagacctatattgcatcacctgatttgagtgatacaaactagaacaaaggagtttggaggcagagttgaatgcacatcaaagatgctccccagatctgagaaatttgataagataaaggttgaaaaatggagaacattgatttggaaaggtgccataaatatttcttgcgtgattgcaaggggtgggaaaataaatggaggaatgatacatgattgtacattgtttgctcatttatttttttgattgcctacttttaaaaatttatcctaagtgttatcacttgaattgtgcctccctctggaaaaaaacataaacaaataaataaaataaataaaataaaaaaagttgaagttccaaccctcagtagaatttcacctaaagttacctttgaatgtcactatatttgcgattgaaacttcccagatgatttagttgtgattaggtcattagggaagactctactctgatatgactggtgcccttctataaaagggaaaatttggacacagagacacacccacaaaagaagaatatcatgtgaacatgaaggcagaaatcaatgtgatgcctaatgatgtcagagatcaccggcaaccatcagcagctgggaaagaggcatggaacagatcccccctcacagccctcagaagggaaccaaccctgccaaccctttgccctccagcatctacccttcagaaccgtgaggcaacacatgtctgttgttttaagccatccagtttgtggtactttgttagggcagccctacaaaatgaggacgcctaggatagtgaaatatccaattaaatatacatatatacattttatttttcattcaaatgagtctgtgctcactggctgcatgtaggaaaactttctgtaaaagatgaatattttaggctttggtcttaggcacaagtattgaactctgctgttatcgtgcaagaacagttgggtagtaagtaaagaattggcatgaatgtgttccaacaaaataatatttatggacactgaaactggaattgtatgtaattttcaagtgtcatgaaatattatacttcttttgtttttcttaacaaatgagggatgtaaaaaccatttttagcttgtggacagatttggcctgtaagcgatagtttgctaacctttactataataggaagaagataggtttttgagtcaatgcgcctggtactatccctttcttgctgtgtaatttctgacgtgttacttcactgagtttggtttccatccttggaaaacagagataattttggtttacatatacacaatggaatattattcagccataaaaaatgaaatcctgtcatttgcaacaacatggatggagcaggaaagcattatgttaagcaaaataagccagggacagaaagacaaatatcacaagtgcttaaccatatatgagagattaaaaatagatctcatcgagatagaaggtagagtgatagttaccagaggctggaaagggtagtgtggagagggaatatgaggggatggttaatgggtacaaaaatacagttagatagaaggaataagatctaattttgatagctcaatagagtaactatagtttgcactaatttactgcattttcaaagtaactagtgaagtaaaaatggttgctcttaacataaaagaattataaatgcttgagatgatggatatcccaattaccctgatttgatcattacacattgtatgctcatatcaaaatttcacaagtagtccataaatatgtgccggtattatatagccacaaaaaataagtaagtaaataaataaataaataaataaattcacttttagcagggctggcttataagcacattatcttctaatttttttttatttttgtgggtatatagtaggtgcatatatttatgggttacatgaggtattttgatacaggcatgcaatgtgaaataagcacatcatggagaatggggtaaccatccccttgagcatttattctttgaatttttaaaaaatccaattgcactctttaaattattaaatatacaattaagttattattgactatagtaaccctattgtgctatcaaatagtaggtcttatttgtgggatctaaaaatcagaacaattaaacccatgaacatagatagtagaagaatcattaccagaatctgggaagcgtagtgggagtctgggaggagttaggaatggttaatgggcacattatctgagtaatcacacagggccctgcatttagaagggttcagcatttgatttaatactctactgtcattatcttgaaatgcttaataattttgaacaggtcctgtattttcatttcatactgaaccccgtgaattatgtacacaactctggctcctagcataaagtagaggccctaaaagaatagctattgttgtgactatgtgttgtagtgtgtaattaagtgtagatgaataaaaaggtaaatttttatcctcagttaaagaaccatgacttcactggtggacaataagaatacactctcataggacaaaagcactgatgactagcaagatagacatccttggaacagatgagcatactggcctgggaagtaaagacacagcgctctaattctgtaacatgacaaattagggaccaagaggaaatgctccagagacagccaatttatgtgggggacctaactgttctcttacaatgaaggtttgagctatgaaatcactttgagaatgtgctgactttgcaggggtatgtgcacagaatgttaaacaactccttgcagttgggtcttgcagcaatctttattttgagcggtgacatcagagcatttatccaaacgcttgtttaaatagaaatgcaaaaagaggtgcattgcagtggctgccgtgcagtgtaaatctcacactgggagtgaaatctggggcgctgaggatgtcttgccaacacagcacagagtctgacctactgttagttttttttgctcactgtatgccaccaaatgggaaaactcagagctccaaatgaattacatgctcaccaacatttcacttttcagaattactgctcaagtggtggcaagcagtatgagatttataaacaaacaagccatgccattttttcctatatatatgaaagaatactcctattggtgagaaaattccctttgacagtcttccagcatgtttgtctctatgccaaacagtattgcaaaatattctggctgatagaagagctccaatcccaggttcataggataaacccagctctctgcagctactgtgaacttcaggtatggcttgaattgtgagagtgcattttgccagtgttatatacccactctagggagtgatttcagccactggatgaattaatcttcagaattagttaagtaaacaaatcattacgaaatacattatattatttactaagcagtttatatgtctacagtaatgacaataacacacagaacttacagcagtatgagactgatataaacaacacccctcccttactaaagtattggtgaagccctggcttacttaggtgtgaagcctgttgatgctaatattgaacagtttgatttcctttgtcatttaggtggttaggctgcttctgagccacttctccatttcttgctaattcctattaggctggtcatctccctgtatcagcagatattcagggataaataaaccaaaccttacatctttgtgtttttagacaagaaattttgtaagaaatacaagccacattagccaacgtgttcaggaatctctgctctgccgtgcttctcctttggcctcctgtgattgtgcactgagccagtttgctgttcattagcaccttcaatatgcactgcgcagggctggagagaaaaggttaagatcaaatgagtcaatttggcttcttattagtagctttgacaaaagacttggtggagaaaagtttacaactaatcactaaaatgagaggaaatcaaccgtgctattcctacccctgattcctgagtgagcagaaggttggatgatttttctctttgctaaatggtgtcctgagggtttgaatgcttgtaaaaatgcttgcctttgtattgtttctacagtgggaaactcatcagttgtctgggatcaaatggttttgctaattaatcctttttttaaagcaatttaaaggagcacaaatttattattttatagttctgtaggtcagaagtctgatacaaatctcactgggatgatatcgcagcataggcagggctgggtttatttctggagtatctaggggaaaatctgtttccttgccttttctagtttctagaggctcccagcattccttgctttgtggctccccttcttccatcttcaaagccagcaatatcacatctctctgacccttcttctgtttccacatatgtctgactgcagccaggaaaagttgtcaccttttaaggactcatatgattagactgggatcttaaaaaccaaaatatattttgctaattcacccttccacttaaatgacttttttttgtttctgtttttttgttttgttttgttttgttttgtcttttttacatgaaagaggcatatcttttgggagtaaggtgaagcagaatataaccaagtaaaaaatggagtaaatacagtaattttagatagtggtaagcgctagagagaaaataaggcagggtgaggagtcaaggactgagtgtgatcatgatgttgtttcaggtaaggtggtctgagaaggcctcttggagaggtaacatttgatcagagacctgaatgatgagggtaaaccttgggaagttctggtacaagtgccttccaaacagaggaatggtaaaagctctgaggcaggaaagcattttggctgcataagaagcggcaattaggctggtgaaattgaaacagtgaacaaggtgaaagagtagtaagagaccaaattagaggcacagacaaagatctgataatacagagtcctgaagcttctgctaaggagtttggatttgattttaagtgcagatgggagccattgtctagtgttaagcaggaaactggcgtggcctgatttatggtttaaaaagatcatcccatctgctgtattgggaacagataccagagaaggtaagagttaaaaccaagagttaaaagaggttgttgaaataaacagatgagagataatgtgtgagacttggaataggatgattgtagcagagatgatgacaaatatcaggattttagaacaaattttagggcaggtttgctaatgggttagatttggggagaggacaggattgaggagaaaagagaggtcaagggtataacactttggttaaaggcctgagcgctgtgtggccttggacaagtaacttaatgtctctgaacttgtttattcatctgtaaagtgagaattacaatagctaccttccagagtcattattgcatttatatattcaactaatattaattggcctcttacacgccaaacattttgctgttgctttacattttttttttatcctgagttgattctcacaaggcttctagaaggttattataggacattatttccatcttacatatggaactgatattcggagttgtaaggtttgataacacatggcaagtaaacagcagatgcaagacttaaatccagatctttgcttcaaagcttatgatctatctggctgagtgttactcagatgagtgatgatgga

SEQ ID NO: 834 - DNA, 766 bp, Homo sapiens
atacttgttgagccttacactaccaaggaagaaaccagtgatgtataatctaggaaactggcacatttctaagtaggacactgcacacagcatgtctgatagcggaggtgctggcccatcttgcaaggtcaacccccgtccaggagaatgtccagtctgctgccctccatgacgcatgtctcactcaatgagacatgctcactgctccatatttgcccagatggttgccaggaccatgagagaacaagctcgttttctgttcttctattaggaagtatcttcatttcttctatctttctattctctgaaaaataggtatttccattgttagaaatgcatcattgaaatcaccttgagaacacctaaggttcaggtggccagctaggatctcccggccttactgaagacaactaaagcctccagcaactccactgcatcacctgtccgaaggtcaccatgaacttgtacttggtaagacttactctactcagaaagggaatagttacatgtaatctaagcaactgatgcctttccaagtagggcacttcccacagcatgtctgattgtagaggtgctgccccatcatccaccatcgtgcactgcagctttcatcaccccactcaacacagcaggatgcctgaaccctgaacttaatcttaattcctagagaatttccagcccactgccctccaacttggcatgcctgcctcagtgacgaccttcttatctgatttatgttcacctggatgatggccaagacaagaaa

SEQ ID NO: 835 - DNA, 152239 bp, Homo sapiens
ctaagagtaacacatgtgcacctcactcacggtttggttctgctaatcagagcggtgggaccctccacatctgtctgggtcacagggtgcaccagtccgcagagcagaaaatcatttcagcaagttgagtcacattcctacagctgagcacgctccatccgaggggagaaaaatcacacttcccctcccattgtcatcggacgagggtttggggggcctaaatcccattgtccactgcttaattctggttaggtcatgctgagcacggggccacaggccacagagctatgcaccgcccggcctggggtccaggcgagcttacagcacaggggccaagcgggaggcagggaagaccgggccgagatggggccgctgtgtgtggagcagcacttgcagacgcaggtcgcgggtacacgcgcttagaaggaggggggccgagaccatggggagagcaagggacaccaaagggcgcttcgggcgcgccccgcacgggttctctgcccgaaacccaggggaaagaaaccccagcccgcaagtaccgtctgcaagagggccgagcacacgggctccggcatcaggggccctggtacctttcagccgcggccggtctcacggcctctggaccctgagagtcgtgggcgttcagggccgactctggcttttggcctcagagtacagtcctccgcctcctcgcgacccagcgaggccaccggagccagcgaggagacgtgggccgcggtgagaagagagagcacccggctcgtgtcagggctgtaaggtagctgccgcttactcccggaaaccggtggccagtgacagatgctagcggtccataacttcggctttcatgcagctcccgtcgtccctttcatgaggaacgtacgtgtgcgcgtaatcacgcacgtacgtacaccacgcacgtacgcaggaggcccgtattcagccacgcctatacaccgccaaatcgctaggaagccacgtattcacgaagccacgcagtgacgtcgccacgcacgtacgcacgcacttgccacaaggagacgctgttcagtttaccggatcctgtcccgcgccagccaaccaggacaaggccggggagctcgagacaggcagcctagaccaagaaccggaaggaggaaaaggaaccggagggaggaagaggaggggcgggacgagaccaccaggcaggatttttaagcccagagctgcgagaccagcaggaaggaactgggagaaaccaatggggaggggatgggggcggggctgagaggaggagggcggagctgggggaggggaagggcgggagtgaggaaaccgctggggcggggttgagagtggggcggggacttgaggggatggggcggggacttgggatggggcggggactcgagggggtggggcggggctgagagaaaccattgggggcggggctatgggcgatctgggcgaggagaggctgcaggaggagctcgcggactcctgagaaccagcgcggggagggagggggctggtgagaggaggaaggtggggctgaaagaaaccagtggggaggggttgggggcggggctttggaagctggtgctggagaagcagggcagggctgggggaggagtggggcggggcggggttcggggggggctggggctcggggaggggtggggcggggctgagggaaccgccggggaggggctcgggggcggggctttgaaaacagcctttggagaagcggggctgggggggcggggcagggccgaggggaacctctggggtggggctggggggtggggtttgcacgcagccacaggagaaacagggcggggctcagaaaagggttggatcgggctgagagagaccgctgaggggggtgctgggggcggggctttggaagcacccgcgggagaaacagggaggagatggggagaggcggggctcggcgcggggcggggcttcggaggcagccgcgggagaagcaggggggggttcggggcagggcgggtctgagcgaagccattggggagcggctgggggcggggccttttaaccagccgcaggaggagccgggtggggctggggcggggcggagctgagagaaaccgctgaggatgggctgggggcggggccttggaagcaggcgttggaggggcggggtagggccgggccgagagaaaccactggggagggtctggggtcggggctttgccatcagtggtgtgaggagcaggccggggcagtgggcaattgagcgaggaacagctgcgggaggactccgcggactcctgagaaccagcttaggggagcggcggcttggggaggtgtagggtggaatcacgagaaagctctgtgggagggcctggtgcacagctcagctgcagggtggagctgagggaaagccgggcgttcctggaggaggagcagggcgaggctgtggcaaagcgctgtgggagcagatggggcggggctgcgggaaagagctggagaaggaggagccaagctgcaccaaggctggcgggtgagaattgcgggggaggagctagtgcagagctggaggaaagagctgaaaggttgttggggtgggcagaggggtaggagaagcgagacggggctagaggaggcggagctgggagcggtgatgaaggggtagcagggcggggcagtgggaaagagctgtgggaggaggagctgggggtaagaagctggggctgtggctgcagcggggactgggtcagagcttctggaggagccgcctgcaagaggagggcgtagttgtgggaaagagctgtgggcggaaatggttaagtgccgggtggagcaggggctggcgtcggaatagctggggcggagctgcgggaggaggagctggggggcggaactgtgggaggaacagctggggcggagctgagggaggaggagcaggggggcagaacagctggggtggagctgtgggcggagctgcaagaggagaagttggggacggacttgcaggaggaaaagctaggggtggagctgtgggtggagttgggggagggagctgaggcccttctgtgatgcacccttaggcaagagtccaaactttcccgcggcgacctaactgcacctccagtgtcttcccccagagggcacagaagcagcaagaagggcgggaacacttgactggggtccatgcagctctaggctgagtcttgcagggctgagccccccaggcctgctctcctgtgtcctggccgctccgtcagtgcctgccagtggggtccagagggaccgtttttttaacgcctcttttgcaggtaatgagaaacatcccccctcttaatgtcttgcctcctccggcctaagtcgcccagcacacagcccaacttccctggcaaacttgcttttcaaactctcttctctcagtcacgggctcaggttctgtagtgctgccatgctttactcctctgtccctccccttatctagtctcccgcattgacttcataaccaagttctgggtccctgcctctggagtgcctgatgagacaaaacggctcctcgtcctgcatccccgctgctacttccagaattcaggcctcgtggtctggagcctgcactgttccatgagcctcctgagcaacctggagtcctctgtctttcttccctcaggtctgtcgtccacattccatcggctcagtttctaagtcacaaatctgtccccagcaatcctctagtgaaaacgctgctgggccttctcaggtttaagtcctagcagttcagggagtcggctcagctctccccacccttaagccaaacactctttgggttcacgctgtgctgttcagtcactggtccccaccagcctgctgttccaggtctccctgctttgcaccggcggttcccatggccttgtcctggtgcgctcctggcctccttcaaggcacaactttaaagtcaccttcacagccccactccgagtattagagactttcgtctccagctctgatagcattttgtacctcccctgtccccaccctacgttaggctcttgcaacccagggtggtaattgctctgtaagactgtggctgccgcagggtctcttgagttccttgaaggcaaggccggtgttttactcatttctgaaactgggtgcccagggcacagtatctgcttagtaagtgttgaatgagcaaagggcagctttcttgttttttctagtgagatgcgcctacttctccctggagaagcttgaggaagcagaaatgctggagatgaggtgaggaggagagggtccctctttatgggatgtaggccgtagggctgcaggggaccttcagatcaccagttccaagtcctatgtatgctagcatcccctcctgggttccttccccacaagaatggttgccagcttctgccgaacaccccagaatctgcttagagtggtttcagatcatgaatgaggatccccgggatggtgggtggccgttgctcctcccgtggcctcttgtttgaagaactagaactcgcataatgagctggatagccaccgtgtggctgctagcagggaagcccttggtggccacataagggctcccttttccaactctctcagctgctcctcactctcactcctgggtgtgctgggcagtggggtgcaatgtgcacgtaggtgcacactctccctgggcggcagcgagcagcagaggtctgatctgtggtcggatgacgagaggaagtgcaagtaaagcagctgcagcggtgagtgggcctaggaagaatggcatcaacaggccaggcagggatgcgggtggtgttcggctaaccctgagaaagggaccagaatgcacctgagtcttgattttcattcccaatagcaggtcagcacgaaacccaaaaacgctctgatttctgccttccatgccacactctcttcacctgctgccttctcactcctctcattaacaatgtcctggcaggaacaagactttcccctccctctcttctcgtctcttagcaggtcaggtcggccttcacctccctagacccgtcctgctcctgccttcccctgtggggccctccatggatgctctggagtcccgggcaatagtcagccaactgcagacatgcggggccttcttgggttccttgctgtgctcccttgaaaccactgtgcctgactgcaccccagtagcacacactgaactgacccccactcctggggccagcggtgtgtctcctcaagttctgcttgcttcttcaggccttgcttgcatgcctatcgtgccacacatcatatctcttttaggaagtccttgccttttccaaagatcctgctttgcagctgactgtaccctctgcctgcctcccccaggatactgcctccttcctgaaaccacagcccccgctcaggtcttccttccttcctcatcaccagggagccccctgcagagctcccggtccatcctggtggccttctgagcctcacctccccttccttcccctcccatcccttcccctcccctccccttccctctccccgcttcccttccctaccctaccctgcccccccaccccctgcccccaaccctgccctctcctgctctgtcctctccctccatggcaggctaacctccctggctagagctgtcccttgcgaatttgccatcaccttgcctctctgtgctcagcatccccggctgtgcagtccttctcttctgcccacatgctcccctagagaagcattctttttgctcagactaatttccgtgcaactcctcctgttttctgagcctgtcaccgccttcctcttcctttgcctccccactgacactttccagagtgcagccacctctcctcgctgtgcttttttgactctgaggcccaggaggaagttgcccttctctggagatggttcacgtttgatcctgcctagtgttccggggcacggccagtctgggaccgctttgaccctgattcatggtttcccttcagatgctttttggtcagcctgctttcctcgtctaggaaatggcttttgcccatttttctttttctttctttctttttcatttttttttagacggagttttgctcttgttgcccaggctggtgcaatctcggctcaccactacctctgccttctgggctcaagcgattctccttcctcagcctcctgagtgctgggattacaggtatgcgccaccatgcctggctaagtttgtatttttagtagagatggggtttctccttgttggttggactggtctcgaacttcgacctcaggtgatccacccgcctcggcctcccaaagtgctggggttacaggcgtaagccaccgtgcctggcttgcccatttttctattgagtcatttgccttgttggtatggagttgtaggagctctttctgaattctgcctctaaccccatgttggctttttgtatttcagagacctcgtccgcacaggggcttgttcttctgtgtctttgcagggctgttttggactcagtattcacctaagcactccaaattgtaagtaaccccagagatcatggagtgtcccactgcccctccatctgaaggctgtgacctctcccccaaggaggaggtgctcgcatgcgtccagtgccctgcccattagattagggagggttcccttttttgctctcttgcactcatttgtccgccttttagctttccttttctgccctgactctcacagggtcgtgcggatgtgcgatgtaggaggaggagagaggtaaagtggaggaataggagctggaggggaggaggagagaagaaaagaggagaaggagggggaagagagggagcgggttcaaggagggaaggaggaggagaaggagaggaggaggagatgagaccaaggagaagaggtgaaggaggagaggaggacacagaaaagagaagaaagaggagaggagacggagaagaggaggaggagtaacaaaggaggaagaagaggaagaggactagaagagcaagtaaggaggaggaggggggagtaggaggagaggagaaggacagaaggggaaggagaggcagatgtggaggagaggaggtggaggacaggaggggatgagaaagaggaggagaaaaggagaggagagggatgaggggggaggaggaagagaaaagaacaggaggagaagaggaggagaaaaggaggaggagtgaaagaaaagaggagaaggagaggagggggggaggacggggaggaagggagaaggagagaaataggaggagggaggaaaggaggagaggacgagaggaggagcagaggaggaggaggagaggaaggggaggagatttggaggaagaggggaggtggaagaagaaaggagaaggcggagaagaggagaaagcagagaggaggaggctgaagaaaggaggaccaggaggagaggacgaggaggaaaggaggaagaggaagagtggaataagaggagcagaggaaaaggaggagggggttggggaggagtggagaggagaggaggaggaacagagttggaggaggtgaaagagaaaagaggagaaggaggagaggaagagagaaggaaatgagaaggagaaaagtaggaagaagaagagagaagaggagaggatgaggaggaggagaggagaaggagagcaggaggtgggaggaggaggagagtaagaggaggaaatgaggaggaagaaaggaggacagaaggtggagaggaggaggagaggaggagaaggaaacgaggaggaggacgaggctgcaccacccttatcaggttccagttctcggtgcgccccgttctgcaagacactctcctgtggtcagccctggtctgcagaggattcccgcgctggatctctgaaggatgctggcgccctctctgcagcacattcctgatgcccttgctgacacgtgtcctctgggccctctcctgaaacctgattctccggggtgtcttctggcctcacctcttctgtccagttccagcaagctcactttgcttagcctttgaatcccttccttcactgtctgccatgacagttcaggcctttcaccgtcactcaggcctggaccatcactgttgcccatcccatgccatcaacaggtttgccccatcccttcggctccctaccagggcattcagttgtgttgagcagcagagtgtctccaagtccccactggttgagctgcatccgggtcccatcccacagggaccccctggccgctgcagatgcatgctgatcctgcagctcctcgagggtgtcatcgctttcccccttcccagacccagcacaccctgcctgcatggcgctgcgctgcaccttcactctggtcacgggtctggcagtcagctcaccaattcctcctgcttccctgggacttgccggcttttagcactgcaattcactcagcaaactgggactgttggtcaccctacctggcagccagtgataaggtgagggccactcctgggagggaggacacctgtggggaaaattcttgtgttatttatttctccttcgggatagggtgcctgcagcgcttcatgggagggggtgggctgatgctgcgggctcagaagtttcaagggcatctggggagaccagatattcagagaccttctagatgtgcctgttccatgtatcagggacgcaggttttcccaacagggctggtgtcattggcatgacagacctgccttggctgagcgttcacctgtctttggagttcagccaccttagcaagtcctgggtttgttcttcagactttgctgctcgcccattgcctggatcgggggctactttgtaaaccaccaggaagactccagtgtttctggttaatttttagatgtttgttaattgctcttggtctctcattaatcccctgtgggtcatccaggaaacatactcaccactgtctgttctctgagttttcatttccaggcatccgccctgcctggatctcctcacctgccaggaacttcctctccacaagccggccatcccagcaaaagttctaacaccaaaggtctggcaactagcctgccatcttgtgcctggagccgcctgcgtgccacctactcccgaagatgggaaccttgttgccagttgggcagatgcggggcaatcctgtaccaagaccccattttaccacctgctttctcagaccactctggaacccactgtctcagattgtgtcctccaggaagcagaccatgagagggagttggcagggccaaagatttactggggctaactaacactcaggaaagggataggaaggaaacagggctggagagcaggttgagcccgacctgacagtctcgagcagcccaacagggaggtgtggagcaagggttgcccactagaggggcctgcattgggtacgggtgatggggtccacatggtacctggcatatagcaggctgtgcaatccatattaactgactggataaattaatgcccagaaaaggtgccctggagaatgggtgtgtgctgaacacaatagggaagggcccagcatctgccttggcataggcagaactgtgctgtgccctgcaacaggccacctgagagctgctttgatcttgtgtgtacattagatgactgccaggggcatgaaggggatgtgcttccagggcatttgctggcagggcgtctcgtgatctcttggtattggtgtgagcacagcctggcaggagagggcagatctccatgcaaagtatgtcagaaagcagatggaagccaggccccctcctgaaagaggctccttgaaggtaggtgcacactcatgtctttgttacttgtaagggggcatcttacaggcaagaggagttaggtgaatgtgaagaggaaggaactactctgggcagggggctgggggacgcttcgtagaggagggggtgtttgagctgggccttgaaggtcaaaagggttttgttaggtgggaaatgggggaaggacagtctgaaagggttaggtacattcaaggagcccagagaaggttcgtggctggagcagacgcattcgtagagtgaagtcatgggagagaagaggctgggaaactagattggttccaactcctaaaggaccactgaaggagtgtgggctgcacgctgggtgcagcaggtgagtttcctcacttgggtttcactgtcagcattttaaaaaggcaaactggttttcttcctgagaagaattcattgattcacttgtggccagtaagtcatctgggccagaggttggtggggagatgataggggtgcaagtgtcatcttcaatcacagcataactgcccttgctttcttacctctcgtttagatatttcaatgcttgctcaggtcccctgcgccctccttccttctcccttcccagccatactacttatgggatgactttctctttgtaaaatgaccgttagtcttatcaaattaatcccaaagtaataccatcaatttccccctaaaataccaacaagacccctgcttgaaactgcttgtacattagagacagagaagagtccatgagaatcaacattttctgaggactccaactgtgtgccaagagagttcccctgctggtgcctcctctgtagtaaaggaaaggtaacattcctgcaaggctttgaagcttacagcgtgcttgcccttagattcttgtgttgtgttctgggtcagcaggaatgcctcgccaggtcctttttctcatcctaatgtgacactgaattcttcacaggctcctgggaccacattatcattctcttcactcgagagatgaggacactgaaattcagagaggggaagtgatttgcctcagcttgtactgtaagtgatcaaggcaggactcaaccagtctttttgaccctgactatggtgatttgatctctacaccacaagatggtggtggaatggtggaatatggtaactagaaggccctttctagctcaggacacatttgatgctgtgactgtttgggaattcagtcctgaccaatttaagaggttgtgtttcttagctgtctctggctcctggtttgcccagtttgattctgtgcctgcctagcaaaacctctctgtctgtggtctaagaagcctgacatctctgaactagtcctcttcctgtccactcaatatcgacagaatctcatggtatgtcctcctggctcagccatggaataaagccagctctgttgtttttgtccttgtgttgtgccccagcttaggaagaataactcttcaggctgcctctcccatgctaggtcacatgcaggtcacacattcccaggtaaattttgcactttgtttatctggaatttgtcttaatttccttgtccttgtttctgattgtgtactctcttcccttctgtctcattatctgggccctatgtcttttctcatggtttctcttctgtaagtctctagacccgatgcaagtacacagtgaagtgaatgaagttaaagataaagcttcagtgtctcttgcttgaacagccctggaaggagccctagcattatggtcctacagttgtatggtttggaaaatctacaaaagatattttaaccacagttggttcagggaatctttctttccactatgctgtctctatccctcttgcctgtgtgttgggtagcaatgcaatgaccatggtcatattgagaattcaactaaggggacattaagttgggattcatttagtttaggatatatttttgagatatctttcaggagtccacaggcaattccatatatttcccagtttttgccagctgccctttattggaatagcttgcaggaatacttctgctcactgtgctgatgcatccagtgttaggacaagaggggtgaggctgaagggtacattgtaatgtcactgtgacttgcagcacttggcatcaggggtatgttggcagtggaggagaaccaagattcacaatgtacagcaccagaagctagtctgtggaaaaatcttccagtcatcaatcagatgtgtaaaattgtaagtgaaggattccattttcactgaaaagcaaaagtgctctcttgtcagaaatatacccagcgtgcagtgtacgcaattgtaaatacaagatacatttatttgcacatttggaaggggattttgtgaaatggcatttttcagaattcctgtgattgtaggacatggacctgtagaaggactagaaacattgagtagtatgcagaagagttttgctgggcaggcacagaattaaactgcgcaaaccaggagccagagacagctaagaaacacaacctcttaaattggtcgggactgaattcccaaacagtcacagcatcaaatgtgtcctgagctagaaagggcacagtcatagttcctgtgactgctacccttagaaagacctgcttggaagttacgctccctgctggcatctggaaacttgactctcagaatttccctagtcaacagttaactgataagatggctcactgtgccttgactgttgatacagaaaacgtagtttatgctgaatatctgctttccttctgggagtctggaattttggtgcatgctaggcagaggaagtctctgttaccaaacaccagtgtaaagtgtgggcaatgagtctgggcttctctggccagaaacatcacacgtgccactgcatatttgttgccgagagaagcatgtgctctgtgtggcccctcatgggagggagagagcataaggaagtctgtgcatgggctcctccaaactttgcctgtcttttctgcttgtgatctggctgtgtgccctaactacattgctgtaataaatcttggttgtgattataactatatgctgaatcctgtgtttccaactataacaaacaagaaaagcaggaataacatactatagaagtgcatgaggcagttaagtactaaagataagtagctatttatgttatttttttctaaattttcagatgtttctaacatttgtcaacgttttcaaatgtgtgttcttttgttttttttttctcactttaaatatttgcttttgttcccaattttatactggtaattttgcattcttatacttaaagaaggccccagatgttacaagcttcaagccccacaaaacctggatctgtctctgtcttggatccaagacttgctgcctcatgttggttttcctgttgtcacttcatattacacagatggggaaattaaagccaagagaggggaagctaaccttacttggcaaaactgggacaggatccagttcttccaattcccagtttaatgagtgctctttccccctattctgtaaagttttttggtaacttgtctgtaaatatcggtcatggtacattgtccactgggtggcactcaagagattgaaatttgagttccttctctttgagtagttgggtagtcttgaactagtccctttccctcctgggacagattttcccagtttgtaaaataaaggggctggatttagtgctctttatagacctttctctctcagatatttcctgagtttttcattctagaaatgctggaatcatatatttgtaactgaaactagtaatcttcttgttcttgagtcttcttcatctctaaagtggacataaaatacatacctctcgtggttgttgtgaagcccgtggcactattcatggtagagcaggtgatcaaaagtcgcttgcatccttctgtccaattgggaacaaaagctttcatgtataattctcacacctctcccttggaatcagacaatcttatcagaaaacctaaaaatttttttcaatcaatttagaagtttattttgccaaggctaaggacatgcctgtgacactgcctaagaaggtcctggtgacatgcccaaggtggtcaggccacagtttggtttttagggagatataagacatcaactgatacatgtgagatgtacattcgtttggtctggaaaagcaggacaaatggaagttggaggacttccaggtcataggcaggttcagaaattttctgactggtattaataattggttgagttattatctaaagacctggaatcattagaagggaatgtctggtttacgataaggagttgtggagaccacagttttatcatgcagatgaaacctccaggtagcaggcttcagagagaatagattgtaaatgtttcttattagacttaaagagtctattgtatcagtcttaaggacagtgttcatgttgatggtaatgaggcatgtccgactcccccttcctcatcatgtcctgaactagtttttcaggttaactttggaatgcccttggccaagaggaggggtccattcaggtggttggggagcttagaattttatttttggtttacattctttccttctggccaggatttgccagaggcaacatcaatggacaaacttttattttgtcccatagcattgtggaggtggtttggctgcctgccccaggtccatcctgtcccttggtaggatctctatggccaagagacttacagccaaaagacttatagacagtttaaatgttctaggccagacaggaatggacgtggacaggcatttattactccttaacaattttgaagtaatgtaaaagccaacaaacagaaagtaaaaggcgaggttacaaaattgccttatctatctttaacttctatgcattgagctactgtagtcttggttttagttacagatttttagcaattggctatataagcaagcctaaattttaaaaagaagagaaaatgaagcatacatttaaaagttcttaaactttttttttgaaacagggtttcactttgtcactcaggctggagtgcagtgatgtgatcatagctttctgcagccttgacttccgggctcaagtgatcctcccacctccgcctccttagtagctaggaccacaggcatgcaccagcacacccagcaaattaaaaaaaaattttttttaaagatgagatctcactatgttgcccaggctggtctgaaattcctgtcctcaagcaatcctcctgccttagcctcccaaagtgctgagattacaggcatgagctaccatgcctggcctaaaacatttttaatggaagtataatttgcaaacagaaaacatgcccaaatattaagtgaatgcactgatgaacattcacaacttaacaagatagccagcacttaaatcacaaaatagaacaccgctaggacctctttgtaataccctccaagtcactacttctgcccaaaggtaatcgctattttgcaacattttttattactttatataaatgagatcgtacactgcgtaatcttattactgtctggatttttatattaaatattgcttgtgagattcatccatgttgtcatgtcagcaatactttattctcattgccatatactattccatttttatcagtataccatgatatatttacccattctgctatttgtacatactggaattgttcccaggtttttgtaatacaagcaaagctgctatgaacatgcttggatttactttctttggtgaatatgtattactgttatgtacatgtctagaggtaaaattgatgatttatgggatatgcatatgtttaattttagcagatattgaaaaacagatttttaaagcggctgtagcaatttacattaccaccagcaatgtgtgagttccatttgctctccgtccttgacagcacatgttgtcacttaggtgggtatgcagggggatccttttttggcatgtttacttatttttttacacagtgcaaactggtgtggtgtaccgttttatggcttttgcctaatgccatcactaaagttaccaaacaattccatcacctcagaaattgctttgtaccgcctcttggcattcatccccttctccattctcaaccctggcagccactgatctaatttccattcccatagttttccagattatcaaagaaacagaatgatatggttgtaaccttttggatgtagcttctttcaggtagcaaaatgcttttgagatttaactatgttgttgtgttttcagtagttcattcctttgtgtgtgtgtgtgatagtctgactctcttgcccaggctggagtgcagtggtgtgatctcagcccactgcaacccctgcctcccacattcaagggattctcatgcctcaacctcccaagtagctggaactacaggcgtgcaccattgcgcctggctaatttttatatttttagtagagacaaggtttcgccatgttgaccaggctggtctcgaactcctggcctcaagtgatgcacctgcctctgcctcccaaagtgctgggatgacaggcgtgagccactgcacccagtccagaagttcattgctttttattgctgggtcatattccattgtatagatgtatcacattttgtttatgagtcctatagttgagggatacttggtttgtttccattttttctctattatggatacattgttataaacatttgtgtacagggtttgtgtgaacatagtttttatttcttttgagtaaataggagtgggattgctgggttacttggtaaattgctgggttatagttctttttgagaacttgtcaaacttttgctgagtggctataccattttgcattcccactaggagggcttgagagttccagttgttccacattcttgccagcacctggtactgctagtttttctgtgtgtgtttttgttttgttttgccactctaaggtgtatagtggtatctctttctggttataatttgcatttctctaatgattattaatgttgaacatcttttaacatgcttatttgccatccatctaacttctgtggtaaattttctgtttatattctcgtccattcaaaatattgggttgcttgttttcttatggttaattttaaaagctttatttggaaataattatagatttaaaggaagttgcaaagaattgtattcccttcactcacccttccccaatgttaacatcttgcctaactatggtacaatattagtatcagaaaattgacattggtacaatccacagaggttattcagattttaccagttatacatatacttgtgtgtgtgtgtttctatgcaattttatcacatgtatagttttgtgtagcttccacgacaatcaacatacagaactgtgccatcaccacaacattcctctcatattacctctccacagcctcacccacttcctactctacatcccttacccttatcaaccactatttggtttaccatctgtataatgttgttattccaaggatgttatatacatggaagcatactatatagtatgtttccttttcatatttgctttttttcccactcagcataattcctggaggttccttcaagttgtgacatgtatcaatagttcattcctttttattgctggatagtatttcatagtatggatgtactataatttaagcattgtcaattttggtagtttccactttgagctattccaaataaagtttctgtgaatattcatatacaagtttctacattaacataagttttcatttctctggggtgaatgcccaagagtgccattgctgggtcatttggtaaatatatttttttgtttttctgagatggagtcttgttctgttgccaggctggagtgctgtggtgcattctcggctcactgcaacctccaactccctggttcaagcgattctcctgcctcagcctcctgagtagctgggattacaggcatgcgccaccatgcccagctaatttttgtatttttagtagtgacagggtttcaccatgttcgccaggatggtcttgaattcctgacctcataatctgcctgccttggcctcctaaagtgctgggattacaggcgtgagccactgtgcctggccaatccatttttagtgtttaaagaaactgcaaaccaccatggcacatgtatacctatgtaactaacctgcacattctgcacatgtaccccagaatttaaagtataataaataataatactaattttttttttaaaaaaagaaactgccaaactattttccagagtgattgtgcagttttacattttgaccagcgatgtcagtgatccatttgctccacatcttcattagcatttggtgttgtcacagtgttttattttagccactttgataggtttctagcaatatctcattgtggttttaatttgcattttcctgagggctaatgatattgaacatcttttcatgtgcttatttggcatctgtgtatccttttcagttaaatgtcttttgcctcttttctaattggattttttttttaatgttgagttttgagagttctttatatattccagatataagtcctttgtgggatatataatttgcaaatttttctctcagtttgtaatttgtcttttttcatctccttgaaagagtttttcacagagcaaagtttttaaatttgatgaggtataattttcaatttttacttttatgggtcatgcttttgatgccaaatgtaagaactcctcacctaatcttatgtctgaagattttctcttgtgtttttttgaaaagttttacatttttacatttcacactatgttccattttgagttaaagtttgagatttaagtcaaggctcatttttctttttctttctttccccccctccgccatgtatgtccagttgcttcaacaccacttgttgaaaaaactctgcctcttcctttgaattggttttgcacctttttcaaaaatcaattgggcatctttgcatggatctatttctgtctctgatactctttttcgtctctttttaagagtcagtgtctcactccatgcccaggctggagtgcagtgatgcaatcatggcttactcctaggcttaagcaattctcctgcctcagccttctgagtagctgggactacaggtgtgtgccaccatatgcagctttttttattattattattttttgtagagacagagtctcactctgttgcccaggctagtctcaaactcctggcctcaagtgatccttccaccttggcctcccaaagtatatgtttgctattctgttctgttgttctatgtgtctatacctccttcagtaccatactgtgtggatcattattactgttgaattttgagggttttttttttattctggatacaagttcttcttcagatttatgatttgcaaatattcttttccagtctgtggttagtctttttattctcttaagagtgctctttacaaatatctttcttttattaatttccaatatcgcctgataacgttctttttttttttttttttttagacacagtctcactctgtcacccaggctggagtgcagtgatgcaatcttggctcactgcaacctctgtctcccaggttcaagcgattctcatgcctcagcctcccaagtagctggaatcacaggcatgcactagcatgcccagctaatttttgtatttttagtggagacagggtttctccgtgttggccaggctggtcttgatctcctgacctcaagcaatctgcccgccttggcctcccagagtgctgggattacagacgtgagccaccacgcccagctcctgagaatatacttttaatgatttcagttcttttaaatttgttgagtttttttatggcccacagcatggttgatctctatgaacattccatgtgctgctgaaaaacgtgcattggatgtagttttaaaaatacgtatcagttaagtcaaggtgaatagtagtgctgtttaagtaatttatgtcatcactaattttctgcctacattttcctgcagttactaagagagaagtgttaaagtttcccattataattgtgtatttgtcattttattttttcagtagtgtcacagtttgtctaatatattttaagctctgttaagtacatgcacatttatactttttatatctaattggagaattgacctctttattattgtgtaatatctcaatttctgacaacattctttgttctgaagtttactttgtctgatattactatagctacttctgcacaatattttacttctagtaatattttagatcagataatttatttctttttagcactcttgatttgtttgtgaagatttatgtttccatctaatatattccttcggtataaaaaaacctcttaaagatttcttgtagtgtaggaatactggctaggatttccatcattatttttgttttcctgagaaagtccttatttctccctcattttaaaaatcagccttatggtgataaaatttacataccataaattcacccttttaagtgtacaattcagtaacttttagtgaatttacagttatgtaaccactaacataatctactcttaaaacattgccatcacctctgaagatccttcatgccagtttgtagtcagtcaccttcctatccccaaccctggcaaccactaatttactttttgttattgtagatttcctgtctttggaatttcctataaatagaatcacacaatatctagtcttttgtatctggcttctttcacttagcataatgtttttgaggctcgtcaatgttgtagcatatatcagtattttgttcctttgttttgctggctagtatttcattgtatggatgtatcatattttgtttatctgtttaatagttgataaacatttggattgttttcactttttggctattgcgaataattcagtcatgagcatacttacaagtctttgtgtgaacataggttttcattttatttattgcctaggtgttgaattgctggttcacatggtaaatttatatttagcatttgaaagaattaatggccaaactgttttccagagtggctccatcagttaatattcacaccagcaatgtcatcttctttattttttaatttattattatttcaattgttttttggggaacaggtggtatttggttacatggaaaagttctttcgtggtgatttctgagattttggtgcacccatcatacaagcagtatacactgtacccaatgtgtagtcttttatccctcacacccctcccacccttacccatgagtcctgagtccattatatcattcttatgcctttatgtcctcataacttagctcccacttataagtgagaacatataatgtttggcttttcattcctgagttactcacttagaataatggtctccaactccatggaggttggtgcaaatgccattatttcattcctttttatggccaaatcgtattccatggtgtatgtgggagatatatatatatatagatatagatatatatctcacattttctttattcactcattagttgatgggcatttaggctggttctatatttttgcaattgcaaattgtgctgctatgaacatgcatgtacaagtgtctttttcatataatgacttctttacctctgggtagatacccagtagtgattgctggatcaaacggtagatctacttttagtgctttaaggagtctccatactgttttctgtagtggttatagtagtttacattcccaccagcactgtaaaagtgttcccttttcaccacatccacaccaacatctattattttttaatttttaaattatggccattcttgcaggaattgtgtgtggttttgcctggcttatgatctgggaaacttgcatcctcctgttagtatgtctagttagctctgagaagtggcttggtttaatctagacctccttttctaaacacgtagaaattcctagggaaaatgaaatgttgttctatcactccaaggtttctttggggtcttttaagggataggttcctcttctgaaagctcaaagtcacccgtgattctgggtaagagcaggagtaggttaacctaagcagttgctcaataggttcatgcctgtaatcccagcactttgggaggccaaggcaggcagatcacttgaggtcaggggttcgagaccagcctggccaacatgatgaaacccccatctctactaaaaatataaaagttagccgggcgtggtggcaggtgcctgtaatcccagctactcgggaggctgaggcaggagaatcgcttgaactcgggaggtggaggttatagtgagccaagatcgaaccactgcactccagcctgggcaacagagtgagactgtgtctcaaaaaaaaaaaaaaaaaaaaagcacaaaggactgttcagtacttttacattagctaagaactaatttacgctaacttcttttttatatgcaaaagatagtcataggatcttaataagttgtgtaatcatgttatttgagattgtatactatatgtagctcatgtcacattagttattttcacctaaggataccttaacattaggcctacagaaaattaatataatacctttgttctctgcaaaaggctacaacaagtgatctctagaggtgttttctgactctcaaatctctaactcttggattctgcctcatccagaaaggtttgggttaccaaagcaaagtaccataaactggatgacttgaaaacaacagaaatttatttttcatagttctggaggctggaagtcttagatctgggtgctaatatgagttctggtgaggaccctctttggggttgcagatggccatcttcttgctgtgtgttctcacacagaagaaagagagtgagctagctctctggcctgttcttataagggtacttatctcatttaggatggtcccaccctcatgatctaatcaccttccaaaggacccatttcctaataccatcaccttaggggtcaggatttcaacatataaattttgcggggacacattcaatccataacagattctttcctgttattattttagaatgacatggactctttcccagtccatttgggttaggattcttattcagcctggaggcagagccgtaccctgtatggcctatcacattccttttagcctgggtctctggttacttgtagaacccttatttataattattgtctaatgctgggattctccagagtgctgcttggagaaatttagcctcttagagacagttgcaataaaagaattctatcaaaaagaattcactgaattgtgatcacaaacaaaataactttgtggggataaaatgtactccaacaagggaggcttatgtttgtttttcagcctctcctcccagtgctgcacttctaatctctctgcagaaagaaacatttcaacagagaacccagtggaaattatgacatgttatcttctcagagtcctgaactcccatccctacctcagaagagactcctctgttcacagaagctaaaggcagttccttcccaatggcaactatgtttggatgttggatctacactttctcaagcactgtgatcttcaaatgtaagtttagtaacataaatatctttttgcagcctgaaagaattttatgtctctgtgttatcaggtaatgtttcagtatctcatattttgctggtaacatttagaatgttaatctcataaggagattttagagttatagttaaatttctttatctgggttagatgggaatcctttattctggggaaagcaaagttctttctataagcctgggttctcataatatacagactgggaaacttgggaaagagtaggagcatcattagtttcattttataggtgggaataacaaagcatggagagacaaacatatttgccaaaatagttattctcaactccttgttttgggaattctagagtgtttcataggatttcaaagtacctcacaaaattgttctaaatttctcaaagccaaattcattttaattaactttaattttttttgaaaagttatagcattcttgggggtaggataggtacattttataaaaacaatacaaacaattgttttgcttagaaccagtgaaatgtcaaaactccaaaaatgtttgggaagcactggattagtcagtagcataacaagcaataaaacaacccaggtcaggtgcagagagatataaactcttgtctcatcctccatagatctgtattttcaaaggcagagtcttgtgtgactgcatgtctgaggatatgtctcttctggacagggtttttacagtacttgagaatgatcctaacaaccttttggggtgactcaatttttttcactgctagagaggtaaaacaaatattgatacagttgaacagtgagaaattgagtttggctggagcacaggcacataatggtagaattatgagcctgtgctaggctgtgtgggtttggccaaattgggtcaagtgaaaacagaaagatcagttagaaacttgcaatagtttcgataaaagatgttatggcggttgtccaactttattgtgaactctcttattgtactagtgtttaaaagcagataagctgttacctcttgaatcccacaggctgtctagttatactggtcaggatctcttccagctcaattttttaaaaaatcctttgccttgacttccaaaggcacctgttaagagtggacttctcaagctgtgtaaagtacttttggcataatcaagtctatgttgttccatgaagctctaagtccagagtaactgtctttagttgatcatattgaaagcaagaacatcatttcaaacaaaccaagtctgagatatttaacccacatgtgctttcagacctggtatgtatgagcttgagcaatgaagccttattccattttgatgttataaaaaatggagggatttccctgcagtcagtttcacagccactatttgacttatatttgaagggggaaagataagggctgtgttcttttgatctgaatttttctgttcttaaaagttttcttttctaagaacactagtcagtacctggagacactccgacatatttaaagaattaatttgctttattgaaaaaagttgtttctttaaacatttaaataattactttttcttcagtgacaaattagtttgctttaatgaaaaaaaaggtttttttcataactttcattacatgaacctttagcaaaggagatttctcccattatatacttcttatgatcaacaaattccatcatctccccactaagagaaagtactccaagatgatagaatgattttaaagttatgggactacaacagcagccacaggaaccttgagtaagtaccatgaaccctgaccctcagcgttaatttgtaagcctttggcagtgagatggaatgtcttccttcagtttgaaacaaaggaaacctattgcatcgcacgtaaatttgtatattgatgctatattgactttgtagctgccatgccttcatacagacacctcatccagcccccactgttccacttattgtgatggtttgtatatctttatttcaaagaagatctgtttgaaccgtgtttaatttcttctttgacctgctttcatcactgcccatgcctaccctggtggcattctcatccacgagactaccacatccatgccactaggtggcattctcatccatgagactactgcacccgtgcgcacgtcaagaagtagccaagccatgggctggattgtgcttttcctgagaggatgaaaggcttcatggatacatgctagtatccatgttcctctattctcaagtcaggcaccaagatgatgtttcatacctgcctgcctttcaaagtctcataaatgttcattgaatatccactctatgcaaggcactagggtagtcacagaggcaaggtttgagctaaactacaggccctgccctccaggagctcccggtctcatggcagggtgcagaagccagaatagagggccatggcatgggagagaactctgctgaccgggagctctgaagggttaggggtccatgagcctgatttatggggtcgttgccataggattaggggctccctggcatacagtgaatggagagactagcattgctgtgttatttcactgagagggcaccaatgttcagcctctgagaccaggggaggaaagcagtggccatgaatgttccctcccatcccggggactgactgggctcctcccacagtctcagacacagaggaagaagtgtactcacactgccccaacaccagtgagtggaaatatttataggtctctcatttggttttaatttttatttttttatttttcagaaattaaaaaaaaaatcacactcacaaaattaaccattacccacattcctaccaacaagaagtaaccattcttaaccttgtaatatgttggtttccagatttatgtttatgctttaaaaaattatgcagacaacatattagcacattgccccttttctcatttgttttaatccatgttcttcccatttatacaggagcaattcttgcattcagttatgggatactataaatgcctagtataatggcagcagagagaattactatggttgtataccttttctcgctccttgctcctcaaatgccttagagtttaaaatctattgtggaaagtttgtgaaatgcagaacggtgaaaataaacaaattaccagtggttctttggcttcgggagaactgtaattgatgttcattttggtatatttccctccagtattttttccatatggttttatttttaaaaattttaccccatatatatatacatatatatatacatactaactactcacaaaattaaaaattaaaaaaattaaaaatgtataaaatgaaagaaaaaaattagcctcattttgtatttactattttataatctgcctttttgcttaatcttctttgtcattatatgttcttctacctcatgatttttaatagctgcctagtattccattgtatagccatagttatttcatactttataattgctattgctagacatttagttggtttcctttttttgcttttataataatgtgtgttcctatacataaatcttgtaaatgtctgattttaaagataaatttctagcagcaaaacttcttagttaagaacatatacattaaaatacactcttattatatttttctttaccaaagtaatatatgtttattatagaacatgtacaaaatcacagatatacaaaaaaaacagcatataagttacttgtattcttcccactcagagacagccactattaacattttattgtaaccatccagccttcttttctctgtattctacatgctctttcataagctttttttattgaatgtattcagaatacctaagttcattgttcttttttaccttcactggttacatggcatttcactgaatgaacaaaccagaatttgtttgatgaatcttctaatgctggacatttcagttactttctgtttttctgtactataaacaatgcagaggtaagtagtgtgtgactacacctttccaagtccttgattgttccctgtgaagaaattcctagacgtgcaactgttgtttcacctgtatgttaatttttaaggcttttcatgggtattactaaatgttcctataacaatttttatcttagaggcagaatattggtatatcctttttttcccaaattcttgatattactattttgccaatttgactacaaagaattgattatcatattttaaaattaacatttatttaattacaagtaaaactgaactatttttttcttttttgcccaattttatgttttggtataggtttttccttgtttattaatagatttaaaaaataaatttgaaatattaatttcttgtcatttgttcaggttttctccttcaactgattgttgtgatgagttatatgtctagacttcctgatagtaaattgcactcctgaaataatccctccttgctcataatgtcttgccagatttggcttgctggcatttcatttaggatttttgcatctatattcctaagtgacattagtcttcagttttctttctctgtgtatttgtgtgggtgttcgtcaggttttgtgatcaggataactttaattttataaaatgaatgggcttattccttcttttattttataatgagaaccgcttttagagcatggaaattacctgttctttgtaaattaaaaagaacttgctcataaagctgtctgggcactgtaacaatcatcagaggaaaatgtgtaacaccctatttttccccacgttttctacttctttgtgattccagttagctaattttcctagaaaattgtcctttttattgagattttcaaactcgttaccatctttacagttttattgagatatgcatacaagtcacccatttaaagtgatttttagtgtattcagagctctagaccatcaccacaaccaccacaatagattttataacattttgaaaaccccagaaagaaaccccatgcccattagcagtcaccctctatttccccttaattcccccccttgtcctagataaccactaatctactttctatctccatagaattcccctattctggacctttcatataaatggaatcacacactgtatggtcttctatggcagccttctttcacttagtgtaacgttttcagagttcatccatactgtagcatgtagcagcactttattctctctcttttttaagttttcgtttttgattaacagactactttttagagcagttttaagtttacagaaaattgagcagatagtacagagaattcccttatactgccctcctctccactcctgaccataattttgcccacaaacatcttgcattggtgtggtatatttgtcataatcaatgaattgatattgacacattatgattaactaaagtccgtacatttgggttcattctttgtgttgtacagttctatgggttttgacaaatgtctaatgtcatatatctaccattacagtatcatacagagtagttttgatgaaaaggtaaaacacaggggacttttagggcagtctttccctcctccctgtgaacacctaccaaccactgatcttttgatttgcctttcccagaatgttatataattggaataatatagcatgtaatcttttcagaggcttctatcactaagtaatatgcatgtaagcttcttccctgtctttctttggcttaatggctcatttctttttatggctaagtaatattctattgtatggatttaccacagtttatcccttcaccttttaaagaacgtcttggttacttccaatttggggcaattatggataaagctgcttcagtcatttgtgtgcaggtttttgtgggcacataagttttcacctgatttaggtaaataccagtgagcatagactatgtttatctttgtaagaaactgccaaactggcttccaaagtggctttgtaattttgcattctgaccagcaatgtataagagttcctgttgctttacatcctcgccatcatttggtgttgtaagttgtttggatttttgtcattctgataggtttgtactggtagttcatggttttaatttgcaattctctgataacatacgatgttgagcatctttttacatgcttatttgccatccatacattttctttgatgcgatgtctgtttagatatttttcccatttttaaattgattgttttctttttttgtatagtggatacaaatcctttatcagatatgtgttttgaaaatatttctcacactctatggattctgttttcattctcttaacagtacctttcacagagcataaggtttttggtttaattttactaaagtccagtttctttttatggctaatattccatcatatggatataccacattttgtttattcatttatcacttgatggacacttgagttacttccttttggctattgtaaataatgttgttatgaacatttggtagaagttttttttttgaaacggagttttgcccttgttgcccaggctggagtgcaatctccgtgattctcctgcctcagcctcccaagtagctgggatcacaggcatgtgtcaccatgcctggctaattttgtatttttagtagagacggggtttctccatgttggtcaggctggtctcgaacacccgaccaaggcgatccacctgcctcagcctcccaaagtgctgggattacaggcgtgagtcaccgtgcccggcctggtagaagtttttatatgaatatatgttgtcatttctcttgagtagatacccagcagtagaactgctgagtcatatgataactcaatgtttaactcttaaaaaaaaaataaaaaaaaaactgaacaacttttccaaagcggctgcaccattttatattgccatgcctcctacattgctagtggcattttacgttgtcactagcagtgtagacgggttccgttttctccatatcctcaccaatgcttgttatcagtattttttgttatagccattgtagtgggtgtgaactggtgtctcattatgattgacttgtatttccataatgactcatgacattgaacatattttcatgtgcttattgaccatttgtatatcttctttgcctcttcacttttgatattcttttccatgggaatttcatggatttcactaaaatctttgtgcagatgatttccaatatttacttccaactttgacctttctcctgagattgtcgcagtttcccatctgtttcttagccattaatgccctaattgcagaatcagtgtgtcacaactgaaattcatcatctttcctcccaatcaatttattcttcctctgtgttccttatttctgttaatcatagattaactaatcttctaatgattagactattcttctaatcatccagactttcaatttggcatcatatttacatgtaagagaaatgagataggaaggaatcagtttgttgccaagttccacattactttcataatattttgcatatgttttctctttactttgtattctctccttcctgatctctatcctcttctgacttttttgatcccttactcttctggttctcctgtctttgatcgttttatttcaggttattcttatctgccccttaaattacctatctgcaagatctcagctcactgcaacctccacctcctgggctcaagtgatcctcccacctcagcctcctgagtagccagtaccataggtgcacaccaccatgcccagctaaagggtttcaccatgtcgcctaggcttgtcttgagcttctgaactcctgagctcaaatgatccacctgccttggccttccagagtgctaggattataggcatgagccactgtgtccaaccgtccacaatcttttacaaatcaatgtttaccttccttcttggctatttgtatgtagtcttaagatatgaactatcacttacacacataactcccaaataaatatttctagccttggaatattctgagaacttcagacacatatatcaaactatctgtaggacagatgtccaactggatagatggacatttgtagaatagatgtgcaattggatacatgtccaaacttaactctccccaccttagctgcccccaaacttgttcctcttgtcatatttccagtcaatggcatgaccatccatctgggttctcaggacatacatctgaccatcattcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatcaaaataagaacaagtacaacaatatttactgtctctctggtggctgcttacttttctaaaggatatagtttaagctctttagcctgtcatattgtactgctccctacctacttcttcagctttgtctcttgtcactccagaaatattcttctgtcttttaatgtgttccctctgctcagatgcttcttcctgccttctttacttagtgaaccaccatctgagatttcttggaggtagacacgatcacatggctggaatccaaaagggatggtcgataagaaccggcttcagtgaatgtggatttacatactttctgggagctctgtatgtaaaggaaatgcttccagcccttcctcgcttggctcttggcatataacttctgatggctctcctgctttagtagtcacttttggagcaatgagagatcagattcctttagtggcctgggaatgatgtcacatggtgttattgatagaagcctgcagagcttgggattctgagaagcaatcttcagactagaacttaccccaagagaatgagcaactctatggtagagggcgagagcctcgaacaggcccaataacctctagtccaaggactttgggaagttttatggtcccttctaggcctacaggatacaagcactcagggatagcagtgtttttgggtaaagaacagtgcggggctctgggctcaaattcctgggggcaaacaaatcaatttggctcccctcagctctgtgggactaaactttaaaactgcccctgggagtgacctccccaggataatctcagggtactcagtactcacctgagtagacaagccccaggaagacctggatgagtctttggaagtcatctttttagctcagttttgcctgctccaccaggatccacaccctttactatggaaatctgagtacgagttagggcagatgtcagtgaggagaaggattggagctcagtgacctttcctcagtagtgcttacttgtgaagcctgtgtccttaggaaattagcgctgcctctgccaaagtggctttttactgtgttatcctttcccagagtgcacttccagtctcgtttaggccagtgtagttcctgttgagttaagtggctgtgaaaaaaatgttttctgaaaggaattcggaggaaagataccttattccagtgaacagtttgcgaactcaggagacacagccttttgtataaaaggaagttatgtttcagagaacaaagagagtgtttgggttttatagcaaaagtttctgcctgagttcctaatcaggtttatttatgcaaatgaaatattgaaatgggcttagttctagttggttgatgcagctaagttctgattggtaaatacagctaagccctaattggttggtataggtgagctctgaaagtcccaaagttaaagagaggtgggagtttttgggaaactcagagtgacctttagtcagcaaatggctgcctggctgtattttaaatttaggcccagttagccacttgggatccatcttgaaggattgactcttttaggttcatatttgttcacatgtggctttcttcctctgataccttggtgagcctaatggagactaaaagcttagttaactttggctttagggaattaaattatttctggctgagacactaagtagaagctaaaattgcagaaatatctttataatactatgtgagagtttacaaaaactctcacatacattattcaatttattaaatcttcacacaagctagtgcctgtcccttagtaatcacatgtttagtgtatgaatgaacatggaggtttttgttttattttgctttgtagagagacagggtgtctctcactcttgcccaggcaggagtgcagtggtgcgatcatagctcactgcagccttgaacttctgggctcaagtgatcctaatgcttcagcctcccaagtagctaggactaaaggcatgcaccatcactaatgcctggctgtttttttttttgtagagacagggtttcccgggcatgtcttgaactcctggcctcaagtggtcatcctgcctcagcctctcaaagtgctgggatcataggcatgagccaccacacctggccaaacgtggggatttattgtgcctattttacagtttggcgaactgaggtctaagcagctgaattgagtttcctaaaattcaactctacagttagccaagtatggagcctacacttgaaattagatccatttcaggtgaacatttactaagcatctactaagtgacaggtacttatcagtgatgaataaacatgttccttggttttgagagcttataggcttgtcagaatatgagcaaataatttcaacacaatatgctaagtgtcatgatagagaactttgtgtgatgccgtggagtcatacggaggggcacctaatccagtctgataatgttgtgaaagactacctgaagaagtgacacctcagttaagttttgaaggttcattggagattggccaagggtaaagatattctaggctgagagatcagccccagtcagggcacagaggtgcaaaccagtatggtatgtttttaggattgctggagtattccttgccaaggggaaaatggcagaaatgatgacttagagaggtaggtgagattcagatcattgagtacgtagactttgctttgtacaccattagttactacacattgctgaattattgaaatcatctggggaacttaggcattttcttagttagctagatttgagagtcacatgtggaggcaatgagtgacatagactgccctgttgcatcactctggtgacagtctacatggaggcaggtagatttgaaagggatgctactagacgcctagagaccattttgaaggtcactgaattcatctaagagatatggtggactgtataaggcagtagcagtgaggacagagaggaagaggcagatgcaaaatggtgaaactcttacgatgttgtggggaggattggtgagggagagaaaagtgtctaaggtaattctccaggtttctggcatggctgtctgagtagatggtggtatttttgaccaagttcaggaatgaacagtggagatagaatgtacaaaaaaattggataaattcagcttggaacctgctgaatttgaggtactgtgggacttccagaggggagagcagctattttgttctggaactcaggatgtgtctaggctggaaatacaggtcaaggcctctatgtctgggcagtttaaacccaagtgaatagtaagacatctctcagagagaatgtgtggagagtgcatcttcaataattctaccccctttcgacttcaaaggctgttcccatggggaagcagaagcagcgtatttctctctctctctttttaatgtttgaggcaacaagggatactgaaaatgctataaaaggtggagttagaaaacctgagttcaagccctgcttctgacacttcaccactctgcaaccgtcagtagttcctgagcctctcttagcctccaggtcttcatctgtgaaacaagggtagtaggaataactgcttcacaggattattaagatagtccaatgagaatgtgtatgtggaaagtgctgtgtaaagaaccatagaaacatcatttttgttgttgttgttgtttgtttgtttgttttgtttttttcccctagaaacttggaccaatatgtaggaattacggggagacagatttggtccaatataaggaaagactaatactttgactgttggatgatgggaagagctttgggagatgggaagctctgaggctctggatatccttaagcaaaagccaggtttctgggcatatgctgagcgttttgttgtcaggggttgggtcatcctgcatgacctctgagttacctttcaggctcagatagagtttgagttactagaacacttatctacctattttctgaaattttctacactaagtagattttttaaattgtaaaagcaatacaagcgcatggtctttccctttgactctcttaaagtactgggcattttggatcctaagtggagacttggtttatataccctgaataatggggcaaactgcctcatgtcttactgcatgaggcatttatggacagacattttcttaatgttctttaatgagatctctttaaaataataatttttttcttattttcaagcagaaatgatattataaaaagctaacaaaatattgccaagtagaggtcttgatcgagtatactccaatgagtaggtaaaggtcatttgaaatcagcacactaattatttatatgcaaatgaatttgttagagagcttggaaagagttgttctctgaactgggttaaacatcccctaagagctcatgtttatactcttaatttactcagaaacctgttgttgctctttctttttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctcccccaaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttcttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcatttgggtatatacccagtaatgggatggctgggtcaaatggtagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagctctttctttaattgatagaggaaaggtgaaatatgccagccatgactgagttatcacaaatttagaaatggcatgaattgaatttatactttcctgtgtttattttattgccaatcactgatgtgacacacatttgctaaacaagttctaattttctgggtaactttccctacagaaagcttatttcgctaaatgaaagatctctactcatgccatttaatgaggaattatctttatgattgttgaggtgtcttcctggctctttgaaaaaatcacaaaaacaatagccccaaataatagtgattttatacctagaaaatattctacaaggaataagttgctgtaaaccatatagaggtgaacaattttgaaaagtcaagaatttaggaaagtacattcagtcttaattatggtagaataaaatttcatcttcctgatgcttccataggcccttcaagatgtttgcaaagcccttggtcagcttttgattattttttcattgtactgtatctatgaaaaaggttgccattgggaaagcataagtaggttgtgttttgcaattccttcttgtggaaggaaattgatagaaccttctagttgattttttgaaaaagtaaagatgtttaaatactcttgccttccctaccttactccacacttctggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgctgcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagtcttcagccaaattacgagtacagcaaattaacacaatttgttaatttcctttttaattacactacgaacaggagtatttctgtattttggcttttttttgacatagagacttcatcttaaaagcagaaagactttaatatagctaaatctatatctataacaaataaagcttgtttcattttccttacccagctggctaagatttatacattaattattcaaccgatgcatcttaaacatcctagttaaaatacacactgttggccagaaattgttaaacctccagcatacttttgtttgcctgtaaggaataaatacttagaactgtaaatgggtaaacttaatctttccatgtggtgaggtcaacagaactcatggtgaacatacaaagaataggggactaattattattgagattcaggtaagtgatttcttaggcattttagctgtcatgctgtggaataattgtaaactcaccaggaaggaattgcaaaacacaacctacttatcctttccccagtggctatatagaatttttttctgtcctgcagtttgtgccaactctaatcattaaaaggaatgttattttaagtattgcttcctcaataacagtgtttgacagaaactctacagaatggtggctttgcccagagtgtggcttcagtatgctagtgtgatttaggcaatcagagctattggtaatggaatgcagatctctgtagcaattttatttaaagttttgcctagttaatattatatccaactaatgtaaccatctgtatccggccccatcagtgacaatataaaactgttaaacaccatttcataggcattaagtgctttggctttggtataattttatgatcatgtcttattcttattgtagtacttcattactatcttttttttttttttttttttttgagacggagtctcattctgtagcccaggctggagtgctgtggtgcaatctcagctcactgcaacctccacctcccaggtcctggttcgagcaattctcctgcctcagcctcccgagtagctgggattacagacacacaccaccatgcccagctaatttttgtatttttagtagagacggggtttcaccatgttgaccagactggtcttgaactcctgaccttgtgatccgcccgcctcggccttccaaagtgctgggattacaggtgtgagccgccgcgcccagccactatcatttaaatgtcagtaacagcagcagcaagtattctaggcatagcacagagaccaaggtaatgggtctcccagccttgtgactaaattcttcctgcctctaggtcttcacgtagtctgttgccttgtccaggaatgcccttcaaaccttggtttaaaggccttttcagataagtctctctttttccccctagtattcttgatcactgtacctatttgtcttctccatagtatttatcacaatttaaaattatacttgtattttttaaaaaaacttgtctcccccactagaatgtaagctatacaaggacagagaccatgcctatattttatttattattttaaaaaatttttattttttaattgtaaattaacaaattgtagttacatatatttatggggtacaaagtgatgttatgatttatgaagacaatgtggaatgattaaatcaagctaattaacatatccaccacctcaaatattaacccatatatccttttgcgtagcaaagtaaatagggactgtaaatattttttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggatttaaataggtgattctatgttgtaaaagttttaaaaatgactgtgcctcaggaatacattagctagtttgctctccaagttgaatattccaattaaacaatatttttgtggttttgtgtttatttttattttaacctttctctttacaataataaaagacaggaaaaaatccaggcttgctcatgtgggtttggtaatttgaatatagattttctgtgactagttagtgtaccagtgcctaagactggggttttatggattcttggctatgtgttagtatgggtgtgtcaggtccacataaagggtcccaaccctccttctcaggccagggcgtatgaatgattgcttggtaggaggtgttattgttcagtgtctgatgctgactaccgacacgcaaggtggaatgtattctttctgagaaccaaacattgtagcggagtagtaaaacaccatgtaaatgtccgtggaagggcgcagttgtattgaacattgatgacatgtcattgtgaagggtctcaggaggtagtgttccagtttctggcatgggaggtgatcgtgggagggatatataggctttgaagcagggacaaattggacaaatggtgtctcccacttgactgtctttctttgttgcccagggacagcatacttttaatacttctccttggcatgatgaaaggtaaggccactcctgactttggtggcctggggcaagggtgcaaaatacagactcactgcaaattcccacttctcttcaaccttctcgctctgttccttcccctaagaggacttccacacattatatttgaggagccttgcttctcaaagtgtggaccccagtccgcagcatcagcattacctgagagcttgttagaactgtggactctcaggccccactctaggcctgctgaaccagaatctggattttaataagatgctaggtaattcacatgcacattaaattttgagaagcactgccatagcccacgtgttcaagctccatcaacactgagtggaggggcaacagctgccctgtggccacccctcagtcactcttcaggcctagggtttagtccatccttaggaagacagaactaggaaagaggatcacacaggctccaaaggcaggcttgaggcacatgggcagaggatttcaaggtcatgggtatcctgaggatagcctctaagagggaagcatagacttggggttggcaagaccccttggccctctataccccttgccctgtgaggagtgtggctgcagcagggccagagtaaggccctgccaaccatgaggcctagggcaggatctggttgtcccagtctaagagtgatactgttgaaaggtgtcccaaatattcaaggggatgaagatttgagtgggagtgattcatagctccctgaggtactggccagcagccagggtcttggtggctctttggagtgtgcggaagttatggtggtgggaccattactgctttaagagggaatcagtgtgaactgttataagcaaagtctttggtagctagagacgtatacattgacttatctgtagaaggtatacagcgaaggtgcctcctgtagtgcctaataacaatttgattagattagctactagcctccgtagaagacaggtggatgtggctgtggagggctttgaacaacttccttcaaacctaagaaacgggccacttttctcgaagaattgagagcagtgtctggtgtggttgggatgccgtggctgttggaggggcaaaatatgccattttgtgtccaccaccacctgtatgatgccacggttgtgggacagaggcaagtctgaaatgaagatcaacagattgctgtcccagctcccacaccccacctcttcctctgtaaaatgggtctaacagtccttgtcctgcctaccttgcggaggtgttgggtggctctagtgagacaatggatggaaaagtgctttgcagcctgtcaagtccgtgcatgaagaaatgatgatcattctgccatttgttgtctttcctttgtgagtgtgtcttcacctgcacttgagttttagatttaggttgccctctccttagcactgcagctttcaggtcacagcaacatacaaggttctgtgcaaagccatatctgcccctcttcctgacaccttccagcctcttccatgcagatacactgctgtgattctcatttttgagttccacagatttgggacggagattttatattggcaaatatttctgaagagacaaataattgcctctggaaagaggcttcttttctcttccaaaaattcatatttgctggtttaaattgatgtgactattttttggctagaactctgcagtatttcactgagcagtaattattcctttggtgttgcaggagttttctgagagaagggaactaaatctaagagagcgaatccatctggtacatatgttgaagctctctatgaggccactgacactgaaatgttaatgctaggtttctataaactggtatcatttagatattgatacaatatgagctagtactctgggtcactgaaccaaaggctgaattccatttccttatatggcactggattcctgcaccagtggattgatgactcttggcagagtaccatggtaagatagaccctgcattccagtcctgtcacccgattgtcagactctggctgtcccagccccaatcaggagtagacactaaaggccagcagctggcaaacttagtgtctcttagtacctcaagcattggtaggtaactaagcttgacgggatagtagaagtacctacacatagtaggtaattaattctagattagtctgataccttaagtgttaagtgcccctgagaagaacccctggggcccatggagactcactaatctgcagcttttctttttacattatggtgtgggtgaaaccaggatgtgttccaggactgaactggtggctgtcctgcttgggtggggatctggcatccagcctagccattgctaggtttttccctggggtgttggactctgtttctccaccaaactgccaactaacattcaattcaaataaaatgtcttagaaatatggtgctgccgccgtatgtaaggtgcagggtggcagcaccatgtttccaagattagtattgccactgtgcaaggtctttcctagccagattgttcagcttgcatttatcatgattttttcatctttgtaacttggatagccagtcagccctcttagggacaactctggggctctccaagttctgattcttcttgatctgtgctcattattctttttctgctcttcttacattgaagtcttggaaatcccaaccattgctataaaagttctgttgcaaagaatggaaaatagcctattttatcccatagcccagttacacatacatagggagctatggacatctcactgttcactttgagttgaacttgaaattcctgcctctcctcttcgggaagtattaaccaaagaagccacaaggggattcactagtctcctatgaaataaaatgctatcagataccaaacagctaactgtccagatttttcagcaaaaattggctgctttagttttttgaaattttttcctctctcctctgtagttcagtatgagagactcttcagggcaaattgtcagtgggaggaattcagagatgccatatgtcatcagtacatggctgaggagaagccaaaaaagtattaccgccgttttcccaaaaagctattagggaaggttattgattgttttccacacaccttccaccttcatcacagggtattgtgataactaaaaaggtactttcatgtagctcttaaaaacagttttctccttttttgttttcttaatatccactgtgcccaggtcacttcacagagctccaaagtgatgctcctttctttctccataggatttgtccttgcccttctggcaaatggacttgaattgctactgcttctgtcagctggtggctatgtttacttcaaggtctttgagtaggccagacaagtccaattacataaatcattattgactgctgtcaaccccctgtccctccctcttacacttgtttttctacccctacctccctctgctttctatataggattggagatgccatttttttccttcagactttcaggctttttaataaaaatggtgcttaaaggtacatgtcagcagacttttgggtgacctttaaagtagagtggtatttggtctgtacaaaataacccattctctatcatttatagattgtccacattatacctaattttaaaattcttgatgacatctattaggcttaagcccttaaactagttcatgagggtacaagggtattgtagcattaatgccctgtaggtaaagtgaatgttggtatttgatctttttttttaacattcttaaattattattattattatttattattattatactttaagttttagggcacatgtgcacaatgtgcaggttagttacatatgtatacatgtgccatgctggtgtggtatttgatcttttagttggtacctggaccatccttcagtggggctttcctgcttttcccctttccccttttgtgttgttggattaaggtatatttcatttattcttattctgtgttcatttcaacataagcatcacagacccattaattaagaacagctggctatgttctcctgccacatttctaatttctcaatgcccagttgacaaacagaatcctatctagagcaaagtcatttgttccaggctcagaacacatggagggcccagaaccatacgttgcacttttgtttcagttagaagtcttccatgggcttttcttccagtcacactaaagtagtatttgcagaaatgaagtttctttgggtcttgttttgtttttgtttttgaagatggaatctaagatcatctcagtttagttctttgcctttttgttgttgttgtttttgagctcatatatggggtatgtaggcctttggccatttgaagcattgcagggaatggtatgttttagttggtgcatttgttactgtaagaaatcagcaaatggtttgtggtgccttttaagatttatttagcacatatttttcctatgggctaggtgctgagctggatgctggggatgcacagatgagaaaggcacagcgcctgttctcagattgtctcacagtctagtaggaaagagagagacacatcaacagctaactctgatacctaacgatctggatagaaaatttcaggtcagggcactggcatgaacagagattgagaacagataaatgcgtggtttgttcagggaatcacttatgtagtaatatggatattggcagaaaatgactagagacaagatgtaaaggtagattcaggtcacattttgaagaactgagatttttagcttttagaagattatgttggtatcccttgaactcaagatgttgggtccaaggtagtgattctgtctacattcttagaacttttttgtagagtagcaggaggtagaagaaaaagttattgaagctgaaatagtgatccttagccttagggacagtgtgtgtcagaggttagagcatccagcatggctggtggccagagctttgcatcagtctgagatgtatgtgatgtatctttagctcagggaagagagaggacttgatttttgaggaaggcttgggaaggagggatagaagagctggatagttttgctgctccccagccagaaatttatagtttgatttcattattgccttgaaatattgggatgtcccagaacacacagccattcatatttaaaagtaagcatggcaacctcacgtctgattcggatataaagggctgatttggcttatttatatgatttcaattcacaggcagccataatcaagtgcttactaggcttgtaagagcagccagaggtcagaccatttaggaacacactggggatgataggagctattggttacagtgcaccctcatccaggcacatgtatcattaccctctggcccatagccacaagtatatccttgtccccaacccaccatcttccaaatgcacactatgattataacagggagcatggttggattgatgtggcagtccacatggaaacacagattttgccagaggtcctctttcctgatgttgtttcaccttcactgtgggctgtcattcatgttgcttcatatctatgttgctttgctgtaagatgcatgggtctttcatagactgctcttccttttttgctattggggtgtgaaaggtattgctcctttaaaaaagtacagcagggctgggcgctgtggctcacacctgtaatcccagcactttgggaggccaaggtgggcggattacctgaggtcaggagttcaagaccagcctagccaacatggtgaaaccccgtctctactaaaaatacaaaaaattagctgggcatggtggcaggcacctgtaatctcagctactcgggaggctgaggcaatagaatcgcttgaacccgggaagcggaggttgcagtgagccaagatcatgccattgcactccagcctggacaacaagagcgaaactctgtcttaaaaaaaaaaaaatagtacagcataaatccttccaaacatgagtagagaaactctctaaggaagaaaaatctctggatggaggtgccagggtctacttgggcaggtgttctattgtgacatagctgtctttttttctgtttagcccttggaaaaatgtgtgttttcttggattcaatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggaacctgtcttaagggtcaagagatagttgagttcctctattaaaaacaatgaaggctagaccctgtcttctccattaggaatcctgagcattggtgaggaaattcatactaaaaccttgctgctaccaatctcttattccttatactggatctccagtaaaatgtgcatatatatatgcatatatatatgggtttaaaattatttttatcaatgcaataatatgaataatttttgtaatcaggcttataataacatcaacaaaaccaatcaggccggtactgcttcctcccaatcctgctcctcttgcttttggtacttaccttcatattttatgtaatatgcttatgctgccattacttgattcattattttagatattgtgtgtttacttcttgtgatgatagatgagaggctggctgtctcatagtccctatcagtcgagtatggctggtctgtgctgcataacaagacattcctagttaccaggggctttacagaacagaagtttatttcttgctcatgctacacattcaacttaagtgggcagggggcctctggctcatgttggtcactgaaggatggacatgggatgatggaggctccaactcaacacctgatcacatgatctatgaaatgggcaaataaagagttaattgcctgctgcctctcaaaacttcttcccaggtatgatataaattaattttactcacattttattggtcaaagcaagctacatgactatacttaatctgaaaagaggcctggaagtacaaccctaccatgtgcctgggaaaagatgctctggaatatttgtgaacagccctaatgatgaccatacagcctctccattttctttcctccattactccagtataagtaaatcatgtattttttcaaaattggtattcagtgtttgttattatagctttgcatttatgtccagtgccaagccaagcaatgcattatgctttcacttccttttttgaataatattttattttccccagagtcaataattgcctaatttcttatttgcttagttttctttttactcatttcttattttctgcacaacattcatcagatttatcaagtagtcctcagtattattttttgaacactgaaatatatcagataacctaccaattttattttttcttggagtcttccagcctcccgcttcagccttggctctctgggccttctgtacaggaatcatcctccctttgccagtttcctgtattaggaccctagtttttgggtcttttgtctcctttttaaaaattatttgcttacttgttttgctggagcacgtgctttaatagcttcctaaataaaggtttatgacaaattatattagtcagctttttagtaggctatgccgtggtgcaaatgattccaaaatcccaatggcttatacaagatttctttcttactggtatcctatgtctttcatgggttagcagtagttctagccaggtctttttcactctggcacctaggttaagggagcagcccctctctaggagaagcagttctcatggcagaggaaaaatagcactgattgaatcagtgttggctgtcaaagctgctgctctgaagtggtacacatcacttctgttcacatgtcattggaaaatcaagtcttatggccaagcttgatgtcaataagcctggaaaataaaaataatccttccacaggtaaaattatatttttgccaaaggaaataaatagctgtgttgcgtataaaattatgaattggtttttcgcagaattttgaaggcattgctccattgtctcctcgttttcagtgttgttatttaaaaggctgatgccaatctagttctggtataagagtcttccgtataagcattgtttttttcctttgctctgaaaccttttaggttctttttttttttagcccttataattcagacatgttttgacagtgtgacttggtatagatctttatgcattcattttactgatccttccttaggagctttaaatgtggaaatttatgtccttatttttcttacattatgactttgataattttctccccttcgttttttctttctgaaatttcaattatttggatattagacctcccatattgttcctctgcttttcttgtcttttcctctcttggtctttatgttcttctttttgggagattttcttattttaatccttttacttttttgcagtttgattatcatattttcagtgtccttaaattcctttgttttctgtgtcttcctttttgtagtatcctgcttatgcttatggatataaattttctcttatctctgaggatattaattatagttttaagttttcttctgttattgtatcatctctgttttctctgtttgtttgttttgacttctctcatattggaagagttcctcaaatgttttgtgatccttggctgtctattcatattgaagagtggaactctcttgtttcctggggacaaagggagaggataaaatagttatctaggtagctgcatgctgaaaagtatatatgggagcctgctgctccctatacagagttttaattcctgttttcctgtgtcttatcccaatttctgtggtacttggtatttctaaacccttaagccttcccaggattcaatggggactaattgtttcacttttcattggcatgtctttctgcaagcacttaggttctaacttgcttttcctttactctctgaaataaatattcgttcttcccatcatttcctgtcttcgaaacatttatggataattcttgtccactaatgtctccttccctgttttcttagtctgcgtggacttaacacctctttctctctgtctttctcttctctctctctctctctctctctctctctcacacacacacacacacacacacacacacacactttttatttgcattgttttaattccattaatgagacttcgggagggagagagataatcatgtgttatcagtctgccatgtttaaccagaagtcaagctgtggtagaattttttaaatgtagttttctttacctcatgctaaactgagcatggccttaaaatctacccctgttctttgaaataaaactagccttatacttggatagatgacatgctttcaccaccaaattttaaagacaaaacttgaatgttgatggaaattaaaatgtgtttagcactttctgacactatgcatggtaaataaataaatgaatgaatcagtgaaaagaaaggaaagtcaccataatggatactcttgagtttcccactccagctgcactctctacccttccttaccctgctctgggcccctggagactgacttctatgggctgcatcaaccaggctcccttgtcctctggcttccagttaggtttgacaatgcaacgtatcagtgggggagggagaaaggatcagagggttgagaggaaagccagatctcagtatttacttctccagcttcttctctgccaggtcacatttggcagtggctgtgttccactatttcatgccatagcttgtgttgggttgtccctctctgacagcctcagcttttaccaggttctggtaaccattactctccttctcacttcaggtcgagagatggtagtggtttcttcctgctactgatccaggaccaatgcaccttaccttataggttcccttaaccctgcccctaccttcagttacaccttttgaatgtgctgtgtttcctgccaagaccctgcttgatacaaatgttatggtagcactgtctcattatcatccatgtattcttgaacaacatactccacatcatgggcctcagtttccatatctgaaaagtactaaggtggcgataggtggtctggtctgtcatgtaagaactccttcctgttctgacatctctggttttatatgatgcagcagtggtcagtagccagctctagctctaagttctcttttatagactttgtggaccattgtggataattctgagtggtggatgatcacaaaacaatttcttcctgtctttgggaggcagtttgctggagcaaaaggattatagactttggagtcagaccagggttcaaatttgagtgtactactttcttactatatgacctttaatccattactaaacctctctaagtctcacattcttcatcttaagattagggtatatgatggacactgctagttatctatcctagccgttttcttttcccttgctaaaagaatactattttccattacatatgtagctgaacatttagttggatgttttgataaatgcagtttgcatagacataactagtatttactaccatctgattctctccttctgaaagcatgaaagactaatttccaagcttcctatagttaggtgggatcatatgattaggtctggccaatgagctgtgagggaaaattacctgtgacactttggggctgaagtagaaaaaagcaagtgtgcaatctctgtgtgctctcttacccctgctgaggcaatggggaacaatctccatggtggaacttccatcaatcaagggtccctaagtgactatatggaacatagacactcataaacttgcaggcaacatgtagcatgagtgagaagtaaaccattgttgtgttaggccattggggttttgtggttgatttgtcagctaatccacagctgaaaagcatccctacagttataggacattatctttcttgtagggttgtatggaacagactttctagatttgattcctagctctgttatctattaacttgtacgtccttggtcaagttacttaacctttctgtgccttggtttcctcatctgtagaatgagattaataataccttttcctcatgaggtcagtgtgggtactaaggaaattaatatacaggaagcacttaaaacaaggcctggcaggtagcaagtgctatgcagcattttctgtcagagatcatgtatttcagagtgtcaaatacagtgtctggctctcaccaacaacttaatgctttattacctttattgctgtcataagggttagaatgatccatgtaaagtcttcacatatggtggccacttaacacaatggcactattatttgatgactgatttttgtgcttaattctggatatatgcccctcattttttagttctcttaatcattgccctctaagatttccttcacaacatgggaggtagttaagtgtatggatttccaagagtagttctgaatacgaagttaagaagatgttgaaatggcagcaaagccttaatttaacagggaaggcattcatcaaaagtgttgttatccataagtttgaaaccaaggcgacccacagagaagctacacttgtgaaaatgagccttggataatgagtatttcattatatttgccatttagagcccttacacactgtctgtccatgctcttcattttgcagatgagaaaacttaagcctagagaagggaaatgaatagtctaggataacacagtcagttaacagcataagcagaactagagcccaagtacactgattcttgatctgtatctacattttgcatctgtaaagctatacaatatttccttctagtacttgaataagaaagtcattggcttttcatctcaaaactctcaaaagcttagcagaaactcagagatgtggtttcggaggaaccagaggaattcaggtgagcagtgtaaggtagaaaaagtcaggtttggtcttgtaacatttgtgccatttgaaaactgttgtcagacaactgcaaccctagactcaatgtgaaaattaaagtaactttgcttttatgtgctgtccttttcagagctcatcatccattttgttggtgccattttgctcatgtctttgaatacatcaaaagtggcttgattttctctttcctttgctgtctattcactggctgcaagaatgtcctgtccattccagattttggatgggctgtccagaatcaccacagacttcgcttcttagccagctagaggaaggcagaaatgaaagagccctgccagcgtgtttcctttctgtaagtttccttggacacgaacacaggagcagagtttctatggagcagctggtctccccattttggattttgctgaggcaggtagttgaactctttgaggaagtctgggttttctctgtcttgggaaattactgataacatcagagccagaaggaggtgagtaaaatggaaaagaaaattcataagagtcgtgccaagattgagatttccaaccccacccaattcttccccagctctcctttcagctgctacttgcttcccaggaagcaacaaacaataggctactgattgaatttaggtctgaacttcatacaattaaaggtgaggcaagtaaaacatagttacatttagaatcaaagtctccgtgtttccatcaggaggcacagtctgtatgtatactttagaaagtgggtctggttctgaagccaaacttgaaagcccattcattttggtaattattttcttttttaaagcaagaataatctttattccttggaaactaatttataaaattgttatcaataagatgaaaagattcatggtaattattttcttgttcatagtttcttgctggcttttttttggaactaatcacttccaggaaagtgcagaggtcttacagtgaagagaaggaaaagcatattaattgtagctggactgggtctagatcatgagagctggaatatcctaagatctgggacaaagggacagccattgggcagctgtactttatggtaggcaacatagcacaaagattcagttgtttcttttttaccccctccaggacaatttaaatgtctactctggttagtttctgagagtaggtaccatgttacttaaaaaattctactcattgtaaatgaagttgtatcaacacataacaactgccacttggaaatcatctttgtctttccctgatgtccctttttcgtatccttctctctagtactcattccttcagtcagtgaatttatgctgcaacttgactacatgccaggcacaacaccggcaccattgatataatgttgactaagacagtgttccacttgcttattgctgtgtgataaaccaccctcaaaacttagttgcttaatgtaaaaaccattttactatagctcacaattcagaaattcaggcagggctcatcttggtgattcttttgatcaacacggattacccagtgacactcagctggtaaatgcgctggtatggtaacctcctctctgtatccccctctccagtttcacacacatgtctgtctggtgctttggcaaggatggcaggaaggctaggctcagctggccctgtcaaccagagaacctacacacggcctcaacagcatggtgacctcagggtggttggacttcttatgtgtcagctcagggccccaagggctagtgttccagcgatccaagtggaaaatgtacaaccttttatgactcagcctctggagtcccaaaatgtcacttccactgcattctcttggtcaagcaagtcactgaggaccaacccagattcaaggggaaggtaatcagattctgcctctcaatgaaagaaatagcagagacttgatggacaactttaacgtgtcacagacagccagagctgcttgatgagattatatgccaatggaacaagcagcagactggtcagcaaatagtccaggggcagaggctaccttgaagaagtgactagaaagcctattgagtagtatagtgaataccgtttgaggactaagctgctgagagtctgaggttgctgccttgtgctctcttggaggattcctgtgatgccccccacctcctgctcagcattacatatcatactagaacaacaaccaactctgctggcaaacacacatgcacagggcacagtgcgtagtcctgtctctacacacagctgctggtttcattcggattggttaaaatctaattgtttgaatgaattcaggggttgctaagtgattagtacttatttaggctagttcagtcagaactggcaattggcattgttgttccatctgctgaggctgttccccctcttcttcctcttgctaatgctgctcattcttttgaattcagtatgaggagccccttcttcctggaaaaaaactttttgaccaccctcatcccaatttaatttagatgcgttcctcttgactcccaagcaccacccaaaaatgtactgttaatccagcagacatatctgcaacgggaatgtcaactattgaccaggttcttgctgagagagctacagatactggggtgattcagactgatacagtcgctccctacaccagtaaatctcccagtctggtggtgaaggcagatatcaaacgaatcgttaaaaatgtattgaatgttcctaataatgcctgactcagagtcacatgggtagtgatagggactgtgccatcttttctgttgttgtcatggtgcctggcatataataccatatcagtaaatgttttttatgtgcatgaatgaattttggtggtatatttattgaacatgtggataaagttatgtcagtagaatgtcatttatctttttattagagcccttctaagattttaccaggctgggccatgatgccttccattaagaaacagtggattggggtggagggagggagagcattaggaaaaatagctgatggatgcggggcttaatacctaggtgatgtgttgataaatgcagcaaaccaccatagcacacttttacgtgtgtaacaaacctgtacatcctgcacatgtaccctggaacttaaaaattaaaataaaaaataaacattggagacagggcctacatctggatccagtcgatcctttttgctgccagccaggttatgccagcctcctctcatcccttggtcagtctgatatctggggggctgcaaagtggtacctcacatatcaagttttgaccttcttctctgttaacctttgactttagctatcatgaccctatcgatagatgaacctgtttcctgctgcccatcatatcctatcctttggaataatttgtggcagtacttgactagggcttttctgacctagacctgtcctgagcagacacatgttgtcctctgccatgttctggggaacctaactggcagctaccttgatccttcctggttcacttgccttccaatattggcttttccctaatatgatttccagatcccaaggttgttggttagttttttgttttgttttgtttttgtttttgttttttttttaggcaaggtctctgttacccaggctggagtacagtggtgccatcacagctcactgcagcctcatctcctgggttcaagcaatcctcccacctcagccacccaagtaattgggactagaggcatgtactaccatgcctggataactttcttattttttgttaacacagaatctctatgttgctcaggctgttctcgaactcctgggctcaagcgatcctcctgccttggccactcaaagtgctgggattacagatatgagccaccgtgcccagtaatcccaagtttttagaacaacaacaaaaaagtatagtccttggaactagacataattgattttgaaaggatttctgtatttgctagctttatcattctgagcctaattttctcatctgcaaaaatggggataaaaatcgtgacatcacagggttattttaagtgtagtacctaccatgtaattgctgagaaagtggtagttccctcccatatcccatctcaatgtattgacttttgtattcaaagaagacattattgattactttctctccagtaccttatttactttagggtacttttcctagatggggatagtggcttgcttccagggctggccttgaccacaccgttatcagagcttctggactccaatgacatgactacctgactccctcacttggagaatctgggtcccatggcttctggcacaatgacttcactatggctgcagttctaccttttccctccaaccgtggctcagtgccaggatagaaggaaaatgcgaaagagtttgacaatatttcagagaggagacttttagcagaagttatagctttgctgtcctgggcagtgttatgaaggagctttcccacacattcctctggatcctaccttcatctgccacctttactcctggttctttcttctaagaggatacagtagtatatttgggtggcttgtgacatgacagtatctcttattttgacctcccatagcatttaagcatttattgtctgtaaatgtttaattatgtttttctctctgtgaatttcatgtatgattaaagtatgctagtcataaatcattcaagataacactaagctcttcaatggcaagggttatgaatgaatagcccagggcctgaacacaacctgagaactgctattttttttttttttttttttttgagacagagtctcgctctgtcgcccaggctggagtgcagtggtgcaatctcagctcactgcaggctccacctcccgggttcacgctgttctcctgcctcagcctcccgagtagctgggactacaggcgcccaccaccacgcccggctaattgtttgtattttttttagtagagacggggtttcaccgtgttggcaaggatagtctcgatctcctgacctcgtgatccacccgccttggcctcccaaagtgctgggattacaggcatgagctaccgcgcccggaccgagaactgctattttagggcataggatgaaaagagaagtcaatgaagaaaactgaggagaagtgagagaagcaggaggaaaaacagcaaaatggaatgttaaagaaccctgatgaggaaagtttaggagagacagacaacaggatgtaagcttcaggatattttggagggttttgggcacatttcatttacagggtcataagggtagtgaagttggaatccagcactgttctcatcagtgtcaaggagggcaggaccagctttctctttatgtaaaccctcaaactttaatgggcactagaatccacaatcctgggccttacctacagagatccggtttcaatatgtaggaccaggaactctgtattttaacaaacatcacaggtgatcatgatgctggtggttccaaaaaaaacatgggtctccggttaacaaagtagtccaaggttgtattggtagtttgacagccctatcatgtcttgtgatgaggtaaagtccctaagtcacaaagtcagaatgatagaagggcccttagagggatgatctaccaacgcaactcagtgggggcactgtattagttcgttctcacactgctataaagacatacctgagattgcgtgatttataaagaaatgtttaattggctcacggttctgcgggctgtacaggcttctgcttctagggaggcctcatgaaacttaccatcatggcagaaagcgaaggggaagcaagcacatcttcacatggccagcaggagttgggtgaggtgctacacatgtttaaacaaacagtgctaggaggatggtgctaacccattacaaactacccccatgatccaatcacctcccaccaggcccttcctgtaacactggggattacacttcaacatgagatttgggtgggggcacagagccaaaccatatcaggcactattggaattttaggtgggaccatgcttccttgcaggggactgtttgtcctgtgcaatgcaagatgtgtagtacactttgttcccaccaactagattccagtagcacccctcagtcattctgatgaccaaaaaaccccaaccccatatatttcctcattcctcctaagggggcagtaccatccccactgagaaccactgccagtataatcccttcattttatgtgggagggaaatgggtctcagagcaggggaggaattcttcaaagtccctcagtgagcatttttgaagtaatatactctcaagtctgttattcttcatcctgtatttctgtaactaagtttgggaacctaaatgcaggcttgcctccccagttggatggtcagctttactagaaaagatagagacagtcatcttactaggtccctgttgtctctgacagcatcaagtatcatgctggctacacacaggcacctcccagatactcactgaactgaattgaaccacaaaactctgtggagctccttgaagatgaacaagattcagaaccctcctaggcagtaagtcttctttcaggagggaccgaattgtttgtttagattgcactttgaagagaaacattaactcattagcatattcttggtacatcaagaacattcatctggaccctgagccccgctagagtgtacatgccaggagggcagggaatgttgcctttcttcattgtttatcttcagctcctagactggtgcctggtacatagggagacactcagtaaatatttatgtatgaagaaatggctccaccttacaataaaagattgtttactttcttcagacaagtataaaataagcaaatgttttcaaggattattatgtccttggtgaaaagtaaaaagtaaatatgagttaaaagaatatgagtaccttgtatttgcaaagaagatttctaaaattcaaaggcttttctcatctactaaggaaaaggtagagaaatgtgccctttttgaacctacagtgaccgatgctgatggctagactaatgtcctcagagagaggctgctggtgctggtgctcagcacaccatcccttcctctgacctgttcagcactgtcaagagtgacatggagagaccaccgatggcctgtgaggagattcacagatgggggagctgggcagccaagtgaaggcatcggctcacacagtcattggctgtcagaaagtaacagtaaaccaaacccaagaggatgaaatgtaacagggaaatgtgggtttcaaaccccaatgaaccacgcaagagtgatctgctttaatagcaccaggtaggaggaagccttcagggtttcaattgatagaaagaccagcagtacctaacaggttgatgttgctgctccaaaagactgagtgacctcaaaccaccttactgaaggctagtgcctagagtacaagaagcagtggtccatacctgcacacacctgttctgtttacttcttacttgtgttcctgtcatacaaggcacctagacaaatgagagtccattcagaaagttaccaggatgtggatgactttgtaacctggttgtatagagaacagtggaaataactggagataatttactttaatattatgagaggagtctggggaccattatagcaacttgcaaagatttgaagggttgacatgtagggcaaagaacagtctggttctgtaatctcctgagaacagaatcaacactaacggattgaaatgcctgcaagtcagattattggctcaacacaagggaaaaccttctaatgactatgctatccacgacttcggtgggctagttcatttggtagtgagttccttgtcactggaagagttcaagtagtgaactgaccacttacctggcagggaagccatagagggggtttaaacgtctgatgagattgaactttatgacttttaacatttcgttcaagcctgaacacaagcctgttcaagtttgggttttgcattttcaaggtgataagtgaatctgattcaatatatgtgaatattatctatattgaaatattcaatatagattcaatattatatagatatctgtaatatattatatataataatatattatatataatataatatatttaatattatatataatatatgttatatataatataatatatttgatatatataataatatattatatatcatatataatatataatatatgatatataatatatcatatattatatataataatatataatatatcatatatataataatatattattatatcatatattatatataataatatattatatataatataatatatttaatatattatatataatatatttaatatattatatataatatatttaatatatataataatatgttatatataatatatttaatatatataataatatgttatatataatatatttaatatattatatataatatatgatatataatatataattatatattatatatcatatatgatataatatattatatataattatatattttatatcatatatgatataatataatatatcatatatgatatataatatatatcatatataataatatataatatatatcatatataataatatataatataatatatgatataataatataatatatataatatatatactattataatatatataatatatataatatatatactattataatatatataatatatataatatatatattatatatattatatatatctgtcaccaaagtaaggtagagttatgatttgggacataagtgaccatcactctttaaatgcctatcattgtgtagattttagaaaatttcatcaaatctcttataagaacacatgcttaatgtgcactaagaaacctgattatcaaagcagtccctctaccaagaaaaccccctgcactccctagctcaccttctacccacccaggtattttcatttttatctgtgggtgtctagatcaggtttgctcaggactaattcacagcaaggtgagaagcaaactaatacaggtacctgtgatttggacagcactgctctcagggtcagggtcaagatcaagggccttactttgttctctggcctgtcttgtttgcttaggtcagggcagtcttgcttattttctggctgttgagcatcttgtgctgttccttcgacattttcactcttcacagttactaacttgtcttcttttgataggttcttttttttgttaaggtaagacctacatgataaaaatgcaaataaaacagaagtatattcagtggaatgtaaggcccgcctgtcctaactaatcctgtgttccttagttccctcctccagaggcagctgctatgattaccttctttcagatccttccatagtgagtctgtgcaaacataagcactatatagatatctgtgtggtcttaaagcctcccatctggctctgcccaccagtttgtgtgatcttttgctcatcttcagctcctacaatagctcatttatttggagccaaccctctctgctaacctgtcttggcttcactattttctactgctcacctgctctcatactgccactctgacttggtaagaccttaatctgggacagggagaagtagaaatcatcatttaggaagagtaaagcatttctagtttctatttccattccatattttctagccctgtgaaattaaattatgcctgttcatctgctactgactcactatattccacaagcaagcaatttgcatttttcttcacagcagcatctttttcctcaggatgctgtggcaactaatgttttaagattctaagaaaaagtcataataataaaacctttccatcctaggcatctaaaaattgaattgtgaccaaagcataaagaaatattattaaagaagctcaacagtttacaaacccagcaatgccatgttgaagattaaacctcgtaggttgggaattcatttagggcacatttgcattctgtgtttttagatgtggctacatgcacaagtcacctaacacatcaccacagaatacaatgtgtcaaagtatttagaatatgagagcatcacacagataagggagcagtttttatctgggaaggtgagaaaagggagtgagggagtaaattggcccatagaattttagagtttgaaggggcctcaaagatgagccagtagtgtaggctaagtacctttggctgcatcactaccaagtggttgtctagcctatggtttgagtacctccactgacagagtgctcgttatatctcaaggcagcttatttcatcaggctgccctattagaaagcttttctttaggccataccaaaatctattttctactgcttgttcctagattaaacttcttcgggctacacagccacaccaaattctttgcaagtatgaaagctctttatacatgtaaaagcagttttcaagtactcctgtctagagtaagcatttaaaattccttcagtggacatcaaatgacattgtttcccacccatccatcatctgtgtgggcacaaaaccttcacctatggagtaaaatgtgtcagttgcttctcttgtgtcttgtttttggcctaagtaagttcaatgagataaccacgaattaaaagaatcttggaaaggaatcaaatatggaagtatttgagaatgagataataaaggcaagtctggtcatacaatttcagaagcttatgcctttaatcagttaggctaatagtgaggccatgagcatagacatcagaaaactagggataaccctcaccatgatctgcagaatgaagatgttaggaaaccatagactctgtgataggaaagtcctttagcaatcagctaatgaaactccatcattttatagatagggagactgagatttgaagaggccaagagacatgcacaatgtcttacagctacattggcagagcaaacactaattaatccatgtcttttgatttccaattcagtgcttttctgtatgtgttttcttaacttgagacacaagcaacagccagatagtaaaggatatccttttatcaccttctctccagtcactgttaaccaattgtatttcactccaaaatatatttcaaaagttacagagttacgtaagaatgctcttaagattcttggaccgatctccaaagcatccctgccttattcaccaaaaacttagcagtttgtgtctttttgagttttgaattaatgtgagcatcagtgaggataagtccccattactgtgaggaatttgtacaatgagcgtctaataacatggataccacaagggagtattgataagacatttgggaataagaaaggaaatattggccaataatgcatattattgcgtgataaaaccctgatgtcatataatcatgttatggcaacatcattctaaacagaaactcaaaatcgctgaattcctccggacgtgtgtgcaatgtacatgggtcttcacgtgtacattggaaatgcacattaaagtggaaatggggagctgttgctgggattccaggatattggagacagacaaggtattcaccctgcaggcacttcgtggatatttttaatttgaaaaacaaggacaatcccaatgtctagatttcccatttgtgtagccccccaaaagatttcagtagcagacctcctatgagtctaggtccttctcaagccgagggttctcaggtagaaattatactgattgagatgagccgttggccttatttgagaatgacccaagtctggttttgtcagacttgggtcattctatttaaattcaggtatagaccctattttctagaccccattttctagagaatctgtgccaacaaaactttgaaaatttgaagacaaaattaacatttgagagaaaggattatagaaaacctgctaaatgccttcttaaaaatgggcccagtcctactttccaatcctataagatagcatgccatcacttatctatgccataatttatactgtattgattttattgtcacaactttgggaatactctgtcatgtgtatttatgatggcccataaatctttggaataacatttagagaccaagtcactatttggagtcaaggaaatagagggctgtgtagacagattagagcccattaatggacccagtgtgtagacctaagaaacctgcctaagataacttctcttgaaaattgagtaaaagaagcccttaaataatagtagctcaaaatggaaagctgtgagctgtgtagcccaaagtgatgactctatttgaaagcccttattttttcctgtccaggaatcctcaaatggtatgtttgtaaaaggaattgacaaaagcatgcagctatacgaggcagcaagattctctggatgagcagatcacagctttcacatattagcatgtcctgaacatgtaactcccagttatagatctggaattacttgcatcatcaattcaatactttgggacttagggctccagttgtattggtgccagatggagaattaatatgttgtctaactcagactagttaaggggttttgctccttggagggagtgggagagaatgtgactgttttgctctcattttcctcatcctgcattagaaacaaagcaaaaagttggctggaatcagtattagcattgcccacagctgctgaactctgatttaaccagatgccatagctatagcaacggggaaatattggaattttgaaattaacatgctactgaaagttgctaaatatatcacgctttgtggaggggttcatattgtaggtatttccattatttctcaaatgacaaagtaagtcaggctttagacagaaagttaatttattatatatggtggttgctgaagtctcccctacttgatctatatctataaatgtgttttttgaagccaaatgagataaatcagtttgattgtccaaggcatagatggaaattggggctgtcataaagccatcttcagatgcgtgtgggtgtcagaatattcatctttggggtttagtggaaagaacctcaggctaggagtcaggaaacctaagtctcagcctctatgattaaattattaggtgatcttgggcagatctcaggttccccattttttaaatgccaggtgttgaactcttctgccttccaattctaggattctggaatagttagggttctatttcccccggctgtggctctagggggtacttactgacatcctgtgaaataagaaagagagacccacatcccaggatccctggatcagagtggtgggtgacatgtaaagagaactgtgatttccccctacaggcttttccctggataagaaagtgttttctccactcaacaaaccctataatgggcctgttggcttcatgctccttcagtcctcctttccccacaactgggcctatgtgactctcagaatgaggccctgcaccttactccactctacctagcaaggctctgaggccctaccttgtagtcaagagagatctgaaggatccacagtcttaaaagcaggtcatggatgcagtatggctgcaagttgatcttggacttttcccctcagtcctaataaatagattgttgccaccttcctgggactggcacaccttgccttctcttccatatccaggagctcattatctgtctactacctactttctttaattattagagagcctggtccctaccttggctttgtacttggtgtctttttccactgaggactgaaattctgttgtccttttcagtcttcctggggtctgtgcttgtccactgccagaattctctgggatcactcatctgcctatccatggagatatttgtctaaggcttctgtccaagactccacaatgtctcatagcctactagccagcatagccttttgttgcttactgttgatcctcagtgaggctgctggcctgccttgcctggacctctgcctgctgcttattaccagaccctcttaaggtgtgcttcatctgctctgtggggacattgccctctaactcatgtctgggcctacacaacacagattattagtctctacttctcatctcttattggagaccctaacctcaaagccataatgggcctgcctagtctctatgttttagatttccccaggctggtctattctagtcccagccaagtttcagttataacttgtgaagactatatgggcagtccttgggccaggttgccctgcctgggccaggtttgtgggcccatcccttgagatgaaagctactgtgtctagtttctcagtcactatgcaccagttaatgaacaaccttgtaaaactttgcttttgatgaccttgtaggctaatttcaagttaatattctgagatggatgatgaaggagaatttttgtgtctttgtagcctacagtaggtagagggatgctgttgggaatttttgagccaccctgagaaaattaggtgaaggtgagaaatgcctgtgtgatcattttggaagctaagttgcatatgaatctaaggtggcattgttagtagtagtagtacttagtctagtagtattcagctccttgccaaggtgcttctggcttaatgaaatgacccagagcttcagctccatagcagggtcacgtgtattggctagctacatgtccttgtgttgaggacttacactttttgaacctcaattttcttacatgtcaagtgaggttttgtggatgatatctttataagctttcagacaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgaggaagtttgaaggagaggaatttcctgagtggagaggaatttcctgacctagagtacaggggctactggcttctttttgtttggtgcctgctgttgcttgtctggtagcttagactcaagttattctggaagcagttaaagggtagaagaagagcagacctaatgtgtgggactattcttataaggtatgacaggatttagggaccaggcaaagggtgcaaagccagtatcagctagtccaaggtaaacccagttcaaaggagaagagtaaatgacctaagtgagcagcaaaggcagaccatatttggacactaataatggtgaattttatgtgtcaacttgactagcttatggtgcccagttgtttggtcaaatactagtctagatattgctgtttagggatttttttagatgagattaacatttaaatcagcaaactttgagtaaagcattaccctccataatgtgggtgggcctcatccaattcattgaaagctttgagattaaaaaaaaaaaatgtggtttcccaaagaagaaaacatttggcctcaaaaccgtaacatggaaaccctgcctgagtttctaggctgcttgaccagccatgcaaattttggattccagactgtaacatcacttcttacccgggtttctagcctgtctgcatgtgcagacttaccatctcccacaatcatctgaactagttccttaaaatctctaacacctgaaaggaacaggactccacaaagaccaacctctctgacagtcctgctgaaatagtaaaacgatcaagcatagagtttttgtgctaaacattccaggggtgcttatttattgaggaacagtgtttctaatcttcaagaaattttattccctgagaaatttccccatttattttaatttgcttgtgcagtcttttaagtgggttatattactttgtacatggatcgctttgctgtgcttttatatgaaaatcattattagtagtcaacataagatacaaagtgtactgcttctataaagcttatcttacagcatatatatagcctgctgaaaatatattgctcatttgttattaaaaatcctacccaagtaaaaaaaaaaaaaaatctctctctctccctctctctctctctccatacgcagacacacacacacacccccatgcacgcacgcgtgcatgcactatggttggaatgttgtttgtccccttcaaaattcatgttgaaatttgattgccattgtgacaatatttaggaagtggggcctttgagaggtgattggatcgacagggctctgccctcatgagtggattaatgctgttgagtaggagtgagtatgttataaaagggcaagtttggcccccttttgctctctccctctcagctcttttgctcttctgccatgtgaggaatagtgtttctccctctggaggatgtagcattcaagaagccgtcttggaagtggagacagctttgactcgatgccaaatcagctggtaccatgatcatggacttccagcttccagaactgtggaaaacatatttctgttgtttataaattacccagtctgtggtattctgtcagaacagcacaaaatgaactaagacaatgtgtttgtgtgtgtttatgtgtgtgcatgcacatgtatgagcgtgtgcatgtgtgtgagtgtgtgtgtgtatctcctatttgttctctctggataaccatgactgaaacagatatcatgaagatagcaatgcggctttgagcagagacagttgcaggattatggagagccttgagtgagctgtcattatgagttcttttaccccaatagtcataaaatattgagtaatatttgagtaataataattaattattactatgtctactaagtgagcatatattgtgccatagaggttggttggcatgatttctattgactcagatttctgagatgctaatccagagcctgagtggaagtctctcatcttcctgtcagagaagctttactctcctgaagagagcaccaaaagctgggtatcctccatcagggaatggggatcagactagaaaaggcctccagctctgtcaggttaatactgggatcaagaaggactttttatattaatggagtcaatgccattgaaagttagcattcatttagtccacttcttcattgtatacatagggagagtgaacctgagagaagagaagccacctttataggccacacagcaagttggtggcacagccaggcctcacactcacatctcctgacaataagtaaggtagagaagaaaggagaaggaaagagataaaggttgtttgctagaagagaagtctggattccggttgtgctttttctatgagccatttggtgagtaattgtcccaaagtttggaagtgtcccagttttcacaactggatagaatggagggaaaatagaaaagtttgaaaagtaaagtgaaataacatagacaacatatttataagggcccctaactgctaaattacaaaattgaaaatgatctatatagttttcattgatgagtaaatctgctttctggtggacttctctagtggcaacaaggctactgcactcagtctcaccaccttgaccaaaggccaagtttgcccttgttaaaataaaggtacactgtgcttgctgtggggccaggcttccttatttctctcctatatttgttcaggaatttggttctgtcccatgaggatactaaattgcattgatcaatgaaaatggcatctgtgcttgtttgttttaacttgactttgatagcttcatccattaaactttcaatgaagttgtaatttctttaaaaaaaaaaaccctaaatttaaaaacatgctggcagttcataattaccttggtatatatcaagatgaatcagtgaaggtgactctctttcctttgcatttagtattgttgctttgtgcctgtattttctatttaggatttattagtgtaaatcccccttatacatcattgaaagcattaggatttatgtagtgttaaatccatatcaggatttatatggaattaaatccaatctaagagacaggtggataacctagtggggttttgtacccataatttctaccgctctttgtggaaaagcatttcattacaaactttcagatttgggaaggcagtgttctgcaaatggcacctattagtaccaatgtggagcgttttactgcactttccatgtagtccctgggctcctcactgagaagcatcctcatggcaaagcatctttcatggccacgaggaggacattaacctcttctctgctccttccctgtttggagcacagcacagctttgattaactctttaaagagccttctgtttacaccctctcacagatctgcagacagtatttgcaaagcacattgcaatttttgacagcaggcaccactggggtggggaagatacttgtcagctttttcctttggtgactttccttccatttttttttatcttttgagggaatgaaaactgctccaagttggtgcttgctattctccttttttatttcttttctcttctttgtatatgcttttccccatcccatataccaactgatggggtgattgagtgactttcatccattcagtcaagtatttactgagtcctacttcatgcaaagtactgtacaatgtactgagtttttagagttatttctttctggggttgttgtccctttttaaattataaaaataatacatacttatggtaaaaatgcacagtacaaaagcatataaaatgaaaagaagatcctcttccacatcaagctcctagtttcactcctttgtataacatcaataacaatttcttacatatccctataaaaattttctatatgtatataagtgtgtatgtaatgtatacattcatacatatatgtacatataggtaacatacacacatttacttatatatgctttcttagaaaactcagactggagcatggtaaacacaagttttgtacatccacttccatgttgtatcaggccatttgctttgctataaagaaatacctgaggctgggtaatttacaaagaaaagaggtttaattggctcatggctctacaggttgtacaggaagtttgctgctggcatctgcttctggtgaagccctcagaaagcttacaatcatgtggaaaacgaaggtggagcaggcacatcatatggtgagagagagaacaagagagagacggagaaggtcccagtctcttaaaaaaacagatctcatgtgcactcaaagtgacaactcacttatcaccaaggtgatgatgctaagcagctaaaggggctgaccagtcacctctcaccaggtcccacctccaacattaggaatcacatttcaacatgagatttggagaggacacacattgaaaccatgtcacatgtgtatctttccatgctttccatgtcagcacatgcagtcttgctgactcccttaaaggctacatggttgaaatgtaactttaggaaaaccctgaggttttgataagttttgtatatagggcactgaatttgattttgaatgtgtaaattcagtgttcatttgctgtcttcaggtttcttttactttttctctatattgagggcactacccagttatgcattctgacacttgaagacttctggtggcttgcaaatgctccatggagatgaaaattaacttgattggttttccttcctgagcaccatgtgtccactctggccttgggcgactctcaaagtgggtttcaaaccaggcttcagagtttgtcccaatactttctaatagtttattttatccttttcataagttttctcctaccgcttcagtccatattttctggtctggccttatcaactataaagttcttgtttatttggaacttgaggtcagtgacttctgacctcactagctttcattctagctcactcttatttaggcatttactatatgcataatttcctttaatcctcatgacaaacccatgagggaggtgcagtaattatctccaaagtgacagatgaggcacaggaaggctaaggacattgtctacggtcacacagctggtagatggaagaactagaatttgaacccaggtttatctgaccctaaaaaatatgcttttaatcaatatatatactgcctcccttaaatcagtatttctagcttttctatgagcctgcgattctctagtggcaagccacaataatagccacactgtgaacataacactgcatgccagactccataccagagggtggagctgagttttctcatgctggaacagcattttcttacaagctaaaccatgggagggatcttgggtgggaagaagcacttcctgcttataatacaagccaaaaagagattcccacagtatgaagcccacagtttttcctgtgtaatgacattatgaagacctcaggcagaatctccagctattgtgcatttttgtttaatacatttatactgtaaattagttagagctatggacttgcaactcctactttgacccaaaacaccaagacacaagagggaatggtcttttattttattttcctgatcagaactctctagtttccttatcagtgttgctcaccctgggtgttgcctctgaattcagatttgtgtgaatggggttttctaagagaaaccttggtaaccaagagacagtttctgtctctgccttcttctggtggactccaatcctggctctccagctgccttgccttcacgttttagggattcagaatcaggatgcgatcatggcccaatcacagaattgaacatttctaagttcctcagtatccaaaaggaaaggcatttcagatgttaggtaactgtcctttattcactgtctgatagaaatttaatggttacaaaggggtttgtttttaggtttttagttttattatttttagtttatttccagcactggaaaattagcctgaaaatctggaaagggaaaggccaaaccgatcacagttggccctggaatcgtgggggcattcccaataataaatgtctagatggtgtgtttattccagttccaatccaatccaattcaatgaatatttgttgaatgcctgctgtgaagaagataaagaatgaataagacatggctctcactctccaggagttcacactgtaatgagaaattgacatgtgcactgttaattctcatacaaagaaggcaataataaaggtctatacagaagtttaaacaaggtgttaaggggatattggaggagtaaaaaattatgtcgaattagagtatctggaaggaatgctgtttgaaagaaggtggttttgagctttgtcttaaaggggtgatgagattattataggaagacattgaggtgaaaggtagtttagtttgaagaaccacacactctgcaggtgtgcagtcccagggaacgcatggcaattagtctggtaaggtggagagcagcatggcatacagctggagcggtaagtccgacccagtttatgaagagccttgaatactagactaagagtttggacttgctctgtaggttaaggggactcttgaatacctacccctcaaaatcacaaaggagtctgtttcctgtcatcatagcacttggttcttctcggtagccccttttacagacaaattccttctagttacatttgtactcatttggtgaagattctctatgggaaatacttgactttaaaaaacttgacacatagtttgatgtaaacgactctgatatatcaataatgtattttattcatttatctcccaattgtgtatgtaactacatatactttgtataatcattgactatgattacagtctgtgttgatataacctaagagtggttatgcatgatctgggtggtattgcatctggaatttatcctactctgtaacatgttccattgagcttacaccaaaccagtctagctatgccatcagatttctctttaccagctctatttatggtctttctctgacattactataagaatgtcaggttaaattatatcagatgcttctctctccaagatatgttaactttgctccatcctctttcaccattcagcttgtcattctatcatgaacaggaattagcttcgtttggcatgatttgtatttgaagaatctgtattgactactgtttatcacttgggtttcccctagatactcataaatgactgccttaataattgtcctcacagcttaccagatattgaaattaaatttatgagtttaattccctgagttccctggggactttttttttttttaaagaaaaatggaacacagcagtttcatgactcacaacaactcttccataataaccaatgtgataaaaacattttttcagggaaacaaatttcagttttagccttccaaatgactattacgaaaattaacaactaataaaaaattgaaatactaaaagacatcatgtatcctctcaaactatttatttattgtactcatacatattcttaagtgcaataaaatctgcctagaaatcattaatccactagtatatagtccttacttggtgctggcaactgaaaatttggtctttttatatacaaattgttacacgcatgaaaagtagtccaataatggcactttttataggttatttcataagtactcttggttggacatatgctaaagtattgttacaggttgctgaggcaacccgcctgctacagttgtggttaactctaaaatttactgataatgctgacctgagacttgagtcttatcttcactgaatgcagtacaggtgtattgtaggtaggctgtaggaggaccatagctacctctaaatctttacagaagattttgaatgtggcttttgttgcatagaaaataaataaaataaaataaatctctacagaagactggcaagagattggtgcatatttaatagcaaacagtgggatgctttgaaagggatggataacatagaacattgaacagcaagagctttagtggggtttaggttttagtagttgtccagccaagactctgcctgttactgaagctagggatatgtggagtgaccaatttacatcagtcatagtagagaagtaattgcttttatctgacaaaagcagtctggacccagtcaacaacatgctgatgctacagtccctattcttgatgttttattggaaagtggtaagacttctttttctctctgagctggtaccaccaatttgcagtggtatgttctagaagcaaatcatatttcagagctctttggttgtgtaatttttttcaataggcatgatgagtattctggaagctgtatcatggtgccttttgcttggctgtgtgtcattactataatgcataggttttttacttgtttgtgtgattgtttttattccaaagactgccatccagggccatgcagcaaacaagcaacagggaaatatcccactatgcaatcctattttgagatgatatttaggatgagagaacatgcattagttacctaccagcttgacaggaatggatttccaaatctgacacaccatagcctgaattctcaccagtttgctcctggaaaggcccgctcatggtaagctccttagagtttgttagtagtggggaagccttgagtttcaggagaacgtgtttggatggcattttaagaagccattccatttttggtagagtagaaaaagtctgcatctgagtctgtagtacagtctgttctctggatgaacacaatgtctctctcacatttttctgatatttattctgcaaatcagcagcatgagcccctgccactcttctaaataagcttccaggcattacctgcatgctgtgttcctgtggtgggatggcagtaatctctgctaagataaacgggagcttctgtggataaagcataaacgcagtgaagtgtgtgtggctggaagatttaatgcctctacaggtaatttttttagagggggatctggcatttgatcaaatccagagtcattatgtaaatttaatcaccttgcaacacactagtaattttattatctccttttcatttgacagtgcttagatacaagttgagcttggaattccagaggtagagcactgctgattggagacatattaagtaaaatgtactgtggaaatgagataaaacctttattcttgctaatgattgtcattgtatgtattcaggtgtccaacaaaggattttagaataaagtgtgcctttaaagtttcccaccttcttaaagctcccaatgaattgcaaagggcctgtttggaatggactgtattaaatctacttcaaatgaaaacctttacactgagtgaaatatggttcaacaattcttaacacaaggcctttacacttgtgtagcccattttggtttggcctatcttgtcactagaatgctgtctgagcttggattatttatgccctaagatttacttaaaattgaagggagtatttccattcatcaacactagttttgatagatgcttaaaaggtgcagtgaggttgatgatcctgaatacacaaattattgatcaccacatcaagttggatttccctaaagatgtatggctttctgaccttgtgatttacactaatgattatgtcttaataaaagtaataaagctaaatactttatacgtgatctaaggagtgagattagaaaggaagcaagaggagagacatactgtgttgaactgaccttgctaaggcagaagaaatggcattttatggtgtttttttctttccttcacttctctgttttacttcttccgctttttatctcttaatttgaaagaaactcttgggaatatctcttctcctgcagacaaagacatcatgagctcccccatccataccctagaacatgtaggcccttggtcaaccatagagtctttcctttaatcaggtgatatctctccttttgtaccttgcaggcacggaagccaatgacttgggcaaatgcccctaattcaggatcaactcagatgaccaggtttcccctacctagagtgctacttattgcagtgaaaacttttcttctttccaaaaacctttaattaaacgtttaataactccctgactcataatatggcttcataatgggacatcaaaatggtataatctaggattaagatttaagtgccttactatctagtttcccgttgagctgagtatctgttctctgtttaccactcatgcctcaattttcttattctaaaatggaagtaatgatcactacctacctccaagggttgatacaggattcagtgaggcatttgatgtgaaagtatccaacactcagtttggcatagaatatatgttcagtgaaggcaagtggaatttgagtgatcttgtgagtgctaagaggttataatccagggttagtatgcaaccctaatagtggggctaccatgcacagtcacagtgagggtctgagtcaaatgaggataactgggctctggctttggtgtctccttttgtgggttgcagctggtaaaataagtcctcttttgtcacaacatcatacaaaagtaggttcacacatgtacactcacacacacgtggtttgggtgagagagtatatcaaataatcccacagtagagagatgatgagattgctcttaagggatgtcctaatttggataaaacttgtgtgactttaggaaatggacttaccctctctctctcagtttctttctgtctctctctctctcgtctatccattcatccaaccatctgtccattcatccaataagcacttatgaagtatacccatcactatatttctatcaccattactgagtagcgatgatagaaagactgatacttttcctttccttaaagagcttatactcttgttggagagagggacaagcaaacagttataaaacactcttaatccatttgggctgctataacaacataccttagactggaaaattttataaatatcataaatttatcaccaacagttcttgaggcttgaaagtccaaaaattgaggtgccagcaggtttagttgtctagtgaaggctctctcctttatagatggtcccttcttgctgcatattcacacggtgaaaagggcaagaggctaataaactctctgagcactctttataagagcactaatcccattcatgaggatccaccctcatgacctaatcacctcctaaaagtcccatctcttaatattattactttggggattaggtatcaacatgaatttgggagtgacacaaacattcagaccatagcaaatactatttcaaagtgacaaaagcatgcagagggtatcatgggaataaagagaaggttcctttcccagcctggagtggaaatgaatggtcagagaagacttcaggaagaggtgatgcttgggctaagtcctaaagggtaaagaggtgtttacatagtaaaaagtggcgggggcgggtggaagtgtgtgtttaagctgagggcaaaccctcaggaattgctctgcagttcctatactgtccagtactggtaagagttctgatcagatttgatagccatacatgaaatgtggactcagtgtttgtttgtagcccaccagatgtgttgagaacactgtggataagtgcatattttagtgcttctgtaaagccctagaaagtaaatattttaggctttgaaggccatgaggtctcttttgcaactatgcaactatgcagtgctatctcatcacagatttaatttgcatttttctaatagttaacaatgttgaaagtatcatgtgcttatttgctatctacacatctatgttgaaatgtaatgttgaaatgtttgatgtattttccccattttctaagtggacttttttcttactactgagttttgagagttctttattatattctagataaaaggcctttgtaagatatgtgatttgaaaatattttcttctagtctgtagctagtcttttcattctcttaacagtgtatttcactgaacaaaactttttaattttgataaaatccaatttatcaacttctgtttttatggatcatgcttttgatgtcatatccaagtactcttcaagtaactcaaggtcaggaaaattttctcctatttttttctaagcattttattgttttatgttatatgtttagatctataatccaccttgagtaaatttttgtttaaggtgtaaggttaggttaatgttattttttttcatactgttatacaatgatttcagcaccatttgttgaaaaaacatatcatttctccattgaaatgcttttgcatttttgtcaacaatgagttggctatgtttatgtgagccaatttttagactctgttttctgttttattgatctgtgtgtccttccctttgacaataccacaccgtcttgattactgtgtatatacagtaggtcttaaaatcagttaatgttatttctacagttttattctttttctttaaaattgttttagctcttttagttcctttgctttttatataaattctacattccacttatctgtaaatacaaaaagttctatgggatattgattagaattgcattaaattatgctgtttctttcagtccataagcatggtataactctatttaaatcttctttgatttctttcatcagggttttatggttctcaggatgcagagtctgtacatattttgttacacttatacctaagtatttaaatttgttttgagctattataaattttaaatgtatacatatatttaaattttggttttcagtggtgcattgctggtatatagaaatatgcttgatttttgtgtgttgacttgtattccatcacctttatagtactcacttatttttaggagtttttatgtagacttcttgagattttctgtgtagatagtcatgctgtttacaaacagagttttctttctttttttctgatatctgtgccttttattgattgatttttgccttattgcattggctaagacttccataatgatgtggaataggtggtaagagtggatgtcttacattgctaccagtcttcaggagaaaacatttagattttcaccattaagtatgatgttatctgtaggttttttggagatgttcaagttgagaaaagtttacttctatttctagtttgctgagatttatttttaataattaatggatgttggcttttgtcaagtgctttttctatatcaattggtacaattatgtggcctttttagacttagtatgatcagttatatcaattgaattattctattattgaagcaaccttacaatcttgtgataaactccacttgattgtggtgtcagaaagggcctctgataaatctccagatatgtactcagtttatttctctttgccctgtaatgtaaatgcagttatactggtatcataagggtacatttcggtactagggaaaggtcagagagagaatgctgagaggtggaaggcattctgcttgaatgaggagccaaggaaggcaatggaagctaggggagagaatgtaagaactgatccgtgagcaagccaaaagtgagccaatccatcaggctacaaccattgagtgagtgcctgctatgtgccgagcagttgacacaggctaaaaggttctaaaaagagtcaagattggataacaaagaaagaaggcccttgaggaacttgatcatgctgggggctagaagtgagagggtttgtatattctagttctggaatttggctgatgagcactggacccaggacccaggtggctgcctggagcagcctgaggtcctttcttggcctgctggtaggtaaaataaatgagaggagaagagtctgggaaaggtggcctctgtggcttatctggcacctgcaatttgattagatgtatataacctgtgtcttaaaatccctcgcattgggcatggcaggccaacatgcaaccagcaggtactgagataggaccatgggctctgagagggagagataattagagattttcttcaaaactgaggacttgaccttcctgcttacttactgtgatcactataatgccactgccttaggcaatgatacccagtttgatctcctctcagatactgttaggtcagtgtctccatccattattttctgtggaagctctggcagcctgagagtttgagcaaaaccaacctgaccaccgattttttagtatatagcttggtattgtcaaccatgattgcacattaggattgccagagacagaaccagcttaatagacatgtgaccagtgcatttacacaggaccccatgctcagaagggagggccatgctgggagattaatgttctattattattattattattattattattattatactttaagttttagggtacatgtgcccattgtgcaggttagttacatatgtatacatgtgccaagctggtgcgctgcacccactaactcgtcatctagcattaggtatatctcccaatgctatccctcccccctccccccaccccacaacaaccacaatgagataccatctcacaccggttagaatggcaatcattaaaaagtcaggaaacaacaggtgctggagaggatgtggagaaataggaacacttttacactgttgctgggactgtaaactagttcaaccattgtggaagtcagtgtggcgattcctcagggatctagaactagaaataccatttgacccagccatcccattgctgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgagattaatgttctgtggtttccatttgaaacttaatgatttttatcttttttatcttcaaacctgtgttttgtaagtgaagtgtaatgagacaatgaagcatgtactgggggcttgaaatcttgattcacatatggatctacctcctacaaactccccacatctccaggatgggtttttggccaccactcccttgatttctggtgcccgtggccttacctgggcccccctttctcatccttgttcatccatccccagcaggagcctggatgttgggagagtcaggatcagatgcatgcaccttgcagcccctctagggagggcatgacatcgatcatctctgctccagtttcacagcaccaggcacattcagtgggaaacacagtggcagcaagcctcttgtctatccctgatttaggtacctaagtgtaccctggtaaagaggttgtaatatccttgggggatgtctgtcttctgtgggaggggatggtgggcccatgggaagagagatgctaaacctcaatttccttaccttctgataaggcacagcatgtcagtctgatggctggtgaaagggacccagtagttgtcaggcccaatcacacacccaagacacaagtcattgggtggagctcctgggtgcctgcaagggtctaccctcagcccatgaatatccccatgcccaagagagtatcgtttgggcctgcttcatgtctggagagaccctctctttctcctttcaaccttcctgaatctgacttgcattagtctcttctagccagctcaaggcaccttccagagatgaagtatgaaatacaaattgtacaatgttggtgattctgcataggagttaaatgctctgatattttaatttaagatatcattgtgtcgtacaatataaagatgaacactaaaatgtctattaatgatttaaaattttactttttctttacttagagtgacactgaatagcaaagaggaaacaccatgacaggttgaatgagaaaccacagaagaaaggaaaacatctgtatattttagtacctttaaagacactttttctctgttttttgaataaggcacaccacgttttcattttgcactgggccccaaaaatcatgtatccagtcttgtctgggggtatatttaaaatatatggatatatccaaattaattggcattggatagggctctaggcatatgcatttttaaaggcattccagagaatctgttgtagaaagaaagtagaaataagcaaagagcgaaagctagaataaaccctgtgatactagattagcgtcagagagatcaatatgaaaaatcagtaaatatgtctgtctatctgtctatctgtaaagataagtagatacagaaatgaatgttgatatggtgttgtcatagtctgttcaggctactataacagagtgccttagactgggtaatttataaacaatagaaatatattgctcacagttctagagtctgggaagtccatgatcaaagagccagcagattctgtatctggtgagggttctttgcttcatagatggtggaaggggtaaggagctaagatgctcctttagacctcttttataaggccactaatcccattctttaggtttctgcccttatcacttaatcacttcccaaaatgacccacctctttataccaacacattaggaataagatttcaacatataaattttggagggacacaaatattcagaccatagcaggtgtattcatggatatgtatctatgtgtatatgtatatgtatatagttgtccctccatatccataggttctacattcgtgggttcaagcaactgtggattaaagtatttgggaaaaaaaacaataaaaaataacaatataacaataaaaaacatacaaaggaaaaacaatatggtctaacaactattgacatagcatttacattatattagctattgtaagtagagaggatttaaagtatacaaggggatgtgtgtaatttatatgcaaatactacaccatttaatataaggaacttgagcattcatggtatccaacatggattttggtatccacagggagttctggaagcaatcgtctgtggatactgaaggttgactgtatttcttttcttttttttattttattttatttttatttttttattattattatactttaagttttagggtacatgtgcacaatgtgcaggttagttacatatgtatacatgtgccatgctggtgtgctgcacccattaactcgtcatttagcattagttatatctcctaatgctatccctcccccctccccccaccccacaacaatccccagagtgtgatgttccccttcctgtgtccatgtgttctcattgttcaattcccacctatgagtgagaacacgcggtgtttggttttttgtccttgtgatagtttgctgagaatgatgatttccaatttcatccacgtccctacaaaggacatgaactcatcttttttatggctgcatagtattccatggtgtatacgtgccacattttcttaatccagtctatcattgttggacatctgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttggactagtttacagtcccagcaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatggtcttttggctgcataaatgtcttcttttgagaagtgtctgttcatgtcctttgcccactttttgatggggttgtttgtttttttcttgcaaatttgtttgagttcattgtagattctggatattagccctttgtcagatgagtaggttgcgaaaattttctcccattttgtgggttgcctgttcactctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagttttagctttctacatatggctaaccagttttcccagcaccatttattaaatagggaatcctttccccattgcttgtttttctcaggtttgggttgactgtatttcatagctctgtccactgagagggcctagaagcagcaacactgaagtagaattaagcttacctagaactacatcttgtttcctaaataccattctcaattaaaaagaattagacctccttagagaaatagctaatgagagagagaatacaccacagtagtaatctcagaggacaagatatttacatagctacaaactattagctcccaaatttgtattaattactatggtggttttaatatgtgttcacaaattatttgatactcctccctacaggtggtagagattaattccccttcattgagtgtgagctggactttctgtctcagttctaataaagtatgaaacggaaatttagtagttttaccatttactatttatattttctatttgatatataagtaggttgaaagtaaaaagatatatcacacaaatattcagaggaaagtgggaatggctgtattaacattaggtaaatagacgcaagaacaaagaaaattactaaggtagaaggggtcattaaatgatgattaaattgtcagtaaccaagaagacagcaatcctaaatgggtatgtgccaaacaacagagctgcaaaatatgtgaagcaaaattcaatagaattgaaaacagacaaattcacaattatagttggagtcttcaaactcctctctcaacaacttatagaacaattagaaagtcagcaaagatataaaagaacacaacaactctatcaaccaacagaatctagtgtttataaaaacctccacctcacaacagcagaatatacatttttttcaagcatccatggaacatataccaagataaactatatactagactgtagagcaacttcaagaagtttagaagaattgaaatcaacagaaagataccaggaaaatatccaaatacttggaaacaaagcagcacacttctcaataatccatggagcaaaaaataaattaatcagagtgaaaataaaaatacaacatatcaaaatttgtgggacacagctaaaggagtattgagagggaaacaaatagcagtaaatgcttatatcagaaaaagggaaagatacactaagatcagaaacaaggcaaggatagctgctctcatcactcttattcaatgtagtatagtactagaaattctagccagtataataaagcaagaaaaagaaataataagcacttgaattggaaaagacaaaataaagccctcccaatttgcaggtggcatgattgtctatgtagaaaatcccaaagaatctacaataaaacttctagagttaataattgagtttagtaaggttgcaagacacaatgtcaacccacaaaaatcaactacattttcaaatactgtgaacacatcaaaaccaaaattcaaaacacaataccatttacaattgctacaaaaaaaatgaaatacttgggtataaacttaacaaaatgtaacaaaacatgtagaggatatgtatgccaaaaattacaaaatgctgatgaaggaaatcaagaagacttaacattaatggagagaaatactgtgtttgtggattggaagtctcaacccagtaaagttgtcaaatctgccccaaattgatctacaggtttaatgcaattttaatcaaaatttcaataaagtttgtttgtaggtaaacttattctaaaatttgtatgatgcccctctttattcctgataatcttccttgttctgaattctgctttgtctgaaattaatatagatactccagttttcttttatgttagactggtatatctttctccatctctgtacttttatataagtctttatattgaaagtagatttcttggagaaaagatataggtgtgtcttgtttgatttttttatcccctctgttttaattgatgcctttaggtcactcaaatttaaagttattattgatatattaatatggattacatttgtaactattttctattgtgttttcattttcatatcccaactcttttgtctgccttctttgtttttaattgatattttatataattatattttatctcttttcttacaatatcaattatacttcttttaaattttttaatggttgccctacagtttaaaatatacattgctaactatgagtctaccttcaaataacactgtaacactttactcatagtgcaggtgccccataacagagttatcaaatcttccctccaatcctctgtgacgttgatatttatttcacttatccatatgctataatcaaccaatacattgttgctattgttactttaaacagttatctttgggctgggcatggtggctcatgcctgtaatcccagcactttgggatgccgaggcgggcggaccatctgaggtcaggagtttgagaccagcctgaccaacatggagaaaccccgtctctactaaaaatacaaaattagctgggcgtggtggtggcaacctgtaatctcagctatttgggaggctgaggcaggagaattgcttgaacctggtagatggaagttgcagtgagcagatattgtgctatcgcattccaggctgggcaacaagagcaaaactctgtctcaaaaaaaaaaaaaaaaaaaaaaaggtgttcttttagatcagctaagaattagaaaaataaataaaagattttattttaccttcatatattccttctccaacagtctacactcatcctttctttctgtagaactgagtttctgatcactataaccttttccccctaaagaactccttttaacatttcttgcagggccagttggttttcatttctgtcagtttttgttttgtttttctgagaaaactgtttcattttcacttctgaaggatactttcactggatatagaattgcggtttgctggtttttttttctttcaagactaaatatttcactgtactctcttcttttttgcatgtttccttgagaagcctgatgtaattcttatccttattcctttataagttgttttctctccctctcttgtctttcaaggtttttttcctttggttttctgcagttttgctagaggggactggagtaggtaggagcaatgcccttccccagctcagataaggccctagaaaaatcttttcccctgtaaagttgtcctatgttaaggggaaggcatatatcacaatgattattttttactctcgccgacagacccacaagataattttactcagatctttactgtaagaacttgttggatttttttgaaggtaaagacaacaaaatgttggggttttccctatgcctgcagtcctcaatttgtcattctcatagtagtctacactcagcctgcagcaatttgttaaaattaccagttttggtattcctagtttgtgactccagtgactctggtccaagcaagcaaattgcagctatgtctctctggatgttcctgactctctagatttcagggtggtggtttgccctacaacctcatttgtctgaaggattcatgaaaagtcattgattttaagtttgtccagcttcttcttgtaaggatgggagtgatgatttccacgatcttgtcagaacttaaatcagagtaatattccaaaatttatatgaaaagacacaggtcctagaataactagaacaattttgaaaaagagtaataaagttggaggaatcggtctacctaacattaaggctaactacatagctgtggtaaccaagaccatgcagtattgccagatgagttagatatataggtcaatggaacagaatagagaacccagaaatagacccacataaatattcccaactgaattttaacaaagatgcaaaggtgattcaatgaaggaaggatagacttttcaacaaatggtgctgtgttggaacaactggatattcataggcaacacaaacaaagttcaacttaagccttacaccttatgtagacatttactcaaaatggatcatgtaagtttttaaaacataaaactaaacatattttagaaaactggaaaaaatcttccagctctaaggctaggcaacagattcttagacttgacaccaaaagcatgatccataaaaggaaaaagtaattggtaaattggaactcatcaaagttaaaaactttctgtggaagtttttatgaaacatccttttaaatatgaaaatacaagctataaactggaagaaagtatttgtaaatcatatccaacaaagaatatataaataactctcaaaactcaatagagtaaaaaaaatcctattagaaaataagcaacaaacagcaacagacatttcactgaagaagatatacagatgacaaataggcacatgaaaagttgttcaatcaacatcaccattaaagaaatataagttaataccataatgtgatattactatacctccatgcatggatctttccacattgcttatgggtaatagtatgaccactctggaaaatggtttagtggtttcttacaaaactaataatacacctactatactattcagcaatcatattactgggtgtgtatctcagagaaatgaaaacatacatccatacaaaaacctgtacatgaaattcgttcatagcagagctgttttcaatgatcaaaaaacagaaacaacccaggtgtttggttaataggtgaatggttaaaaaaattatggtacatccataccatggaatactactcagtgattaaaaaaaaagaatgaactactgatatatacaacttggatggatctcattggcattatgctgaatgaaaaaaggcaatctcaaaaggtcactgttaggttccaggtaggtgggacatggctttattcagcagtttcttcacactgtcggtgctgcatttatgcacctcacagaccataatggctcagaggcaggtgatgagccctcccacgttatggctacatagctgtgattatgtaatgcatgggattgtgcgcctgtgctccaatcccactgtgtcatactgtgcaggatgtgtacctcagcctatacttgactgcagcacagccattgtccttacaatcacatactgtaaggacagtatgtgattccatttatataatagtctcaaaaatgataaaaagatggagaactgattggtgctgtacaaaggttagcagtgttggtgaggggagttgtgactataaagaggtagcataaggaagatatttgtggtgatggaatagttccatttctggattgcagtggtggttacaagaatacagacgtgattaaatggcatagaattacacatatgctttgcaccaatgccaatttcctgatgttggtatagtactatagttacataagatgtatccattagaaaaaattgagtgagagtttcacaggacctctctgtatttacaacttcatctgattctacaattatatcgataaaatacttcttaaagtagcttacagtggagaaacctggcagaaatctccttaaccaaggaatcaagactaacatcactggtaagtttatgttcatatcttgaaccccttatactgtgtcataagaaacgcacttcacctctgtgctatccttccccaaaatatataatcccagtctaattatgagaaaacattacacaaacccaaattggggggtattctacaaagtacttgaccatttatctttaaaattattgagatcatgaaaaacaaggaaacattaataaatttccatagattggaagcaaataagatatgatgactaaatgtgacataatattctggattgcatcctggaacatgaaaaggacattaatgggaaaactggtgagctacattatacaaaataactgatcagtgctcttcaaggtgtcaagattatcaaagacataaaagaatggatgaactgccatagattggaggagacaatgcaatgtgaaatcctgaatttgaccctgaacagaaaatgcaatgtagtggagaaactggtaaaatgcagataaaatctagtttagttaatcatattgtaccaaagttcatttcttagttttgataactctgatggttataaaagatgttgacatgaagaatgctggatgaagtgtgtgcagcaactgtttgctgtttttgcaacttttctgtaattttaaaattatttcaaaataaacttttaaagaaagcctcctgggagattctaatgtgtagccagagctgagaaccactgctacctcattcatttggtcctgcctcatgggtttccactatactctcctactccctagtctgcccttcctccatcaaaattgctgtgctctgaagggatgttttcaactggctgctggcctaaataggatgagacaaaaattaaaacgtttctaccactatcccagtgggaaactaattccaaagctaatagcatatgggcactatcctatctactctagccaggtgtcattgtacagtaagaatttccacctcagagattgattccttttcataaagcatcattacatcatcatttttcaagcagcacttctggatgtcagcagatgaattcagtaagaattatgggtcatgcgaactggtgtatcagggctttttctgtaacaccacaaaacactgggcttctgtggaggagagagctaaatttgtctagcgtctcctacaatccattttaactctctagacaggaaaggaaagcccttgctttgaggcaggaggctggttttgcaggtagttagagccaggtacttaaagacagcgagaagaaaggatggccttagagagtgatgtcctggtcgtagagaactgccttaagtagagatagtccacatcttgaatagcaaactcctgttgctatgacagcttccaagagcatacttgtctcatcagagcctggggcttattcaattggctccaccctcttcctggagtgcactgtttattaaaagggccctgccctttattctactaggattagtcattatgtgttagtgaactgccctttttctccctccacttcagcttttcatctgcatcctagaagcaagggccgtgtctttgggcctgctgagagtccttcaagagagaaaattaagaacagctaggggtaggcacaatgccttcatatgcctccagcaaaaagggcagctcagatactccaagaaggagagaaaaataatgagagttggagaaacgggctgagacatgggaactgtgcaaaggctgattactggataagattaggctcagggcaaaagtgcttactgagatattggaactcttaggacttattaatctagtgtttagcacttggagtctatagattaacaggtaaaactaaactgggacagactggcgaaagctgtgaaaatgccctgaggcagcttatagttaagaataagattaacaagaaaatgattaaagactgagctttactgcacagtaagttacaaattggaccctttgcatacagactttcatcttttccctgttgttctgtgtgggattgcatggtttacatgtaaaagtaaatttatttatttcttggtttgtttattctaaagaaatagatttctatacataaaatattgatgtttatttggagtagtatatccttatgaaactaaatgataaacttatagagtgtgaagggatgttagagttgacatactttgacactaaacattgtatttttaagtttaaatagcaatatctcacaatatttagtgctgttgtctaattcaagaaactacacacagaactgatacttcaagctatgcaaccacagcagtaacaaccacagtgatgccttatcttatttgcaagattgtctctttaatgggtgaacgaacctttggaaggatgaatgtatgacctaaacctaatagaatgagagtaggatcactgacatcagtctgagaaatctgttttgaagtgataaccaaagtggtctcctcagtcaaaaaactgcagtaagtattccccttcctgtgtccaagtgttctcattgtttgggggagggatagcgttaggagatacacctaatgtaaatgacgagttaatgggtgcagcacaccaacatggcacatgtatacatatgtaacaaacctgcacattgtgcacatgtaccctagaacttaaagtataattaaaaaaaggaaaacaaacactaacatttcaataaataatgctgctctaaaaaaaactgccgtaagtattaataaataaccttagaagttactgagcatcgggtcttcttaaataacatatcttttcaggagtgcagctaccccaaaagaaagacaacaatcttaatatactagacaaagcagaatgaatgaactaatcaaaacaatgattgaaaacaaactagaatatcattgaaaagttaagagacaatgttggtaacttgaggcaggaataggcagttacaaacaacatcattcagaaatagcagctatgaaaatataagttgaaataacttgatgggggggggtaaaaacaacagatacagatcaagaatgaattaatgacatggaatactagattgaacaactttcccagaagtcatcagaaagggataaatagttgggaaatataggaaaaatactgtagaggaaaaatactttagaaggagaaatgtccaatcagttgaataagagtaccagaaagagagagggagaagagtatgtggaggggatgtaagtatttgaagaaacaaagaccaagaattctccaatcttaggggagtatggatgatctcagtttaaaaagattcagagtttgccaaccaggatttatgagacaaagcgtatatctagacacatagtagtaaaattttaaaaaaagaagccttcccaggaagaaaaagcagataacctacaaaggaacaaaatcatattggcaccttagtactcaaaagcaacccagatagaagaaaacagtggaacgttaattttcagtattgagggaaaaaacttagaatctagaattttatacccagctaagtatcatttaaatgtaagaatgaaatattttaaggcatccaaggcctcaaaaagtttgccacaaagactgtctttgaaataagttcaatgaaagagaatttataataaatatgagtgagttgacttccccagtcccctcttgcaaatgttcctttaatttctcagatctgtcaaccttcctcttactgtggcgacatctccaggatagagttcttttgagggagccattctggagtttttaggctattctgtaacaatctcaagtggctaatttttgcttttattacaatcttatctttcctgctaagcttataaactacctgaggacacaatattattcatttctgtattcccagtagtacctttctcagggttttgcacatgggaggtatttattaaatgtctgtgccagaaaggaagagaggaaaagaggaagggaggaagttataggccagaagatgaagctagggttgcttccattcaagagaatggttgttctctctggtttttgtgcacagaggattaagtgacatcctagtgtgtgtcaatattgtgcacttcagcagatcatctcctgtgttaagtctgactatgagtgacttgaagataattgagcattattcatttcaccatcaaaatattaaaagcagcttagtttgaatccacttgaattaatcatttacttggttctccatgacacttaagctccctctgagtcattcatgatggaaaattatatgctcgcatgctagtaaacattcccaggccaggaaaaagatgggaaagtaatccacaaggggttctaaggttgttttttcggggggaatttttcagtgcatctccacagagttggtgaaaaatctcccttcttccctcttcagtgaggcagtactttttgcttatctgtggttctataacaagtgcccactgaggctgtatgggtgatgcacacctttcagcatccaaactctaagacctgtcttgtattggacccctttgctttccagggaagaggtgggtaggtagttagtgttccacacttactttcccttgacattatttgttgatatttggaggcaggcagaacaagagacatcaaggttgataggtgcatcagagttaggtcttttcccttctgtaaacaaatgccatcttttccattcatctaaaaagcatttgtagatgtttaagatgcttgcctgtgaactattttcaggcttttcctagttatttttttgctagtcccaaagaaaacgggctgggcagagcagaaaatggcagtggcaggtcgccaaaacaaatatatgacacatgcatatcctggaggccaacattatcacatcagcaaatgccagcagagagttcttcctcaccattatctcctccatgttttctcaccaccaattcagtttttggtcatgtgtttttataataacattgagttgagggtgttagcagcaattttgacatatggaattaattgcattatttctcaggtatttggaattcttaaaattccagaaaatcatgtaacatttggacaccacatggatttaattcagtatatagtcatgaagcatctgctcagtgcaaggtcagccctgggcagtgcctaggtacacttatcagtgtgaaggaagtgccaagggaagagtacaaatgaattggaggttcaaagcagggataggatttcctggtgaaacaaaaggaaagacttcttgaaaaggtagccttggggactagacataaacaacagatataatttctacaggcagaggcatgttaggaggcaggaacaacttgagcaaaagtaacaaggtgggagatcataggatccatttagggctagtaatagtcgctatatattgagtcatcactctgtgccatgcatcgtattaagtgttttacatgcattctcttatataactgccacagcagtctcatttgttataggtagcatcattccgaccttacaaattaggagaataaagctcagaacaattatgtaacttggtcacctgctaagagatggcagaacaggaattcaaaccaagtctgtcagactccaaagcctagctttgtagccactaagttttatgactcagaaataaacgtgactgggaagaaagggtaggaccatgctgtgaagagctttaggctttagatgctaagcgaaggatcctgaacttaaaagtgccagattgtgaaataaaagggaaaggagttttcctgtaacaggaaatgaatagtcaataagaggtcaacaggttagagaccaatgaccaggtccaaaacttctctgttttcttcatttgttttgtaccttcctgggaggagaatgggttgagtaggaaagaaacctccctgttcctcttagagcttttgtatggaatttccacttcttgggggtcctttttgttttgttcaattcctcgctattgtgcatggtcttacctctgaggagggaaggtcagaatctgaacttctgtggccaactagaaaattgaattgcttaaatttcagttcctattgcattatattgggtaactaaagcccctgttatctttttcatttttgattagttttggtattttatgtagcttcttctcagacacaaaaagataattcattaattgtccatggatataatcatcctcttcaatcttgtctagaaactggaaggccctgttgccctcacctgtagttagcacctcttttaccaaccttgatgtgggatcctgaaggagcaagttcttggagtcttgccttctgactgaccctggtgcttccccatgtggccctgcatgttgtggcatggtgttccccctccctttgaaattgtcggtaacaaagtatcttttttctctctctctcttttttttttttttttttttgagacagagtctcactcggtctcccaggctgaagtgcaatggagcaatcttggctcactgcaacctccgcctcccgggttcaagtgattctcctgcctcagcctcccgagtagctgggattacaggcatatgccaccacacctggctggttttgtatttttagtagagatggggtttcaccatgttggccaggctggtctcgaactactgacctcaagtgatctgcctgcctcggcctcccaaagtgctgggattacaggcatgagccaccacgcctggccacaaactatcttttcaatgacagatgtctcctgatctttggcctcacaccatctgaataataaacctacattttaaaacagcagtccctaacctttttggcaccagggaccagttttgtggaaaacagtttttccatggaccaaaagtggggactggggaggtagtttcaggatgaaactgttccacctcagatcatcaggcattggattctcataaggagcccgcaacctagatctcttgtatgtgcagttcacagtagggtttgcattcctatgagaatctaatgctgccactgatctgacaggaggcagagctcaggcagtaatgctggcttgcctgctgctcgcctcctgctgtgtggccagttcctaacaggccacggactggtattggtccatggcctgggggttgggaacccctgttttaaaagaccaaaaactctgtcaatacaatcaaccaaatctagagggtggggaattctgcaggaaaaatggcctgattttttactaacttaactgcttaaaatataacttctattgttattgcaaatttgctttctttgattaatagtgagactgaaatgtgtgtatttgtttagcagttatatttcttcgtgtgaggaagtgaattgagtattcctgcccattatccatttactcagaatgtgttttaaagcaaactggatcaaaatgtttcatggacttaaatgtaaaatataaactataaaactttttagaggaaaacataggaaaaaatttcagatctaggatttggtgaagaattcttagacttgatacccaaagcatgatctataaaaggaaatgtttgtaaattagagctcttaaaaaaaagttttacaaaattaaaagttaaaaaattttgctctatgaaagaccctgttaagggaataaatgacaagttacagacagggagaaagtatttgcgaaccacatatccaacaaatgactcatatctgggatatacaaagaatctcacaactcaacaggaaaaaaatccaattaagagatgagcaaaagacatgaagagacatttcaccaaataggattcacagatggcaaataattacatgaaaagatgttcaatatcattaggcatcagagaatgcaaattaccataatgagatgtcactacatgcctattagaatatctaaaatgaaaaatagtgataacaccaaatgctggtgaagatgtggagaaactcaatctctcatatactgtttgtgggaatttaatatggtacaaccactctgaaagaaagtatggaaatttttaaaaaactgagcatgcaattaccataaaacctaggaatttcactcctggacattcattctagataagtgaaaactcatgtgcacataaaaatatgtacacaaatgttcatagcatgttttttgttttgttttgtttttgaggcggagtttcactcttgttgcccaggctggagtgcaatggcatgatcttggctcactgcaacctccacctcccgggttcaagtgattctcctgcctcagcctcccgagtagctgggattacaggcacctgccatcatgcccggctaatattttgtatttttagtatagacagggtttccctatattggccaggctggtctcgaactcctgacctcaggtgagctgcccaccttggcctcccaaagtgctgggattacaggcgtgagccaccatgcccggcccgttcatagcagttttattcataataaccctaaactggaaacaacccaaatgtcctcaaatgggggaatggataaacaaactctagtacatccataccatggactactacttgacaaatcttgcatggatattaaggatttgatgtttagtgaaaaaagccaatttcaaaaggtcaataccatatgattccaattgtataactctcttgaaatgataaaacacagtgatggagaatagttgttgccaggggacaggaacaaggatgaggagtgggtgtgattataaaggagataaagttgtagcatgagggaatgcctttgtggtggtgcaagcagtgttttgattgtgatgtttattgtgtgaatctacacgtgataatattgcacaggactatacctcacacacatgagtgcatttaaatactggtgaaaactgaaaagctctgtaatttagttaattgtattttcctatagtcacctgtgatgcaccattagggaaagccaggggaagcattcggtggattctgtaaactatttttgcaacctcctgtaagtctataattatttcaaaagaaaaagcttcaaaagcaatgctagaattttaattggaatagcattgaattacccattaatttgggggtcactgacaccttcacaatgttaagtcttcccaggttcattctatttgttgcctttaaaaatgtttttcatttatccaaataacactttcatcaaccaagataaggtaaaataatttaatgttaacctatttcaagtttaaagcaaataattatttgaaagcattttactccaaattctttgcatgacataaaagttcttagctttttagatattcattttcacagtggtttttagtgtgtgctctctgaattagtagtatgcatatctctaacttttcagtctaagtaaagaaaataagattttatataaaatgtagaaaacttacaacattagaggtcaatgtaaccactccctatccttttctctatggttgtcaaatgtattccatctacatatgaagcctacaagtaaatgccataatttttggtctaaggaatcctatgtatttgaagaaattaagaggaatgaaatggctttttaaatatttacccagatatttctaatttctgctttattttttaaattaatgtatgcatttccatctggattcatcttccttcagcctggtgaagaacttccttttgtcaagaagtcaagcagtatccaggcagcattggcttagatgaagctaattgcttagtgaagctaataggatcacttgtctagctgctaggtcagcttgtcacattttcatagattcagccagtaaggaaaaacaagcccagatagattcagtttattacttagagagtaacagcaagatcaacatggcattagctgcctgtatccatagtccaacaggattacactgaaccagaggaaccagatgacatgaataacaggttactctgacactgaaaaaccagctctaaactatagccaaacatgtttatacagctgtgtcataagggagtgagacaaggtggaaagttctgtgctcaccgacattagggagacggatgaaaaacagccttgggatggttcctcaccaggctgtttatattcccttgctccaagaggaattgcatggtgttctccaaagacccaggtcagattatggtaaaaccttgcctaagtggcccatatggagactaaaatgatcattggggcaccatgcggtagagctgttctcctacaactttagcatttcttgtggttcaggtttgctggcaaagaattttttctttccttattctttaacaatttcacgattttatgtttttaattttaaatttttgtggttatatagtagttgtatatatttatggggtgcataggccagtttgatacaggcatacaatgcataataaccacaccagggcaaaggaaacagtcaacaaagtgaagagacaacccatacaatgggagaaaatatttgcaaactatccatctgacaagggattaataacaatattttttagaattttgttgtatctcaaagtatctttgttttgccttcattcttaaaaacatatttttgctgagcatagaattctgggttgactttaaaaaatattttaatttttgtaggtacagagtaggtgtatatatttatggggtacataagatgttttgagatgagcatgcaatgtgtaataatcacatcatgtagaatggggtatccatcccctcaagcatttatcatttatgttacaaacaatccagctatactcttcgttatttttaaatgtagagttaatttattattgattatagtcaccctcctgtgctatcaaatactaggtcttactcattctttcaaaccattttcttgttcccactaaccatccccacttcccacccacccttttactacccttcccagcctctgctaaccatcctttttctctttgtctctatgagttccattgttttgatttttagatcacactagtaagtgagaacatgtaatgtttgtctttctgtgcctggcttatttcatttagcataatgatctcaagtttcatccacgttgttgcgaatgacaagatcttgttctttcttatggctgcatagtactccattgtgtgtaagtgccacattttctttatccattcatctgttgatgaacacttaggttgcttccaaattttcgctattgtgaacagtgctacaacaaacatgggagtgccgatctactgattttctttcttttagttatatacccagcagtaggattgctggaaaatatggtagctgtatttttagttttttgaaaacctccaaactgtttgccatagtggttgtgctaatttatattcccatcaacagtgtacgagggttcccttttctctacaccctcaccagtatttgctattgcctgtcttctggatataagccattttaactggggtgaggtgatacctcattgaagtttttatttgcatttctctgctgaccagtggtgttgagcatcttttcatatgcctatttgccatttgtatgtctttatttgaaaaatgcctattcaggtcttttgcccgtttattaatcagtttaatagatattttcctatagagttatttgggcttcttatatattctggttattaatcccttgtcaaacgggtactttgcagatattttctcccattctgggggttgtctcttcactttgttgattgttttctttgctgtgcagaagcttttaaaacttgatgtaatcccatttgtccgtttttgctttggttgcctgtgcttgtggagtattactcaagaaatttttgcccagaccaatgtcctacagagtttcccggatgttttcttatagtattttatagtttgatgtcttagatttaagtctctaatccattttgatttaatttttgtatatcgtgatttgattttgatttgatttttgtaggggtctagtgtcattctcctgtacataaaaccagttttcccagcaccatttattgaaaagactgtgttttcaccaatttatgttcttggcaccttcataaaaaatgagtttactgtagatgtgtggacttgtttctggtttctctattctgttccattggtctatgtgtctgcttttataacagtaccatgctgttttggttactattgctctgtggtataatttgaagtcaggtaatgtaattccttcagttttgttctttttgcttaggatagctttggctattctgggtcttgtgttgttccatataaattttaagatttttttctacttagtgtttttataggaattgcattgaatgcgtaggttgctttgagtagtatagatattttattttattttatttattattttttttagacggggtcttgctctgtagcccaggctggattgcagtggcacgatctcggctcactgcaagctccgcctcctgggttcacgccattctcctgcctcggcctcccgagtagctaggactacagttgcctgccaccatgcccggctaattttttgtatttttagtagagacagggtttcaccgtgttaaccaggatggtctcgatctcctgacctcatgatctgcccacctcagcctcctgaagtgctgggattacaggcgtgagccaccgcacccggccagtatagacattttaacaatattgattctttaaatcaatgaacatgaaatacctttacatttttttggtatcctcaatttctttcatcagtgttttatacttttcattatagagatctttcacttctttggttaagttaatttctaggtatttaattttatttgtggctgttaaaaatgggattactctcttgatttctttttcaaattgttcactgttggcatatagaaatgctattgatttttgtgtgttgcttttgattgtgtcctgcaactttactgaatttgtttaacagttctaatagttttctggtttatctaagctgaatctgctttaaaggggcttagatacagcttagatcacaacacccaagtcctttcaaagtccactatctctgggcccagttcagcactaggattctcccaggagttgctgctgttttggcttagactgcctttcaagtttatttagagacacagagcactttaacctgtggttgcgagactagcaggaactcaagttctgaccactgggactgctgattcccctctggctaggtctggcttaaatgttccctccattcagctgagtttggtctgtttttgttttctgttatagggcagcactgagttcaatgcctaacaattgctgcaatcttgctctccatgacacacaggaatgctctccgaaccacactgccactgctgggagatgagggaggggtggctttggtgattcaagactttttcctacctcttcagtgcctcctttagaaatatgaagttaaaaccaggtgctgtgtgtgctcacctgattttggttcttatgaaggtgcttttttggtgtgtagatagttgttaaattcatgtccttgcagatgaaccatcaggagaggtttatattccaccaccttgttctttcccaagtccaggttggcttctttttcttaccactttgaagatgttggtcttgtctcttttggcctccatcatttctgatgtcagtaattgagtcatttttcctcctctgtgtgtaaaatgttgttattttctggctgtttttttgattttctcattatatttggttttcagcagtttgactatattccaagactttgttttctgtcctcttgggatttgctgagcctctggaatctttaaatttagggaaatttaaaccattacacatgcaatttttttctatcccattctcctcctcctcctctccttctagaactctaacttcatgtacgttacacctttggatattgtcccacacattcctgaggctttgttcattttttttctcgtgtgtttttctctttgttctctgtatatctataggaacgcatgattttgaaagtttcatcttaagtttactgaaacttccctcttttatttccattctgctgttaagcctattcagtgattttttaaagttagatattgtattttccaattgtgtaattttcattttttatggtttatatttctctgctgtgattttctatcttttcatttattgtgaaaatactttcttttactcctttgagcataattctactagttgccttaaatttattgtctgctaattctaacatctgaatcatcttaggttttctctttgttgattgtattatctcttggaatggatcacaatttcctagttcttcatatattgagtaaccttggattgtattctgagtcttctgaatattatattatggagactctgggttctgtgtctgaaaaatactgattttattgttttagcagacagttaacttggttagactgaaactaaattctgtctcttggttggtagctaaaatgtgagttcagtgcttttatctttagctaaagtctgtcccatgtatgtgtggttcaggggccaactgagacttggatagtttgtatatacaggaattagtgctccttctatcttgccctctctctcctttacaggattctccccacaactgtccagtggctcagtttgtcccaagctctgttctttagttcttcatatcagaatgattgtcagtttattcttagtgtgctagccacttggcagctttggcttgccctcagtctaaaagctgtaaaaataggttgctcatgttatgccatacctttattcaaatgtcaactccttttaagaatatgtctgcttctgttcactttccagtctcttcatatcattgtttctttatattttgttcagtgtttaaaattgctgttttcaggaggattgcaatcagtaggagtttattcagtcatatcagaagcagaagcaatgatcctgctcaattttgatttcactcctagcagcttatctttaatgtggtattctgtcctagaaaggaatcttgacaagtcatttttgagagctcatagtggctagattcctacagcctctttagtccttcttgccgtaggccttttatactcacttagtactggagagtggacaacctccaccagtttcagctgctattctcaattgttccactatgcttttcagtgaatattcattagccgtttttccttgtgaactcctgttccactagggttttggctgtcttggattgtaatgtgtaactatggggagccactaaaacttaagccttgcctagtgcgcctcccaacccaataagtttgatggtggggagctatgttgctggggagagagcctctagcataacaaatggtaactcagccttggcattgctttttttcagaagaatcctctgtagttgtagttctctagttttcagggtgtcgagatacaggtagaagtggggaaaaaactcttaaaggctggccaatccacatgcagttgatatctagtacccatcatctcagccagccctgagttcacacctagtgggtactagtctactgtttaaatgtctcccggtggcaaagcagggaaaagaatggtgttctcagggtagtaagtagagaaaatgggcacattaaaaaattgttttcctaccttaactcctgtccattgttcttggccctcttcttttctaggctgccttttccctaatttaccctactcagattcctgacctatccacaggctcttctgtttttccagtggtttcctcatcattttttagctatttggtagaaatatccatctctggattatgtgacatggccagggtttggttctagagagaggactagttgtaattttgcaattttgataagaactggcataactgcttctatctataaaaaaatgaaattacctaaaattctgtaggtatgtatttcaggacatttcaggacattggaacttaaaaaggtgagattcctgaaccctagaagacccttgataatttaaaacaatggtaacaatgaagaataattaattgatcatcagctttggattcttacccagttaatgacatagacatattaccaccaggggtacagatgtaaaatacatctttacagacataagatctaatggcataggagataattttcatttttgtaaaatgtctcatcgataggctgcaaaataatgaacgatttttttctgtggcattactgaccagacattgggccagggttgtaatatttgttatctaataaaactaaaaatatctggttaattattttttcctttgcttatgggctttgcttatagtctgatgaaagtaagttatactttatagtttctaaggagattaggatgatagaaagtttgaatgaaaaaagccatatcaaattactctagttcttaattttgccagagccattaaaacccaattagatacacaccaaattcctgtttattagaagctggcatagttgtgggagcacttttaactacatgcggtcttttgcaaaaaggcattgcgtcattttaataacaagcacgttttccatgaatatactcattcacatcaacaaaacagcttcagccatttacaatccagtgattcgaactgtttaagcaaataagtgtatgagccattagacagcttctttccttcttacatcttctctctcattaatactccatccccacccccatgcctgttgaagcactattcatgtcctccaggagcagctcaaatagtatcaagcccaatcattcctccacaagacaaaattgattgcttcctttcttattcttctccctatctctaatgccaagtgcagaacatggcctgtagtaaatatgttaagtgaatgcagtaagagtaaaaccaactgtgaaatggtaccattttgggagactggccgtgaagatggtgctttcagaaaggcctttctcctctactgccaagacccaagcaagcatgttaagacggactacttacccaagactggctatggctgtttctaatagaagcagagaaaaccaagagatatggcatttacccacaaacactgctattaacttgcttgtgcttgggggagtagggcaaggtactcctgatttgtgtgcttgaccagggcatgccacggacatagagtcaggcctctttcatcaatcatatgcttctgtagccaccattgtgcaatagcataggagtggataatcaccgtgttttgatgatttttcgaaggtggaataaagagtggtattagaatctaaggtgttgattgtcttctataggaaacatcctctcctgttccatcagaaactcttcaaaattcgaaaccttttaaattagaagttattggagatccctttctagttacattgacaaatgagttatttacctctgccctctccttattatgtatttcatttgaggtaaacacaatgcttatttaacttttgcatcctcagattaactgcaagtggaacaacctaatacatttccccaacattggagtttgaattcttttttttttggatatatatgattttatattttctcaacattaaactcaaggaaagtcactgttttatctcttttatcttactcagaccatggtggaaaataaactcattaatttttgttgtaaaggagaggagaagctggtgcatgtcaattaagtgaagtttatttaaaagatcttatacgtataattaatctatcctaaaatatgatctttctctattgcattgtgcctttgtggacgtcagtattatcaaataaaaataagttccaatttagtgtgttaataggtgcactttaaatatattttaaaaatttctttccaaagcaatttaaagtgtatataaggaaaacataaataacatatttcacaacttaaatgcttttttatgcaaattctaatatctgtttcagaaatcatttctataagaaaatgaaatcttaaaagctgtgcaatacaaatgtgcattttatttaaaaaaaaggaaaacagagaaaccaatgaaaagaaagagtgtttaagagctatttcagagtaaaaacttaatatattaattctttgagaagtaatttttgttggaaaggaggagctggtgcatgtcaattaagtggaatttatttaaaagatctcataaatattattaatctatcctaaaacattatctttctgtactgcattgtgcctttgtggagtttgaattctaaggacaacatttttcattctcaaatgaagctgacttcaagaaagaacagcagaccaagcagcaatgctggcctcctctgtcttgcagagcactcttataatgaaagggcttgtggaatttggctccatttcctacagccatgggataagggttgcatgtaaacaataatatcctgtgctgtttgggcctcatttaactgtctttattactttagaaggaactgccaagtggtgctgtttctcatagctcatgctttacataccagcggtattgtagggtctgcttcaaagatggcactccacaccacgaagcttgtggctgttggcacacttggttgtcaccaggcttcatgttgacacattccttcaagtcacaccaaaggtgcactttccatgaagaatgaatctggtacactgaaggtgggcctgttattgcagaaggcctttgcagttaccatttgggtgttttcctagaaagctatagcagctctgcacctagaatgactgtgtttgctgaattacaaacagagaggtgatttttgcaaagtaagctgttacattattgacagagcactaagctggagtcaggagatctatgctgtactccccagctgactagctctttagctctaggggaaacatccttgatttccctggcttgttttctaaccttgaaatgatgagattatgctagataatctctaaattcctctctggcctaaatttgatcaggcaaattaaaacagtaaacaacaaacagtgagtcaagaaacagaagttcccaatccaagctctgctgctcagtaattgtgacttgagacaagtcatttaaccattcagactcaggtctccattgctggggagaccaaagtcttctctacctgccccacctggtggttgtgcctgttgaatagggaaacatctttttcactcaacacatactgaacaattgctctgtggcaccagcttgatagatagcgaagaagcacaggttattagattatctgttactactactaatattaactacagtttagtgatcactttctatttccaggaatgtacatacaatattacatttagtcttcattttatggaggaggaaatttgaggttcagagaggtttaataatttgttcagactcatgtagctctgcagagctggagctgagatttgaaccagcattcttctgttctttattttaatggttacaaaatatctcacctctgacaaggagcttgtgttactatcattatttttctgggccatagtgtctgaatcccaagatctaaaatctgttggggggcaggcagatgaggggactgatctggcttgggctgaaggagagattctctttacagacacaggctgaggcagcacagccagggtagtaaaaatacctgagggacagccctcaggtatttttcaagcctttctctggcttgtagacttattttcaagtctacaagccagaggaagtccaagtggattgcccaaactgaggaaccaaaatcagcagtcactgagatgactggtcaggtgagtgcggaataaagcaagcactgtgagtcacaggaaggtgagagtgctttggtacagtttccaaggcttggcattgtttgcaacgagttttgagtgaagctcatggtatggtatgtggttagagcaacccctctaaaaagccatgcagagggcagaaaaagccctcagttttctcaccagtagaagaaaggctcattggctaaatgagctctgagtgcatcccttagtcaaacattctcttagccagcagatatgcagagctgggctacaccagggttctgagcaataaacaagtgctcttggtaggccattttttctctctttggaacgtgacgctgagtttctgagatgctgggattcgcttttggtgtgtcaggagctgcactggcaggtccccatcccccacaaagcaacccctgttctgttggccaacacttcccagggcagccctcccatcaagggaagtgggctttctagcctttgggaggttgtacaactgcacctagttgccatagacacagccaagctttttgtatgtctgcttcactcctccaagactgctgcttctcagaccatactgatgatgctttctcctacttcctagcctaaaagagaatggtttgcttacttggtctttggtttagaagtggctgtttgtcctaacattggactcgtgcacctgaaatcatggcctcaatggcagaagcaggccagtcagggaggagagagggctgacccctggtattggatatggccactaaccaggacccaggcttgggaaagtggcattgttacaggcaaaggcagacaagaaggtgagaagaatactctccacgcagacctaggtgcctcggtgatattctagaaaatggtcagtgctgaggaatacagcataaccaacataataacaataattacaatagcacaagaagacacttgtatggacactggtaagtatttagcatacactaattcttttggtcctcacaacaatcctgtgaggcagcaatattatctcctcactttacataggaggtaactaaggcacagaggagttaaataacctattcaaaatcacacagcttagggagtatgtgggtattacttggctcttctgccagttgggcaatcatcatctgcaagacctctaaccagtggccacaccctagccactgagtcaaggtgccagttccagagagaaaggtgggcaaaaacaaggcagggagagtgactcatctatccagcattagtctagtattgaggaccatcctctgtgccaggtgttgaaggaagatttaagtaagatgatatctcatttaggctagcgtttagttttcaaggagggtaggaaggtaggcaggacaactctaggacttaagagtgggagttaaggcagaagaccagctgttaagcatgggtcagtgtaagaggtaggcttgggaagagttctaatctgggagcattacagatctttcaggcagctgttctagggggtcccagacaggggagagcaccctaattctaatgctccagcccagggctgaagccaggcattgacttcatgcctgtgaattggctggtcagggaactggagtgagccttagcctctaggtggaagctccaactgtagggatctgagtaggaaaagggaattgaattgggggctgatgggaaaaaatctaagaataacaccccagctcctgtggaacctgattttccttctcctatccctttggcagcataggtgccagatgtggtggaaagggaaatgaatttggagccaagagatatgggctccatatgttagtagaaactatgatgtttgaacatccttgttgggatagctgaaattcttagtagaaattgcagaagaccagaggacatctgggaaatatacatggattgaagtggagaaaaataatcttttggggaaaatctccatgaccaaaaaccatcttattgttgtttttgtcttttaattgttttcactaagggggcataataatcaagtcatgtatgtaaaaggctttctaagctgtatggcagaagccctgtgcatgaccttgtcagcatcttcattgttacagattggagattggcaacctcaggagttcacaggaggagactggaactttgcttcttcccacccaagccccttttctctgtaatgggaaagtatcatttggagctgattcacacttctttgctgtgctcacttgtctcctctagagccatcagcaggggccactgctacctgcaggcagggcttgcataggtgcatgaagaggagagcagagccccttgcccttggctggcaagcttagctaagaaaattgggaagttaagtatctgtcataggatattacgagggtaacctgacagcctggaaagcacttagtgaagcacctggcccacatcagcatttggtaaatgttggccttcgctattctccttttcccctcctcctctccatcatccctctcattctcctttcccacctcaccccaccatcccgcattttcagagggctttctcaaacctcaggctaatggcttgatggactcaggaccaagctgacctggctccgacctagtggcccagtttgggtaactagattttgggccctggacccttgcattcccagcatgagcactctggggttgagatattgcctggcctttggcgcttccccttccagcccctgtgacttacgcccttccctctactctcagagctccctgatgccagtctctagctatcccaacacatttgttggatatgacttctcctttggtaatagtggcccacacagcagagattcccacttgggtgtggagtctttttgtcctcacctgccatcctacacagtgactctatacaatgacctctaattaaccaagtatttatctcagaaccttcccagcaaccctatgtagttgcacagttcattcatttatccatttattcattcaacaaacactcattgagcacctactgtgtgccctgggaggtgcaaccagggtggcacagtggaaagagcatgggaagtcttggaagaggccttcaggcagtatggcagagtgggtaaagcctgaactcctgagtctcacaaacccacacttgaaccctggctctaccactcacagctatatggccttgagcaaatcacctcatctccccatgcctcaatctcctcatatgtaaaatgggcatatgaatatcccttacctcacaggacttactcataagcctcatttcctactctgtgctgtcatataatttgtatgttccttttatttctacatcgtatcataacatgttataattctatctgccttccaagctatattctgagctcccagcaggcacaactacttgtttatgtttgtatctctagtgcctcccatagtgtctgctccagaatatacattcaataagtcgttgctgaagtgttaacactatgctgtaattatttttccaggcctgtcttcctcattaagctgtgagcttctggagggacgatatttcatttgtctcaatatctgcagaacatagcaggggtttggcttggagtagacactcagtgaatgttggttaaatgaatgactggggagtgggggattgagggaaggaatgaatgaaggaacagatggaagctgatgattaagacagtgtcttacaggctcactgttagtgaggtcaccatcagcttcaaattaatttggatatatggtaggaatttggggtaagagatagttgcattttctgaggccttatcctccttaaccttgtagaatttaacactgttgaccactctttccttggcattatttccctctttggcctctgtaagacaaaactattttgggtttccttgtgtttttctgactcttttttttttttttttaagacggggtctcactcctctcatccaggttgtagtgcagtggcacgatcacagctcactacagccttaacttgctgggctcaggtgattctcccacctcaacctcctgattagctggaactacaagcatgtgccaccatgtctggctaatttttgtattttttatagagacggggtttcagccacggtgcccaggctgatctcgaactcctgggcttaagtaatccacccatgtcagcctctgaaagtgctgggaatacaggcatgaaccactgcacccagccaagtcttttttttcctcctgcttcctcaccattacctcttccatttcctccctaccaccgctagcaccccagtgtgatataaatattctctagggcttggacctggccctgccctctccttttctggtgaaaattaatctaatcccaaggctttgctctttagaggcatctgtatagatgactcccaaatctctctccagttctgacatttcttctgagctccaagtctgagtcttcagcctcctgctgcatatttaaacctggtcctttggctgacttcccaaacttcatgtctcaaaatcctcatctttttttccccaaactgacttctcttcccatcttctctctttttattagcagtaatacctttcagtttttcagttcttctatcttctcatatagcgataatgcctatatatattttccttatacaattcacaaggaatatatatatgaattattatatataatgaattattaattgtgataatggcagagtcattttatatatatatcacaactagtagtactagttgtgatatatattattgatgtgataatggcagagtagttatatatattatatatagttatatatatagttatatattataactataatatatattataactatataatatattataactagttatataatataatatatataactagttataatatattatataactagttatatataatataatatatataatatatagttacatattataactatagttatatataataacttttaagttaaatcttttaagttggcttctgtttccttttgtcatgatagcttccttgatttttggttatataggatgtttcaggctcatcttatacaattccaaacccaaactgggggtcaaccatttatccaaagagctctaactccccttaatgggaaatgatatttagagagcacagtctgagagctgggtttcctcatagctactagattgtcatgtattttctttttagtgaaagagctgggagatacatattttttaaacaatagaagtgatgagtttatactgatatttcaaagtcaaatttaagaggatagggtttttacttatcttttatgtttgtaactgtatctcttctctcttactctaaaagtcttggttcctaatgacatcaacaaaattacttgctttaccctacctgatatttgtaacaattttaaaataacaattcaagtgttactactaagactatggaatgcagtttaagattgctttgctattttgttgttcttaaagtaaagtcctgttagggaggtagtcaaagtattatattttaatgtcggttgaactaatttctttccctgtggagttatgtttccaacttgatacgcagtttaattcctttgcttcattttttccctcagttttagggattgttttcctttctcttttggatttatctttacattgattatacgttccaaagttggaatcatgtaagagaagatattcttgaagtcttgtttccattctgctcaccattctttttccttcttccctttttagcaatcatttttattaggttttgttttatagatctattatgtgtttgaatattaaacaaatgagagttagtagttgtattccacccatatttcttacacaaaatgtatcatgtgctataaacactgccctgcttctttgttttttccacttaacaacatgtcctacagattatcatatgtcatcgtatggagctcttcctcattccttttttataactgcatcctatgccagcctgaagagaaatcatagcttgttcaaccagggagtccctgttgacagatatttgggttggttctaatcttttgctattacaaagaatgctaccatcagtaattgaggtgcctgtctcctggttctcctggctccaagcctgctttgccttctgcctccttttgcacacgtgatcacttcagaacccagcagttcttcctttgtcctcttctctgtttctgcttttccatccgtgctgcactcaaccaatttcacatgtgttgtctttgcctgaatcatagcagtagcagtgaaatccctgcttatctttctccccaatcccagtatgtgctgaataccatggccatattcatctcctgaaatattattttcactatgatctcttctcaccctactcaaaaatcttcaataataacatacaatccaagttccttaatttggaatagaagggcctccatgaactaatccaaatctcctttcccaatacttattccctctgctttggtctgtagatacattactcagcatatgtgatttcccaaaattcatgttaattattgcctttataccttacctgttctttaaacctccaattaaattctagagcctcatatactcttccagaatcccaggcattctcccctgaactcttactctgtgtgatatcagtttcaaactcagcaaagacttagcccctaggcaaatggaaaatcttattgaatctatctgttcactactgtgagatctaagaaatctattgatacattcatcaagtattagatgaacaccacaacagcatccaaaggtgaggcaagtgggccctttgattgcttagggctccttctggtagtgagcaagaagtatgtgggcatctgtctgcctggacgcacagataggaagatattccagggtggcaatacttgactgagagacatagtagtagactgtgtgtctcttacaaaggataatttctttccagttcaagaagaataaattggacccttgtctggggaaaggggctcatccactgggccggagtcacaaggtccccaatcctgggagtttctacctttcgcccatcaagacaaaatgtggcagtatgttctgtgagggcttgaaactcatgtaaacctgacattgtcctggccaccagccatgtgcatggtggttggcaaatcacacattactgaacactgcattttatactgctttctttgtgcacttttgttgtttggactgtattagccttagtttcttacaattcctttttaaatttcaccatctggggctagaactatttttggtttatttatttacaatttaacctcctcctccctttatttccaaaaggatttgcagaaacttaccagtttaagtatcatgtaaagtaagacatagagaagagttgcatgtttcaagaaggagtagatattaccagatacctcatgatcagaacactatgcatgttgagcactgactttaactgaattttttgcagtcaagggtgagggttacagtggcataaataacttgagaaccagaagagggctatattcctctttaaatgtcaacttcttcctgacacaaaactcaaatagggatttgtcacaggaatattgaataaacacattaggtaacatagtgattcatgtctttaatttttacaaacaacacagaaataccagtcaaatcaacactgcttatgtgaactgaagtaggattttgttttcattcttgttattgtgtatatccacagctaattgaagggtaagctgacacaaccactttcgaaagctgtttagcagtatctactaaagctaagcaaatacctaccctatgacccagaaatttcactgcctgtgttcagcaaaagacatatgcaagaatgtccattagagcattaatttagtactggtcaattaatgaaaataaccaaaatgttcatcaacagtaaatatataaataaattgcaatacatttacacaatagactacgctacagtaatgaaaatgaacaaagtatacctacatgcaagaatgtgaaaggctctgcaaacatactgattgaaataagtcagaccctaaataatacatactgtctgattcaatttctataaagattttaaaaaaacagattaaactaaactgtggtattagaaatcaggatagtagttaatttccaaggggaaagaaaggagaattataggtgcatgatggggcttttggagactggcaatgttctgttttgggtctgggtagtggttacttgtgtgtattcactttatgctaactcattgaactgtacagatatggactgtgcccctttctatatgtgtgtaatgcttcaacaaaagtgtcaatagtgatgcatgcacatgttaaaatttcaaactatattaaagagtgtgcaattaaaaggaagttatcctctcactctaaagtcctatttcctctcttcagtctatcattactactagtttctagtatattcttttagaaatgtgctgtaaaagaacaatgatgtgtatgtctctacaggtatatatttattctttttgtaatttacaaaaatataaactcactacatatgttattctaccacatgctttttttcatgtaacagtatgtcttagacatcttttcctattattgcgtggaagctatcaaccttattctttgtaatgactccataaattattctactgtgaaaacacaccatgtttaaccagttctctgttagtgaacatttaggatttttccagtttttaaatattacagtgacatattaaacattaaacatatcttttgacacatgtccttgcacacatgtataggtatgatggactttaacaccctttggctagattctttagcacataacgtaaatatcccatagagtcaaaaccacccttaaaacttcctcaggaggctgggtgtggtggctcacgcccgtaatcccagcactttaggaggccgaggtgggcggatcacgaggtcaggagatcgagaccatcctggccaacatggtgaaaccctgtctctactaaaaatacaaaaaaacaaaaacaaaaacaaaaaaacaaaacaaaaaaaaactagccgggcgtggtggtgggcacctctagtcccagctactcgggaggctgaggcaggagaatggtgtgaacccaggaggcggagcttgcagtgagccgaggtcacgccactgcactctagcctgggcgacagagcaagactccgtctcaaacaaacaaacaaaacaaaaacaaacaaaaaaacttcctcaggaaggctgacatgccatatcttcattattccagcagagcctatttgcccccaatattggagtagatcactgagtcattggctaagcaccagatgaagaggttagcttgtggttatgagctatgttgaatgaaatatgtgtgtctttaaacaccacaatcactgtgagatgctcactgtatgagagacacacagggactgaaccttaccgatggagtagaagaaccacagcttttaccttatgttctctctagggcacagcaggatcattgagcggaatggtgggcacaacctgctacgccatttcaattgttgtcttgtctttccctcaactctctcctctctctaactttctgtctctgtctccctgcctctctcctctgtataccgagtgtatatatttgaatttacataactcacatatgcatatggtatggttccactctgtatccacaggatcaattccaagaagaggaattttggcatatatatgcatgcatgtatcgtcaaatcatgtacgtgtgtgttgtatagatacatctttttaattatgaaaaatttcaaatatatacaaaagcagatagaactatatgagtcccctatacccatcatccagcctcaacaatgatcaacacccagccactcttgtttcatctgtacccacatctgctttacctctttttgtaatctcatgaagccattcacagacatcataacacttgatctgtaaataattcagtatgtatttctaaaggattaagattcttttaaaaacatatccacaatacaaaaattacatctaaaaatgaacaaaactgtgttaaaatctacaaatatcccgtcaatgttaaagtttccaactctcttacagttgtcataaatggatattcatttgtttgaataaaactccaaatatgggctagatactataattgatatggcctttaagtttcttttaatctacaggttcccctccttctttctttttgccatttattttttgaagaaaatgagtacttttacatgtagcatttcctatactggattttacttattgcatttttgttgttaagtttaacattctctgcagtcttctgtgttttctctgaattaatagttggttttagaggcttaagtttctttgctttttgttttgtttttggtcgactatttcatatacagtttgtgctctacatttagaggcacgcactatctggttgtctctgtttttgtgatgctagcagccactgacaattaaacctagattcattcattcattaagggttgcaaaaatggtgatgttcttattttgttattccttctttatttgttagctggaatatttctgtacatctcctacttggttatccagtggtacagtttatataagaaggcaggataaatgcctaattccaaataatgagctagctcactatccactaatataatcaatgagtgattattttcaaaatataataatgaattcatggatttaaacatattttatgtgttttgattgattgttcttatattgaggctcacattggcccctctttggccatagggaacctctttaaattggcccctgagtcctttttacatgaatcttgtggtttttgaaagcttccttgctaggcatgataagatattctgggatcattatgtaaatttcctgccccagatctgaagacctatatttttagataccaacatggtatagtgaaaagatcacagtctttggagtcagagaaactgggattgaatcctggccctatctcatgctgcctgtatgaccatggtaaaactacttaatatctacccactttaagtttcttcatttttatacaaagcaggaggtactcagaaattcaggttccctctccatttcctgatctcttcttactcagatgacaacatcacatctattattacttaggcttctgtgcttacagcatggaatgttctctttcacatatggtagacactcaattcatacttacaaattgaccttgaggatagatgccatcaaatagatgatgccaacacgtgttgagctctgtgaaagtaggcactgtctcaatgcagctgtttttttttaatttctcctttattttcaaactacccattacgaatattagtaaatagaatccttatcatctctatcccctccccagaattgaggtgggatgatgatgccagctttcagttgtgttaaaggaggaaataaaagaagcatgaataattcaaaaggataatccaaggcaatgagtcaccccaaagtcactcgtttcagtttgaaagacattatttgatatatatagcagatttcccttcttaaattagctttacttacactactattaaaatggcttttcattcctcgaggtcacggaagctagagagggtaataaatccaaaatgtgctgaacaagccacagaagccaactcaggatgaagtgtttacactggatattctgccctgacactcaagtgttgctatgatgctgtcctcaacttaggatcagaattacgaaattgccaggcgacctcaacgttccagccctggcagccaggggagcagcagctgttgcaaagagcacagccttttgacagctaactgaaagatactaagttaaggtggaaagagagatgagaaaaagagtcaccttaattaagcagtatgctgtgatgctaagctgatgccatagattttgggggagctcactggagaattcttttgccttgtggctactttcctcaaagtatccagtgaactacatgacagtattcactcagaaggcactgactagggaaagctgtttgaccacctcctacagggcctgtttttgaagctgttggttttgtggtggaatggaggcagctggctgaggtgactagaaagccactgagtttcctgaaagctaaattttggggctatttcctctcttgggctggctacccaggatcccttttcccataagctccaagagtagattcctaacacaagggcttactctgtgccagaactttgaggggctctttccatgcattctctcattgaatcctcatatccagaatggcaaggtgcgtgttagatatccatttgttagacaagaaattgaaggttcagagaaactcaatgacatgtccccctgcccaccccagacaggatcacacatccagcagatagaagaattacaatttcaacatgagtatctgaccccaaaatgggtgttctctcaaggatgctgtgctgccttccttcagcttagctcctctctcctcacaggtctcacaggcacttgtctccctcctttgctccggctactctcctcctaggtttcacttcctgattgtccatactttcattttcggggacttcattgccaatcagcgcctaatgggcagggagggaagagcacacataccaaataggggaaggtgaccaagattgtgaaggccttgcaccattttcttcccatttgctctctgttcattctcttcttatcgctggatctgaaagtctcctagctctgaagttaaaattctagatcggtgttctgccaaggacaaatgtatttaaggcctggtcaattaggtcaactattagaagcagacctatcccaggaaacctgttattcctggttaatataactttgattccttgctaactcctttcctgccctcttgtcatttactctggtggccctccaaggaacagtgaagtgaccccgggactcatgggtatagtatggttggggctgctagctggaccctggacagactgcacctgcattgctcttactagcttagccacacacctcaggattcatgatggaacaaaaaatgtgtctccaaacgatatgtctccctgtaaggttgtggtcaaatggagaaggaaagaaaacttgtgtatgaactatttaacctgagaagcaacaagctaatcagacccatggaaacattatgtcaacatcaagaaactgtcaggagtagatattatttaagcacatgctcattatatttagcatttgtattgtctgttttactttgtgggtaagcattacagatatatgagaaaaatgagaggaagttttcatttcctactgaagttttacttcgtctcaaaagattgttttcatcacagggcaccttaaaaatgggtaataaccattattaaatagaataaattttttgaaagaagaaaagagttcaactcagaaacattttctttggaaatatcattaaacattatatttttaaaatattcattctcctcctttcacgctgcttgttcatgcctgctttctgtcgatactaaacagttataataaatcatactctcctaacagaattattattattctgtcattttttctaagtattttagatcacaacactttgcccctgtgtgtgtgcgtgcatgtgcattagcataatgaccaactattttgaaattagatttaattcattgtctttgaaacctgaaagctctgcagctctggatgtttctatagaaaacctcctcccctccttacgagaagggcaaaatgaaatgtcagagagatgactattcatctttccatttatgggcttattgtctttgacattctttatactacttcatcaacctctgcttaggccaacctaacacaaaggacaaagagaccatattgctatctctactgtttctttattttagaagatctcaccattataacctcctctccattactattgtccagctgggaacatgcacatattttctattaactgtactacatgagatacattttaggtgactgtcactgagctaccaaagattgccccgttttctcttttttgatatggtgtctcactgtgttactcaggctggtgtcaaactcctgggctaaagtggtcctcccgcctccgccttctgagtagctgggattacaggcaggtaccaccgagtccagctcagaactcttttttttcactagtaaagatctagagcggggatcagcaaactttggcccacaggtgaaatccactgcctgtttttgtacggttttattggcacacaataaacatccatttgtttacatatttctatgaatgtttttgtgctgtgacagcagaattgaatagatgtcactacttggcttttgtgtttgctttcgtgctacgacagcagagttgagtagtcactacattggatagagagaacgtatgtctcccaaacactaaaatatttactatctggctctttacagaaaatgtttgcccacccctgctgtagagaacagatgtccagcataacgtacccaaaacatctcagaatgggtttgcaggtgttttagaggtgaaggtgaaagaccatcaggaagatatagcaagagcttccccctgggaggcagaaaagggattccagtcccttctctaccactatttgcatcgatctgggcagatcctgtttcctccctagcccaagtttgctcaaaaggtcaactgaaagaattgaatgagataatctacaggggcgcttccaacttggagattctgtgattccaatgtttagtctaatgagatttgttacaatcacagatgtatacctacagttgaaactacaagatcctcaaatttttttttattatactttaagttttagggtacatgtgcacaacgtgcaggtttgttacatatgtatacatgtgccatgttggtgagctgcacccattaactcatcatttaacattaggtatatctcctaatgctatccctcccctgtccccccaccccacaacagtccccagagcgtgatgttccccttcctgtgtccatgtgttctcattgttcaattcccacctatgagtgagaacatgtggtgtttggtttttttgtccttgccatagtttgctgaaaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccgcaataaacatacgtgtgcgtgtgtctttatagcagcatgatttataatccattgggtatatacccagtaatgggatggctgggccaaatggtatttctacttctagatccttgaggaatcgccacactgacttccacaatggttgaactagtttacagtcccaccaacagtgtaaaagtgttgctgtttctccacatcctctccagcacctgttgtttcctgactttttaatgatcgccattctaactggtgtgagatggtatctcattgtggttttggtttgcatttctctgatggccagtgatgatgagcattttttcatgtgtcttttggctgcataaatatcttcttttgagaagtgtctgttcatatcttttgcccacttgttgatggggttatttgtttttttcttgcaaatttgtttgagttcattgtagattctggatattagccctttgtcagatgagtaggttgcaaaaattttctcccattctgtaggttgcctgttcacttttgctgtgcagaagctctttagtttaattagatcccatttgtcaattttggctttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgtggcattatttctgagggctctgttctgttcaattggtctatatctctgttttggtaccagtaccatgctgttttggttactgtagccttgtagtatagtttgaagtcaggtagcatgatgcctccagctttgttattttggcttaggattgacttggcaatgtgggctctttttgggttccatatgaactttaaagtagttttttccaattctgtgaaggaagtcattggtagctttatggggatggcattgaatctataaattaccttggacactatggccattttcacgatattgattcttcctacccatgagcatggaatgttcttccttttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggagttttccaaatatacaatcatgccatctgcaaacagggacaatttgacttcctcttttcctaattgaataccctttatttccttctcctgcctgattgccctggccagaacttccaacactatgttgaataggagtggtgagagagggcaaccctgtctttgtgccagttttcaaagggaatgcttctagtttttgcccattcagtatgatattggctgtgggtttgtcatagatagctcttattattttgagatacgtcccatcaatacctaatttattgagagtttttagcatgaagggttgttgaattttatcgaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcattgatgttcattagggatattggtctaaaattctcttttttggttgtgtctctgccaggctttggtatcaggatgatgctggcctcataaaatgagttagggaggattccctctttttctattgattggaatagtttcagaaggaatggtaccagcttctccttgtacctgtggtagaattcggctgtgaatccatctggtcctggactttttttggttggtaagctgttaattattgcctcaatttcagagcctgttattggtctattcagggattcaacttcttcctggtttagtcttgggagggtgtatgtgtcgaggaatttatccatttattctagattttctagtttattcacatagaggtgtttatagtattctctgatggtagtttgtatttctgtgggattggtggtgatatcccctttatcattttttattgtgtctatttgattcttctctcttttcttctttattagtcttgctagcggtctatcaattttgttgatcttttcaaaaaaccagctcctggattcattgatttcttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgcctttgttctctttggtttcaaagaacatctttatttctgccttcatttcgttatgtacctagtcgtcattcaggagcaggttgttcagtttccatgtagttgagcggttttgagtgaatttcttaatcctgagttctagtttgattgcaccgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttgctgcagaactgagttcaattcctgggtatccttgttaactttctgtctcattgatctgtctaatgttgacagtggggtgttaaagtctcccattattattgtgtgggagtctaagtctcgttgtaggtctctaaagacttgttttatgaatttgggtgctcctgtattgggtgcatatatatttaggatagttagctcttctttttgagttgatccctttaccattatgtaatggccttctttgtctcttttgatgtttgttggtttaaagtctgttttatccgagactaggattgcaacccctggcttttttttttcccatttgcttggtagatcttcctccatccctttattttgagcctatgtgtgtctctgcatgtgagatgggtttcctgaatacagcacactgatgggtcttgactctttatccaatttgccagtctgtgtcttttaattggagcatttagcccatttacatttaaggttaatattgttatgtgtgaatttgatcttgtcgttatgatgttagctggttattttgctcattagttgatgcagtttcttcctagcctcaatggtctttacaatttggcatatttttgcagtggctggtacctgttgttcctttccatgtttagtgctatcttcaggagctcttttaggtcaggcctggtggtgacagaatctctcagcatttgcttatctgtaaagtattttatttctccttcacttatgaagcttagtttggctggatatgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacgttttttccttcatttcaactttggtgaatctgacaattgtgtgtctcggagttgctcttctcgaggagtatctttgtggtgttctctttatttcctgaatctgaatgttggcctgccttgctagattagggaagttctcctggataatatcctgcagagtgttttccaacttggttccattctccccgtcactttcagatacaccaatcagacgtagatttcgtcttttcacagtcccatatttcttggaggctttgttcatttctttttattcttttttctctaaacttctcttctcgcttcatttcattcatttgatcttccatcactgataccctttcttccagttgatcaaatcagctactgcggcttgtgcatttgtcacgtagttctcgtgccgtggttttcagctccatcaggtcctttaaggacttctctgcattggttattctagttagctattcgtctaatcttttttcaaggtttttaacttctttgccatgggttcgaacttcctcctttagctcggagtagtttgatcatctgaagccttcttctctcaactcgtcaaagtcattctccgtccagctttgttccattgctggtgatgagctgcgttcctttggaggaggagaggcgctctgattttcagaattttcagtttttctgctctgttttttccccatctttgtggttttatctacctttggtctttgatgacggtgacctacagatggggttttggtgtggatgtcctttctgtttgttagttttccttccaacagtcaggaccctcagctgcaggtctgttggagtttgctggaggtccactccagaccctgtttgcctgggtatcagcagcagaggctgcagaacagcggatattggtgaacagcaaatgttgctgcctgatcgttgctctggaagttttgtctcagaggagtacccggccgtgtggggtgtcagtccacccctactggggggtgcctcccagttaggctactcaggggtcagggacccacttgaggaggcagtctgtccattctcagatctcaagctgcatgctgggagaatcactactcgatgctcaaatttttaaaacctttttattttgagataattttaggttttcgaaaaagttgcaaaaacactgcagagaactaactgcagcacacccataagccagcttacccgatgtcaacctctgcataaccatggtacagttctcaaaattaagaaattaaccttggtacaatactattaactaaactatagactttatttagattttaccagtttttccactgatgtcttttttccattttagatccaatccagcatatccctttgcatttagtcatcatatctccttaagtatcctccagtctatgatacttgatcaaaacagcacccatcagttattttgtagaatgtgcctcaaatttgatttggtctgatttttttctcgtgattagattgaagttatacattattgggaaggccaccacagaggtgatgtgcctttctcactctgttgtatcaggggatacatgatattcatatgtattactgggtatgttaaccttaatcacctggctaaagtgatttctaccaggattccctaccagcaacttataattccctcttccccaccttgttaattactaaatattttaggaaaaatactttgagaatacgcaaacatcctattctgcttaagcttttgctcactcattatcacatccattgatagattcctcctgtggcatttatcactgtggtgttctaatggtgatattgcttccttcatccctcctacatctatttaattggaatttttctctctcattcacttattcattcgattatttatatcagaatgaattcataaattttattttatgctttaacgtataatctaatactctcaatatttattgctcgttgctcaaattgctgcaattttgaccattgggaactttctcaggttggctcctgtgtcctttcaatatgcccctgttattttttttttaaggctgcctaacttttatttaaaagggggtgtgtttctgggttgctacaatattgaaagtttggttttcaaccaagggcaattttgcctgatctctcagggtaaatttagcaataagtggagatatttttggttgtcataactgccaagcatcctacagtgcatagtacagcctcccacagcaaagaattttcctgtccaaaatgtcagtagtgctgaggttgagaagctctggtctagagcattattttcttgatgctcagatgtatggtagcaaaaccaaatattgtgaggaataaaaatgctttttaaaagtatatttttaaagtattaaacattttgtgcttggaagaatatttaaaaagtaatataataggagactttctcttccatccatgatagaatatcagggactaattaccttccatcttaaacaactagaaaaccagagagaaaatatgaaataatggcttttagacattggacaacaggcagtacaaaagtacaagatggtgattcctgacagagagaatacaagtaaggtgagccctatgattttcgtagcttattgcctggagtaattttctaggctgcagcagagaaagagaggaccaaaaccaatcctagagctcttgatcagtaaggcagacaaagattagagtccagggagaccacgaaggctggaaattgcagggagcaagatttgtatagagaaagctccagagatgtgcagagggtcccctctagtctttggctgaattctgacctgcagctcatgtatgaggaaaaaaaaatctacccttgggcagtgatagaccatgagaaaacaatagactgaaaaattaacagggctcacacaggtctgggaatagacctgtaatacctggagtaggaactacaatgttccaaaggatattgtcttagtagtagggcttagttatttgtagactaaaggctgctatggacctgccttgaacaaagcttaaaagtaagccttgaaagaatcagataccatataagttgactgcatcccagaacaaaacccaccaatatttaaaggaatgcaacaaaatccaccacccaactgtgtaaaatccactttgtacagcacccaagaaaacattattggccatgcaaaaaaaaaaacctgtggaatatgattcttaaccaggatagatgacaatcaataaaaatagactttgaaatgacagagatgatggcattagcagacaagaaagttaaaacagcttttataaatatgctctatatgattatgaaggtggagaaaacatggatatggctaagagaaaaatggaagatataaaaaagccaaaatcaaactagtagagatgacagatacaatatatgaaatgaaaaatgtactggatgagattaacagtgtagaaactgcagcagattagtcaacttgaagtcatagcaataaaaattactcaaaatgatgaacagacagaaaagactgaaaaaaaagaacataacatgagtgacgtggggcaacataaagggatctagcatgcataattggagcagcaggagggggagagggcagaaaaatatttgaaaagtaaggctgggaaatgtttaaattttatgaaaactaaatattcttttatccaataatctcaccaaactccaacaaaataaatgtaaagaaaactacattatgacacatcatgatcaaattattgaaaaataattgtggataaagaaaaatgttaaaagcaaccagaggaaaagagacatggtgcaatgagtaataaagataagaattacatcagacttcttgccagaaaccatgcaagctagaagacaatgtagtgacatcataaatgtactgaaggaaaaaactgtcatcagaaatctaaacccaatgaaatcattttcaaaaatgaagaggaaataaatacttttccgacaaaaactgagagaatcatcatgaacagataatgcactacaatactaaaggaagttcttcagacaaaatgaaaagggtaataaatgaaaatttggatcaaacaaaagtttgagtcctgagactggtaaacatgtgagtatatttaaagatattttaaaattatttgtatattcccattaaatgaaaattgtctaaatgaaaaataataacactgtattgtgatgtaatatgtttctacattttataaatgtagaaataaaatgtatgacaacaataacataaaggacagaaggggaaatggaagtataatgttgtaaattcctatacatgaagtggtataatattgcttgaaggtagattgtgctaaggtaaacattttaatgcttgaaggtagattgtgctaaggtaaacattttaatgcttgaaggtagattgtgctaaggtaaacattttaatgtaaattgtggagcaagaaataaaaataaaaaagagagcctatgaagccaatactggatataaaagggaataataaaaacaattaaaacagaagtcctggaaagagagagcaaggaagaagaccagattgggtaaatagaaattagatagcaaggttgtagacttaggtccaataaaatgaataatttaattaaatgtaaaaacctgaacaattaaattaaagatctgaatccaattaaaagataaagattgtcagtttggtgaaaaggcaagacccaactatatgttgtctataataaacccattttagatataaatatacacatagcttaaaatggatgggaaaagatatagcaagcaaatactaatgaaaacaaagctggagtggctatattaatatcaggcaaagtagattttggtacaatgaatattactagggataaagagaaatagttcataatgataaaacaatcggttcatcaaaaggacataatagccctaaatgtgtctggacctaatagcagagcttcaaagatgtaaagcaaaaactgatagaactgtaaggaaaaatagtcaagtctaaaattatagttagggatttcgacattcctctctcatttattgatggaacaaatagaaagtaaatcagttcggataaagaataattaaattacagtatcaaccaaattgatctaattgacttttatcggacattatacccaatgagagcagaatatacattattttcaggtgcacacagaacattctctaagaaagaccatattctggactgtaaaaaagcctccataaatttaacagagttttaaataatgcaaaggatgttctctaatcaccaagcaaccaaacaagccatcaataacaaatagttaacactaaaagaaaaaagctaagtttactgtatgataatttaaataataaagttaaaaaatataacagggctgtaaaaaaaatagatatctgaaaaattctcagtacatgtttttaacagcttttaaaaaatataattcacaagccatacaattcactcatttaaaatgtacaatttgatggtttttagcacagtgtattcacagatatgtgcaaccatcacccctgtatcctttagttatcacgctttcatctctccaccccactcagagcaatcactaattcattttctgtttgtagatttccttattgtggacttccataagaatgaaaccatatggtatgtagtcttttgtgactggattcttttacttagtgtagtgttttcaaggctatttcatgttgcagcatatatctatacttcattttttgtgtctgaataacattccataatatagatacaccacattttgcttatccactcatctattgatggtaatttgggttgtttccactttttgactatgataaataatgctggtataaaaatttgtatacaggtttctgtgtgggcatatgttctcatttttcttgggaattaactggaccattttataactgtgtttatttttttaggaactgtcagaaggtgttccaaagtggttgcaccatcttccattcccactaacagtgtataggggttctgatttctctgcatattccccaacacgtgctgttatctgacttttttattctagccattttagtggatgtgaagtgatatctcattgtggttttgacttctatttctctgatgactagtgatgttgaacatcttttcatatacttattggccatttggatatcttatctggagaaatacttgtttagaccctgtgcccctttataatagggttatttatatttttattcttgagttgtaagagtgctttatatgttctagatacaagtcccttatcagatatatgatttgcaaatatctcgtcccattatgtgggctgtctttccactttcttgatggtgtcaatatataaatatccaaccacacattcctaaaaaacccatgggtcaaaaaacaaatttcaagagaagttagaaaatgttttaaattaaatgaaaataaaaacacagtatgacaaaatttgtggagtgcagctaaaacaagacttatgaagaaaatttttgaattcagtgctaatttagaaaagaagaaacatctgaaaggaactatctaaacttccactttaagcaactctaataggcattgtcagattggtctccaaaacagttatgctagtttatgcttccagcagcactgcttgttcacattataagcaacacacctgatactgttagactttaatattttgccaaatagatgggtgtgaaatatatcttcttgctttagtttttatttccctgattactagggagttgtttcatcttttctctcatgaaaagaatggttttttgagggatctcttaagcctcctgaaagtcgtctcatctccatggatctaacttaacaaaggtcatatataataatacttatgatgaagtaccttgaacttcatgcctatgtgtagaatttagactgttatgttccataattttcaattgtgcatttaagatcgacccagtggtgtttgtctactgtgttcttttgtatttttattgtcatatcaacttgtttgctccaggtcctaggcatgccaggacttgtcacaaaaacccacgctacagaagaataataagagcctaaagagttccatttctttgtatagattgaaagggaacatttataagggtcttgataaccatagaatgacaactatgttgtaagtttctcttttagtttgctttttccattttcatattgttctggagctgttgtttagatacatacagtagatcatggaagaccatgactacatgatgcctgtatgtgaatattcctaagtatttagatacatgaccaaattgttctgtgttcatttagatgtgtcagtgcggactttagccaagatttcatagtctactattccatttgtctctgttatggaacagaaacttttcagctctgtactgcttccctccatacctggacacctaggatggttctttgcaattaatcaattttatttcttagggtagttttaggtttacagaaaaatagagcagaaagaacagagggctctcatatactccctctgtttcccctattattaacatcttgcactggtgtagtatatttattacaattggtgacccattattggtacattatcactaactcaaatctatagtttgagattcaccttttgaattttgtcaaatacgtaatgtcacgtattcaccattacagaatcatacagaattgctttactgccctaagtatcccctctgctgcattcctccaaaacttcctcctcccctcaaactcctgccaaccactgattttttttcttacagagatagtttgacttcctctctttctgtttgaatgcctttttaaagaatcttactttaagttctggatacatgtgcagaacatgcaggtttgttacataggtatacacgtgccatggtggtttgctgcacccatcaacccgtcatctaggttttaagccctgcatgcattaggtatttgtcctaatgctctccctccctttggaccccacccctacaacaggccctggtgtgtgatgttccccttcctgtgtccatgtgttctcattgttcagctcccacttataaataagaacatgcagtgtttggttttctgttcctatgttagtttgctgaggatgacggtttccagcttcatccatgtccctgcaaaggagatgaactcatccttttttatggctgcatagtattccatggtgtatatgtgccacattttctttatccaggctatcattgatggacatttgggttggttccaagtctttgctattgtaaatagtgctgcagtaaacatacatgtgcatgtatctttatagcagaatgatttataatcctttgggaatatacccagtaatgggattgctggatcaaatggtatttctggttctagatccttgaggaatcaccacactgtctttcacaatggttgaactaatttacactcccaccaacagtgtaaaagcatacctatttctccacagcctctctagcatctgttgtttcctgactttataatgatcaccattctaagtggcgtgagatggtatctcattgaaccactgatattttttcatctccataatttgtcatttccataatgtcttataaatggaacaatacaatatgtagtctttttaggctggcttctttcacttagtgatatgcatttaaggtccctccatgttttttcatggcttgatggctcacttattttttatcattaaatagtattctattatatggatgtaccacttaggcctgttcttaacctgttgcgctttgatggatcatttaactgtgatgacagacaactcccaattctaaatcacaaaacccttcatgttcaaccatagtcaagtgcctatttgaacaaccacttcatttagactcatttactggctaatgtaaacaattgatcatttgggtaagaaaagaaattagccaaattaatggtcactaattcaaacatccaattccatcaaaatggtcaaactggttgaatgtatcggcctagtctgagagacagacagcatggtctagtggaaagagccctggcccaggagtcaagagctctacattatactcacagctcttccactgacctgtcctagctaccctcctctgtggaccctggtctttgaaggctttgcctgctctgctgagcacaaattccataagaactgtaagtcctcccttactggtcagctctcctatctgtaacattgggatgccatttatatgccagagcatatatgctgggatggtaggaccatgcattcatagacacaggacttagcttcttgccaggggatggaactcatgctgcatgtccctgagggctttgcagaacttcttcagagatgagctcgtgatacacactcatcctaagtcctgttggagataggcaaagagtgactctctgaaagcaggattttccttgacactgaaaaggggctttttctcttgtagtattattaagccaaaattgatccaaagccattggggattaatgctgctagatggagctgttctttttagatgaactctcctccccttcttcttgacaacgtaagtcccaatgagctactgcacttcctaagtttaaattcctctttgctatcgggaaccaacttccacgagtgcttctaaagttttagatttaaatattggctgcttttcacaacgaagtctccccacctttcattccgtttgtcttttgtgaggcagagggtctttctgcagtgttaaaacagaagcttgacattcgttccttcttttgcaaattaatatattttttcctgagagactcttcactacacgcagggccctgactctgggctaggcttggcagtaggttttgtggagagaagtagaagttcctctgactttggagagcacacagtctgagaaggagactgacaaatgtatacagcagacagagccagacagtttgggattttggctaggaggctcatcatatccccagctgcccagctaaaaacttcccattctccctcagctgccactcaccattggacctccgaggttcagaccactcatctcacatgggtgccagcaaaagctccaccccttgtttcccttgctccaggctgtctcctccactgcccatgatttaaaggctgttcttcccaccgcaaagtcatgcctcctgctcacaaggcctggatctgtactgactttggaatgaaatcccaacccctaggcctagtgttcacactctggcattctacctcctggttacctctccagatgactgggccaccaccttccacagctcctgatgcttcagctataccagacctccttctgttccctgaacatctcatttacctgtacattgctttactttgtttatatctggagttctcccttcctctactgtcttttccttttcattcttcaagctgcagttccaacatcaccactttgtgacaccttctctaattcctggagagttagtttcctttcaggtaatggcagagtgatgccagaccctggttctgagggcctttgccccatgctgtttggtgaagagaactggaactaagcatttcccagagtgacctaaagtctccaggaacacgtgctacctaggatctctgctggctccttgttcacaactatccctgcaggcagatgcagctgctcacatgctctggcaggagcacagccatcttctgtaaggaaggatgtcctctttgactggcagaaagcccagggagggaggggccagtaagcaggcctcctcagacctatccagagaggaatggggcagagatggcctcccagcctaatattctctccacatccaccctgggaaaggccgccacatacagcagctcttgactgattatccactgagctggtgctgggctacactccgcaaggcatttatggcccaatggggaacatagatctctgtatattggtgtattcatttgctcaggctgccataacaaagtagcacagtctgggcggcctgaacaacagaaatggattttctcccagttccagaggctagaagtctgagatcaaggtttcaccaaggttggttccttcagagtgctgtgagggaaggatgtgtttcagacctctctccttggcttctgatggttgtcttctccctgtgtctcttcacatcatcttccctctgtgtgtgtctctgtgtcttcatttcacccttttataagaacaccagtcatactggattaaggcccaccctagtggccctattttaacttaattgcctctttgcagaccctctgtccgaatacaggacttcaacatacaaacatagggggaccacagttcatcccataacaatgggtaatgaaagtttaggataataagggccataatgggggagggtctgcacagaatattgttgggacacagaacaggctgccctattctggcctagactctctcgaccacatcacacattgccagttaggactaccaagtcctgcctttaattgagcagagtacttgtaagaggcacagataggtttaagcccacagccatatggttccatgtaattatttgtcagttcagccatggagtgttctagttgagaagcccatgctccttgctttctctgatctggcccaggtcccctttgggaggagaagagatctccatgagcctcttctgacttctctctttccctgcctagcctggaaaaattgaaggaacataagctgagggtacagagagatatgaattcaaattttagttagcctacttactatttttatttatattatgaacagacaaatcatatccctgcatgagcctcaattccctcttccataaaatgggatgataattattttcaggcatgattatgaaaataaaatgaggatatttggtgaaagacaatgggtccagcctagcctggagtgtcttgatctctgtcctggcatagcctggtatggagtctgacatgggaccacacccaagccaatgagggtcaactgcatgaagcataagtgactgaatagatggatgagggagagcagtgctctcctgctgcaagtccttctgccagttgtgcccatgaattcaggttaagggtctgtgtgtcctttttacaccacggctaaagggaaaaatgatttcctccctttatggaggggatgggagaagaaaataggggattgggaaagatgggtaaaaggcccaggaaatatcattgatctgcttctcatgtacccatgtggaatgtcacaagcagggtcaggctgcggagctgagtgttaggccagggctgggggatgtgggagcagagggatgggactgggagcctaagttcagattgctgagggcaaggaagtgagggcaagcagcaagcacgggtttgtgggaagaaagggctgtgttcccccactctctccaccttatagcctagcatggagtagctagatggccaatgccaagaggctgaaggttgtgccaacagctacacttccctctgacttgctttctgaaagtcaagaagggtcttttaggcctgtgttatgctgtaatcaggtactctcatttcatggtcacaagcactacacctgataaataagtactccaggaagcagtagagcttggatttgaacccatgtatctctgatcctagagcctgcctcctatccactagggtatactgtctataatgaagaaagaatgggataggaagggagaatacctgggtttgaggcctaactctgtcatattctggctgtgtgaccataggaagttatttatgtgctctgagcctccacttcatcatcagttaaatggggataatactccccctcacacacactacatgtacatacacaggtcactgggaaagttaatcaagggagcatgagggaaatgctctgtaaagtatgccccaagttagcctatggcctggtgtcctatgtggcacacaggctaaccttcaggtgccacttcacttccttcgtgaaagtcccaccctagtttgaagtcactctgcaatgcaaattctgagaacccctggcctctcagagtcgcagctaggttctcctttcaaaactcccttttgggttatcagcaggtactgcccccttctctccccttcctccccccatgctctctcatgctctctctctctctctctctctcacacacacacacacacacacacacacacacacacacaccaaacaagatgataggcccagtcaatcagccacttgctcaaaaatcacattgcaagcatcatccattttctccattctctgggagattgctgcctggagttacatgtgggcccatcagacccacagaaagacctagttaagccaggccctggagtgaagtgctgagttgatgaaggttgaacagagcatctgggaaggaagggccagtccaatggacaagggcttggcaatagatggcccttctcttgtttctattgtaaataggtccaagatctgctcatggctcctctttgctggggacattgtcttcagtgccatctgtatcttcctcctaagtcatgggaaggggctttcctcaggtcaagccacaagtgataaggaaagtagcttgtccacctctagctctgtggcccaagtggtgggagatggcctggagtagggagaagcaacatggcctgcagagtctggcagcctgagccctggccccagctttgccctgccttgctcttggttttccataagtccctgcccctctgtgggccttggttcctctagcttcagattaagggagttggccttatcccatctctgacctcccttcctgcttgaatcctccttgtatccaggcctatacttcaagctctataatcagggagtggaaaggctttctggtcaaggtaggaattgttctgccagcctgactgagagtttcgtgtcggccctggtgcctgctgctgagctctaaccatttcataaccccagatcagagacactcattcattgtcctttgagacaaattccaggtgggaaaaatatcatgctttaaagcagccaagcagcaactaggctcaaatccatttatttacaaagattttccacctcttggcccatctgcctctgagtaacctgaagcacaacaaagatgatatgtgtcccagccctggattttgggctaagcgtgccttaaaaatctgcatcatacctagattccctcccaactatagctcaatcctgaacaacctcagctgtccacagatatttggcccaaggaaagccaaaatctcaacagttaactgtctcaccctaatccttctctatacatgtgaaatcccagtttagaaaggaaaaaatatttatcacattcttgcatggccattctacaccagattgagtgggtgacaggcaggaaaactggaaaggaaatgcctgcaatatttagttaatgtggtcatcatattttatttggctgcatctccccaaatgcaaatagaaatgtcccactttatttgcatgcaagtcttttcttccacagagggagagatgggagagccgcctcgagtcccgcagtgatcttggagcagagtgaggcatttgcttggacttagagcagttgtactgggttccaggtggctggagatgtggtttctaggacaaggccacatgtaaatactttatctcgatcaagagcagcttggaaaataccacaattccgtttttcagaaaatcattttgctggtacctttaacagaatggaaagagcagcaggcttggaatagaattactgcagtcaaatctgagttctagcacttgaccttaggtgaatggcttagcttcttggagcctcagtttcctccttggtaaaatggggttaaaagccctgctctactgacctcactgggatgttacgaagtgcccatgggaaaatgaatgtgaaagcttttgtcaactgttttaggaacatattttattgttgttgttattgttattaagtgaggaggctagagaatgcctatagagcaaaaccaggcaacagttctgtttttaggtggcttggactcagaacaacccatcttatagatgtgatttggagcatatagaatcattctttttttggtggggggagaggtaatcttttttattgtactttaagttctggaatacacgtgcagaaagtgcaggtttgttacataggtatacatgtgccatggtagtttgctgcacccatcaacctgtcatctacattaggtatttcttctaatgctatcccccccagcccccacctcagctagtttcccaacaaaaaaagagtcacccaatccaaaggatcaaggtgttaatatgaaaactggcatattttcaatgggcaagatttaaatatacaggaaattcatttttagtttttttaatcaaacttttattaattttgagatcattgtagattcacatgcagttgtaagaaacaatacaaagagatccagtgtatactttacccattttcccccagtggtaactatgaatcatatcttaagggcttatgtttttcctttgttaggctgctgggaatgcagcctgctaccagaccatggtagaaaccattagctctacagaaacttcactttgagacttcccttaccctttctctggcatttggctccctagaaggcatctatctctcacatccccctggtcctgataaaacctggcatccaagatgctgcccaaattgaaaacgttttggtagtgcaggtagcacagttgccactgccaaaatctgggcaccttcccattctcaaatttcattctctcacccaactgccctgttttccatcacttcctggggagctggacctcctacacttgacattaaaggcctttcctaactcatctcttcagtgcagagcagtggaaaagatggttggctgtagatataagcaaatctggttttgaatgccagctctatctcatactcatatatgaccttggacaattacttcacctttctttctgagcttctgtttactcatccatcaaaggaagataataatgcctcacagagctgttgcaaggattgaagagataacaataaatgcagagcatctggcccagtgcttaaccatcgtggctgcctagttgtcagtggctgtgagcactgcagtgcaagtctatcatgcacagtctggccccatccagatttggtctttgctattataccgtgactctctctgagcctttgctttgacttcatgcctttatttatgctcgtccctatacctgagacatcttttcctttatcatgtttgcgtatctaaaatcagatctataattcaaggcccagctcagaggaagcccttctggcccccagcctgctgtgatcacttcaccctcccttgtggtgcccatcaccctctcctttgtctcagcatggccacagctactctggttgctcaagagactgagctccttgaggataggctcagggtccgcttcacctcagagtacagggcttgatatagagcagcagctatggcaggatccatgggtgtggggtcacacttgaagctctgtagaagatagactttccagcatttgactagatcatactggccctgcttccctgagtgccagggcacccctgccccataaaggccaggtggcacctgggcccctgctagcagagtatctaagtttggatcgtaagaagctacctcatgttcatctacctagaaacagacccacaggtggttccatttggggaagccaatagctatgaggagaaccttctcccgatatttcaacaccttgaatcagcaagggctccatctttctgtgttgctttgaagtttagactcaaactgagacagcccaagaatagggagataagctatgtggcaatccaggactttggggtcagggagtcctgggaggaatcctgtctccccctccttactagctgtgtgatcttgggtgagtcacttcacccttctgtcaagtgtttctgaggagtaaatgggaagggtcaggcacagggtgggttacattgggaacactcaataaaggttcattattgggctagtgctatctgtcctatcaccatagagggcactgcagtgaaggtgagcatttcttgggccccatttaggggaatttatattctgaaatacaaaagcatttcatcacaatgcaaccttgcccatgagcctatcctgaaatatgaaccctgagaagagtagttcagagatgcccttggaaatagtggctattactgaggacgtgttgacatgaggtgagtttgcaactatcccatttagtactctggtgaaggctgtgcactgggatctcatcagtgtgtaaggaaagtgtgtttcttccaggaagagctgcttttgaccagtgtgattgagtagcgattggaggtgttgaggaggatttggtgacaagtgctccattaaatctgacttaggaacagtctccacagagcttccatttaatacttaatgctttgttctctgtagctttgggggatcagttttcactcccttggcagtaacatggatgagctcaattgtgggccgcactgcgtctttggcccctttatggggctacagagacaggtcctttcaaaagctgctgagaaggcctggacgttgccaaaagtggtgaggacaacgtgggtgtggcttgttcaggggctcatctggtgggtcagcatggcaataggtgctcgggacactggaagtctggtgcttggtgatacattgccagatgccaagtcattcacatcaaaaggctgtcagcagctggggagagaggggtttgtctgtctgatggaggccacactaaagcagagcagggaaacaggacctgatccaaacacattggggcttaaggcagggacccaggtccagcaagaagctggaatgctcagcacagaaaacaaggcacagcccacctatatggacttggccaacatggtggcagcagtaaagactatttctctataggcacagggtcacagggctcccccagctgcaccagctgctggctctagggcagcaagatagaggctactgggtgggccctgtcaggtatatcgtaaggccaagactgagactgtgggtagaggccttaagcctggcagtgagaggtgggcgctggcagggactgaggcagattggctgacccattcctgtcttagtcctttgtttattttcacttggacaccatattgaaggttacttggctactttattcctcattcactcaaccaatatttatttactgggcacctgctgctccagtcaggccctctgctctattctgagaagactagtgacactgataccatggttctctccttacaggcctcactcctactggggttggccaacaagcaaacagacaattagaatgcagtgtggtaagggcaatggtagagtatgcactgggcaacactggagcccagcggaggatgcccgacctacagaggcatcttcctggaggcaagagaaagctcgccactgggcgcacttctggccacaatgcagtagtgacatctgtctctgcctccttcaacaaggactgtcttctcaaatacataatttatttggttgggggtggcaggtggcactgcatgtcagagcaaagtgaaggaaattctaggctccttaccagggctggtctgagttaactcccacagcggggaccaggaagtaagcccaaacactcagacaagtaactgataatttaaaaactgtctgtcattaaggattagctctgacacaggccagaaactagcaggctggataagagccttggagggaaaagcagaaatagccaccttcacttggggcctgggaattttctccaagttggcagcaaatcctcttgggaaaattaaactcacagggaggcctaggcatcttttctctctgaggtgagggggatttttccttcagtgaaggatatgccaaggccctaagtcctcctgggagataagatttcttttctaaacatcaagggattgaggattttattccatagtgggatggagaatggcaagcatggcttgcttgggactgaggaccacagggcccaggaatttcagcccagaaaaggacagtgatgccctggagctcagaacctgtggagaaacagcatcactagggaagctcagcaccaaaggaaaggcattgccatctcctgccatagaggatggttacagcacaggaaaaaaaaatcaccaatggcaataatggaaaccactagtgggaatggttgtttttg

SEQ ID NO: 836 - DNA, 123471 bp, Homo sapiens
tttctaaagcacttttcccaagattatcgcacagtatacacctgctcggtttcaagagaaggtccaagattagaacgaaggccagtctcaggagtgtgcagcctaagcagtcacacagcgtcccacacttagaagggctctgcacgcttgaattaatgctctactgccactgacttgaaatgcttaataatttttaaacaaggggccctgaatttttattttgcactaggccccacaagttttatagccagtcctagctaaaacctttattttataagagagaaagctgacccgtagggagcagatgtacttagtctaagttcacgtgactgaaagtgcacctcaggggctaatgcatttgcacttagctgctttcaggcaccagcaactagactgaaacaggccttcagtgtgggaaggcattcctggggttcccgtggcagaaaggtaggggtagctggaatcacagctccctcacttgttctaaggatccaactcagaactggagaaatccaggctttagggagctctcaggctcgtagggaagcagacagcattaagaaaatacaattggaataggagctgaggaggtgacagcaggacaacacctgttaggggctatctggtgtcccccaaaattcatatattgaattcctaagccctagtacctcagaatgtgactgtttagacatggggcctttaaataggtaattaagatagaatgaggccgttagggtggtccctgatccaatatgactggtgtccatgttaaaaaaggagattcagacacagacttgtgcagagggagaaccatgtgcggacgcagggagaagtgggccatctacaagccaaggacagaggcctcagaatgaaccaaccctgcccacaccttggtctccaacttccagcctccagatctgggagacgatgcatttttatggtttaagcctcccagtctgtgatgctttgtcatggtagctggagcagactagtataacatccttcattcctcccactcctgtgaaataaagcctatgactctttcacagagaaagggcccaagactttaaggggttaactatcttgctcagggtcaaaccagtaggcagccatgccaggacttgaacgcagcttgatctgtccctaagcctgtgttttccactccaccagcctagggggaattgcaccccaattcgcccaattcagaaggtctgaatccctttcctaggcatgcccatccctctgctgccctgtgggctcagggacttcctggcacagatctcccaaccccagactcaaagcttccctgtggtttgcattcctgccctagactaagaggactgccgtggctggatcctttgacagaaggactctggagccatatcaacatttaccctaaccctaaggaccaaacaaaagagtgaatatgacaagcctttataagtgtcacacaccagagttccaggtgcatggggttcatgaacaccagcactaagggaacattcttcctttactattaaagtagctacatcaggaaatcacagattctgttgcctttatgtggaggagcaattcagctctctctgtgactccctcatttcaacccagaggcagccaggtatcttcctaaacaaagagctatctacccagggacaaccatgttactcgcctgaaaagcaaaagcaactgcagatagttaaggagatttttcttctttcttcttttgttaaaacaattttaggttaatggtgctttattggggtataacatacatacaataaattacccagatattgtgtccaacttagtgaaaaatttaacaaatgtacactcccatggaaccatcattcttgttgatatggcagttgtatttttaaatagaaatcccaccttctttagccaggcgtggtgacatgtgacagtagtttgagctactcaggaggctgaggtgggaggattgcttgagcccaggagtttgaggctgcagtgagctaaggtcacgccactgcactccaggctgggtgacagagcaagactcccatctttatttacaaaaagagaaagaaaatcccatctctctgctgcgaggcttccgtgccatgatgaagagaacaagggctggggaagcacagagaagagtacaaatccagcatggaggaatcctgaaagcatcccctcgagcgtgtgacagacaggtaagctagatcttgtaaagagtctgctgagaggagacagggaataaagggacattgtagacataaggataagcaaaggcttaggggtttccaacagcttaggagaaagagttcagagtaaatacagcagaagatggctcatggggtgccatctggggtcaggaacagatatgattatataaaaatgaaaccaagcttgctgtctgatttagaagctatttctgctaccagaacagtcagtgcctgtctaacgttcatgtcaggttttattgcttgtggtcaaaggctgtcgcacagtacacggagcaaagagcagaaactgcatgatttttcagaacaacgtccagaataaatatgaatctctgccttaaatgggacattgcagagcaagttacataaagaattatcagtctaatagatcacagcactagttgatcaaaatacttaacatcagcttagcacggacgtttaaagcagtcagcatcaaagagatacttaaagttgtaaaacctaaatgcatgtttcccctcattgtccccacgtcattttctccctctttaaacgcttgtcttactctattgcatagaattcatctttttaagctgttttaaatcctttctggaaaaatgaaagtatacaatatacacagattaccacatacataggtgcatgcctgtctgtctcagaaacggcctatcatttcacatcaatttttaataccacccctaccataaaccagattgccatatgcacataagcctgtttcaagactatttcttctgttccaatagtccatttattcgttcctggtagtataccacactcttacttactgtattttctttcatctaaacaatcaaacattctcaagtctttcccattaaaaaaagaaaattctcccactgccacccccacatggccactagctaccatgctaactctctttccacccttttacggtcacatttctcaaaacgtctgcatgtggccctctgtttcctcagccacttttcaatcctaagccacggcaatcttatttctactcccaccacaccacacaaactgctcttgctaaggtcaatgagcttatgttgctaaatccagagggcaaactccagccttcactagcttcacccaggtgaccacttcctctccctttgcttctgtgcccttccatcctcttgggtttcctgcagttgctttccttattttccatcccccttcttggcctctcctcctcttcccacttcttaaacacggaagctcctaggatttcggggctgggttacattctcttaacaggctcaccacagtttacctaggagcactccccctcatctatggcttccaacattacctgcaacatggaccatgctgcatgttcaccaaacacggtttccttttcctgctttacatgcagttagaccacatttcctggaatcccttttgattatgtgccactagcttctgaccaatgggatgtgggaagaagagatgtttaacacttgcaggtctggccactcaaacctcacacgtgatcttccatgttctctcttttcattcatctgccagcccggtgccaaaaaaaaaaaaaaatgccagtggagatctctgagtgcctaggggcccctggaactactggacaagaggaagctggatgtctaataccctgaataaaacagagcccggcctccaccccaacccacccccactgactttgaacatgagtgaaaaataatcctttattgagtcagctcactgaaatacagaaattgtttgatgaagcaattaacctggcccaactaatacactatctctatgctaatgacaaccaaatatttgcattatgggcctgttcttctaattatgcatcaaatgattgacaatgcagcccaaactgatgggacagatagtttttttttaatagattactaggaagtcacagatattcatgcatacattcattcattcaataaatgtttatcgagtgcctacaggcaccagataccgtgctagaaactaaggttgcaatgatgagcaaagataaaaccagtccattcactcacaaagtttactgtgagcctgatgacagctgattctcatgtctcattatattccagctgcgagaaacttctgtagcatttgctgcttcatgcaagcccgctacccataaaactgaggcttcccctctctagatcctggaatccactgttctctcctctatgaaagggtgcaactggatataatagtataacacccctttctcttaagtattttgtcagttttttattgtagtaaaatatatataacacaatctttttcaatgtaacaatttgttgctaattcagtggcattaaatatatttacaatgttgtgtaacttttaccactatctataccccaaaattgtcactatcaacaaaaactccatgcccattcaacagtaactcctctttccccttcacctgagcctccagtgacctctattctactttctgtctctaaaattggcctattctaggtacctcatataagtggaatcatataatatttgtcctctgtgtctggtttttatcaggaagcgtagtttttaatagtacatccacgttatagcatgtatgagagtttcatcccttttcgtggctcaataatattccattgtatggctagaccatatcttgtttatccactcatctgttgggatgcacttgggtttctacttttggctataatgaataatgttgctatgaacattggtgtataaatatcttttcaagtccctgttttcaattcttttgcatctatatcttgaagtgtgattgctaggtcatatcataattctatgcttaaccgtctgaggaactgccacactgtttcccaaggtggctgcaccattttacattcccatcagcaataaatccaggttccagttattccacatacttgccaacacttgttattttccttatttttttattatagccgtcctagcgtgtcctagcatgtgtgaagctgtatctaagaacagttttaagtataaatgttatatatgaatacaattttgttctgacaaattcaaacccagaatagaatttaaaaatccacttcactgtagccacgtccaacctccttcccctctccagagaaaatcactgttaaaaatttggtatgcatctttcctgatcttgttctctgcatttgtgttctttttttttcatatatggatttttttttatggcagaatttttatatatttataaatcagttgggaaaaggtaaactattcaataagtgatgctggaacaaatgagtctccatatgggttcagaaggaaaattttgccacccaccaaaaaattaagatgaaatagacacgaaacatggaaaacaaaactataaaacttacagaagaaaacacaggaaaatatcttcattatacgtgggcaaacacagatttctttttttttaaattttatttttccataagttattggggtgcaggtggtatttggttacatgagtaagttctttagtggagatttgtgagaacctggtggacccatcacccaagcagtatacgctgcaccatatttgttgtcttttatcccttgacccccctcccactcatccccccaagtccccaaagtccattgtatcattctgctttttgttttgtgttgttttgcatttgtattcttatgtgtgcgtgaatgcaagattatgcgtaatggaaacatagccattctgtcactgtcagttttcttccttctttccaactgttccactgttgttgttgtttttttctgttagagaagttccacttcgaaaattttgccctttagcttgtactgctggttataacgtggtctttgatttccaggaagagtatgctgtgttggctgaagtcactagcagaagaactttggtgtctgcctcatgtagaatgcattgcctaggtcgtctcaggcctgatctgagctgaacttctcctatcacatatgccaacaactctttatgcttctctctttctctgaaattaccttcttttgtctggaaaaaaaaggaatgaggaagatttttcaccccttcagagaaaacaactatccaacaggacgaacgtgggaaacagccagtgtttggtgagagatcgccctctgctgcctgtgttaatcagggttctccagagcagcagccaataggaaagatagatacatttgtaaggagtaacataatacatataaatatacatatttaaacatatatatttagattataaatataaatctatgtctatattatatataaatatatacaagttggttataaggaactgactaacactgttatggaggctggcaagtttccagatctgcagggtgagttggcaagctggagatccaggagagctgataatgtagttccagtcagagttcgaaggcctgagacccaggagagctgatgacatagttccagtccaaagcccagcaggctcaagactcaagagaagccgatgctgcagtttgagtccaaaggcaggaaaaagccaatgtcccagtttgaaggccttcaagcaggagggattctctcttacttgggggagagttggccttttttttctattcaggcctttaactacctggatgaggcccacccacataatgggtggcaatctttacccagtctcctaactcaaatgctaatctcatccagaaacaccctcacagacacaccgggaatgacgtctgaccaaatgtctgggcactccgtggcccagtccagttgacacataaaattaaccatcacactagccatatgggccttttagggagcctgaacccatagcaggaagctctggtgccttgagcaattgtccggatgggcattataggcagttaaaattctaagcaagaaagattaagaaaaaaacaaaagcgtgtaggccaaactggagagaaagagagtgcagtggcaatgctattcgggtttctttcctgctcagaaccccgtgatgactcctcatcccccatagaacatacccttaccttatggggtttgtgaggcctgactcactgcctgcctcctgctgccaccacacatgcttcttcactgttcctcacttgtgccaagcctgttgctgtttcagggcctttgcacttgctgttccatctgcctgggcactctttcccagatccttacagggcttcatggcaaggccttccctgaccaccctccccaaaatagcaccccctccatccatttccgcctccttacccccctttatttgtttgagcttgtttcctgtcttcttcactaaaatgtaaattccacgaggccagggactttattttttttctctgcaaggcctggatcggaataggtgctaagtatttgctgagtgagtggataaatgaataaatgaataaatgcaaaagatagaaggaggggacagatctagtgatggataaaaagcacatacgaaatggtgtggatcctaacgaataattaatctggggaaagctaaagctgaaaatgaattgaggctttaagaaaatgctgaagacagataagtaaaatgccttttagtcagtgtaaggaagtgtgagagcaatttcttggaagaaaataaatcctcttttgttggcatttttccttccagaagattgatcttcaagctaaagaaaagttggaggagagggaggagagagagcgggaaatccagacagctggtgaagttgctagatcccagaggctccaaggagcgattgattgcaggggatgtctagatagtgacagagaaagcgtcatagagatccccaggccccagagcagcaaggaagcagcagcctcatgccctcaggcatggcataaaaataatgctagagctgcctcactgaaaaaaatcccgaagggccaggaagcaggctgaactcagccaatgtctgtatggacagaggatctctaaaccagcccccacccccccacacacacacacacacacacacacacacacacacacacacacacacacacacacacacagagctatggcacaatgctatgggtttgcatatttttctccatgccccccagaatgatgtccaaatctagagcagtgggtgtgaatcttggctcgtgaactctttgaacaaatctgatgaaaattgccacatgtgcattatttcagggaatttaaggaaatttcaggaattctcctccaggcgattcatggacacctgaaatccaagtgccccaggttagaaactcctgttctaagggtatattcctcaattgcagcacttggattaatgatgtaactccttaaccctagagttgaagattgcagccaaattcttagtgtattcattcaacaaatatgtattgattgactgtcatgtagcttatttaatcctcacaactgcccttgaagtagattatattaataccaccctcactcttgacagatgaaacaaacgaggtactggggctttgggtaacttgctacaggtcactcattttgcactagtcactagtaggagcagagccagtggtggaaccccagaaattcagctttagagacattttactgctaccccacgatgcctcttacgaggttggcatctgtctttcagatagccccgttcaccctgaaaacatgtctcttagactacatatagtaggttagacatgaaaatcccaccaccaacgacatccggaggctctgtcaccctgcctctgcttattcatcgttcccatggtttgctgactcagttttaatcattggtttaccttctggatctatttgtatgagggattgcacaaatatttccccacatccaacatctcgcaaggagatggactcacgtgcatgttcaagttcagtctccaagttgagaagaaagctttctggtagcaatgctgcacacacccaggggctcatggatctctcaggagaggccacatccagtgtccatgaagtcatgagttctgcagcatagattccaagttcagcttttgtttcatcaacattactgtgtgcacttctggttgagacacttaggggaacagagaaagttcttcagtaaaagagaggatgtatgagcttcctgtggcttctgtaacaaagtacccatggactgaggagttaaacaacacaactacatggtcttgcagttctggaggctggaagtcaaagatcaagatgtcagcagggtgagctccttctgagggctgtgaagaaaggatgtgttccaggcctctctccttggcatgaagatgactgtctttgccctgtgtcccttcacatcatcttccctctacacgtgtctgtgtctctgtccaaatttctccttttataaggaaataaatactgtaaatatatatatattttgcactataatactggaaatatttatatattcctagtgtttatttatatatgtatattcccagtattcatatatgtatatatttccagtatttatttatatatttatttgatataaggaaatactggttgtattggattaaggcctactgttgtaaactcactctaacttgattacctccacaaataccctacccccaaataagttcaccttctgacgtcctagcagttaagacaccaacatatgaattttagaggtcacaattcaactcataacaagggataatggtcaggaagaaaaagagccacagaatgctagacatttttaatgagttaataaatccttgctataggatcaacaaacttagtaagttaataaacctgatgatggatggatggagcattgtaccaggcacaaagcccggctatgatgacatcaaaggcaccctgctctcttctgttgagaagtgttcaaagtagttagggagtctcaatgagcccatgtagcaggtaagcaatcttgatcgctcacactcaaaaatgcaaatgtatcattttgttcacttatagctagacttaatagggtatccattcaaatgacctgtcattccatcagtgcccacacctggtgactttttccaaggggtccacagccccaccaggattctccccactgtggcattatctccatcacaccccaaggctagatgagaccacagccctccaaggctaaatgagaccacagccctcttggggcactaggaagatccagcttaaaccactgctgaattcaaggtaatttagtggcactgcctcagaacctctctgtcctggcaccccacctagtggcaagggacatatctgcaagactgctgtcttccagaattccagctgggacgcagtcctctatttgaaaacaagttttctggaaggagggagctctgaggaggagtttcacaaggagaagaacacagatttgggataagatggggggacaatatttcagtagggacaatgacagagacatgagtacatatatatatagcaactaactttatatgaagggaaacacacatagacatgtattaaggacacggtgtccaagtcagagggaaaaagaaaaacaggctaattaatgagcagccatcatctgtggcaaagaggcatcaggctctacgctagcctttgtttgctgtctttgacctctctgcacctttgttttctagatgagcaaactgaggcttgagggggttgaatcctttcccccaaaaccacagctgctgggttgaagagttgggattttaaccaggggcggctgaatcaaaaggctaggtctcttccctgagcaaaataatggcatgacaaagacagtactgcagattgtcttgggaaaagacaggacagggaaatcagctaggaggacatttcagcaatctgaatttgagttgaggtggtggcttcagaaatgaaaaagaaaggggtggatgagtgtgaatactgtagggaaagtctgggtgacatataaggcaaagacaaaaaagaaaatgaaaatgacatcaatcctctaaaccactgcatcagaaagataaaggcaaacggtggtggttaaggagaggcttggaagaccagatgactgggaggctgcagggaaaagctagaaatgagggtaactttagctccagatacagcaagtgctgatggcgatgttctttgaaatgggtccacaaacccacataagaatttggagggctactgacagagatttgggtcagcaaatgggtccgatatgtccgagcatggcacacaaggatgatgtctcagcttcacagctgcagctgatgcagaggcactatttttgctacaactgaagatgtggccattccagcggcttccagcatgtaggacgatgaactaagcaggtcatgagacatggagtggagaaaggagcaacctgctgtaagatacttctcactaatggtgatggaggagctagctcaaaaaggggtagcttctgcactgtgcaggaacttgacaccatctggacagcaagccggtccagtccaactgaagggtgactaagtgtatagtgggctgcctactggcctagagtagtgactaagttgcaattctcgttaaactgttgttttgagtgtattacttccttctagcatattgtcaaaattctagtattcaaaggtgtgacaaaaacataaaataaagttgagcagccctggaatacagttatccttgacagcaggagtccctcaagggaagagctgctctaagatcaagttttgaggttggcccaatgacagtcagacatcctggcacttgaggttgcatttgaaaggtcagcattctcaaaagccagattgaactttaaggaaatttcccccagtggatggtagggagccacgtggtccctgagacacctgggtctaacctcacagtctaactcctaggcttcctaaagaggtggttaaacaagaaaagtggtaaaaaatgtgttctttcttctcttcccggtcatcatagaacttaaaaaaatctcagtcccagcagctgttccatgtcttacagagacagaaactgaaccacctcctttcttaaatcatttcgttatatcaggcttgagcatgtctaccaacaaattctgctgttcacagtagttctaacacttggaagcaaagaaaagacgaatctgctggacaggtttttcaaggaaatttagcacaaccctaagttattaaggaggcccacaagaccaaacacaaactgactattctccctctccgtccccctacccttcctcccctccggctctctggtccatcctcagggaactggcctgcattccctagccctctccaccatcccgccagatctctctagtccaaccccatatcaactgacctctgctctctctccatccccatccccttatcccccccatccccctctacctctctggtccagccccacatgaactaactctgggctcaatctccttcccagtacccagtccattgtgagatgacctctcttgctccctatgtctctaagcctttgcacctgtttgctccatctttgcatgaactaatctctgctccctctacttttccatccccctcaactcctctggcatccctctggtccagccccacatgaaggaacccctgctccctcttcctcccctttttctccaactctgattgaactttttagttcaacctcacatgaagcaatctctgacctctctagttcaaaattccacccccaccctcctgcagctctccagtccaaccccgcatgaactgctctctgctctctcctgtgccctgtctccccccattgcactactgccctctgccgcagctgcacatgaatgaatctttgccctctctccagcccaatccctacacgcaaccgacatttctttggtccagccccacatgaactgccctctgctttctctcctgccccttccccaccacctccctacattggtccgtcccacgctgcatgaactgacctcagtccctttacttctgatcttctcccactccccagtgtccttctggtccagtcccacatgaactgacctctgttacctctccattccaaacccaccccactcctccatctctctggtccacccgcaagggctgacccctgctacctctgtctccctgcctgtcccctgcagctctgaaatgaccggtatttgaacccactcaccctgcctctccctccctaacaacaaaatgggaggcagggcccagtcttttcactcctctccaatagtatatgtctttatgcaatcatatgccaccttcacaccccttagaacttacccagtcactctccctacatctctctggtccagccctccatgacatgaactcagctccatctcctttccttccccttccccaccatacatctctggtccagccacacgtgaactaagctccgttccctctcctttcccttgccccacactccggctacctctgcagatacagccacacataagctgtcctcagtggcttttcctttccctctctgacgctctgcatctctccagtgcagctgcacaggagctggcctcgaatgcctctcccatgccatcccattcagccttctgcatctcttggtacagcctacatgaactgacatctgctccctctaagtgtgcatcgccacttcatccccctccagcttcctgggccagccccacatgaactgtcatttcccctcactccctcacaactctattgtccacatgaataagccactaactctacaaacccacccactgacactcccatgaaaactcagctgcatcctcacatgaactgatccctgctccctctcactcccttccccctacccctgctcccctgcacctctccgggacaccccatgcacggatcttttctacttctctgtccctatcctctgcaatttcccttcatctcttggtccagccccacgtgaactgacctcagttacttctccatccacatcctcccccgccttcaggactcttttctgcctccacatgaactgagcccagctccctctccttccccatcttcctgatccctttacagctctctggtccagccccactgactcatgctccctctccgtccccatcttcctgatccctttacagctctccggtccagccccactgactcatgctccctctctgtccccatccttccactgaataactgcacacctatgttagaatggctgccaggcaaagaccttatgtttgcttttatcctcagggataacctattacttgccactctccgtcctgtctcaagagattcctgagagatttcatttatgggaatattaagcaggaggagataagaatgtctccaggatagtccattagcttaatttagccattcaacaatgtatacatctttcaaaacatcatattgtacaccataaatatatacaatgttgtcaatttcaaaacttctttttaattaacttttttttccttatccctgaaactgtttttttttttttaagttaagttccgggatacatgtgcaggacgtgctggttgcataggtaaacgtgtgccacggtggtttgctgcacctatcaacccatcacctaggtgttaagccccacatgcattagctatttatcctgatgttctccctccccccacacccccacccccactgccaccgacaggcccctatgtatattgtccccttccctgtaactacgtgttctctctgttcagctcccactcacgagtgagaacaagtggtgtttggtttcctgttcctgggttagtttgctgaggataatggcttccagctccatccatgtccctgcaaaggacatgatctcgtttaattaactttttttcaaaagagtgtttccagggttacagttaacagtaaaattggaggcagggcccagtcttttcactcctttccaatattatgtcttttatccaatcatatgcctcttattagaaaatcacaatacaacaaaggtcaaatcctcctaggaaatgctatcaacacactttggggacagtaatgataaaagcttcatggacccacatttaacaacaaagcttatgtgataactgtagcaaaagaatgggagtaagactgaacacttctgaatcctcttgttcttgaataccttcaagccaggtcctctctgtaagtttgtatttcacctccagtgattctgagtaggcacaactcttctccccatcacacagacatcaaactccaggcacctagagaagtagcttgccccaaattgcccgatgaggaagtgggtgtgtgtgagaatccagggtttgggctagtctgggctcttcccccaagtttttcttaaggagcagtccctcggcatgagactcatctgggggatatggtaaacttcatattcctgggcccccaagtcctacaggatgtcagggtccagaggcatgagaccgagggccaggcttctggcctctgtaacgtgctccccgggtagggttaccagtggcaatacaggatgcttaggtaaatttgcatttaagatcaacaatgaataaacaaaaaatacaaatgggatatagtcatactaaaaaaaaggcatcattgatctgaaatgcaaatttacctcaactttctttttattagctgaatcaggcaaccctatccccagaggactagcctacccccagaagtttgaaaatctgttttctccctctccatgtgaacaaacgagcattccatcattgttcattttctattctccctcaccccttctgcctccccactctcaccctggagcagagactttaatgtcatctaccaggatttctcacacagggaatcccgggcaaggccaggaagatggttggatggggtcactcagcccaacccacctccaagagtcgatgagataccataagcaaataaattcacgagaggttggctgaatccatcctagtgttgcgttagcctggctctccccattttattcaagcacaaattactaacaagactcttttccagtcttagctttgccaaaactatttttagagcatcatttaggcttaggtgatataaaaattctgctagttttacaaaccagcagccttccaaggcaaaaagcaattcatgccaggaaagtagcaaaggattattcattttctgtccataggctggtaaggagttttgtatctaataggctgccttcaacacaataattgagaagaggaactcataagcaaagctaaagaactcatccttagagaatacaagttcaaactgagaaaggttttacttttaagacaaaacaaatagcattaacacacatccaaatgccagtgcaggagttcactgggtttataaaagagaaaactaaactcaagtgtcaaataaaaactggagccgtcaagaatgactgcttgtggcaacacaggtgtaacatgtgcttgtctaaagtcgttctgtgtttgtggatatgtggaaatgcatgacgagggaaacgatgcaaggcaaaatggcaggtgctcaaagctttaagatccttttcttcacgcttgtgtgctcttgttttgcttttgagaattagggtaattcgcaggtcattttacaaagaactgtaatatcaaagaacacttccaaacggctaaaataggctcaaggtcactattaaagtgataaagggaggtccgtgggggaaaagtttgtgttctcaaaagccagatttcacaccatggcaggcactaaatctagttacatgtgcttgcagtagaaaaagaagacactgatcttaatagaggctggtctttttcatgatgcgcaggaactcttgctcactgacctctccatctccatctcgatcagcttcatcaatcatttcctatatgacagtaaagattcaggttaatttataaactaatgccaaaaggtgactaagtaatagacttttttttttttagagatggggtctctatgctgcccacactggtctcaaattcctggccacaagagatcctcctgcctcagcctcccaaagtactgggattatatgcatgatccactgtgcctggcaagcaatagacttttaatctatgtgaatagataatttgtatctatgtgaatagatcattgtagtccacccaatgccagtatgctactcctgataatagcttggtttctgaaaagttatttgaaaaccaactcatactttgtcaaacatatcacctgggagggaccttgaagattgccttgactagagggattcctggaacctaaaatagtaagcaaaattgtgcatatgtgcatttttctggaagcagggttcataggtttgtctgactattaaaggagaattaagttgtctgcagagggacaaagtacactggcttttcttcaaagaggtgctcacactagggaaaatgtaatggaaaagtcacagagggctcaaaggtgggaattttaagttccagtgtgatgcattacaaacctgcagctcctcatcagtcaggttctcacccaactccttggccacgcgtttcagatttttgaacgaaatcttcccagtttcatcatcatcaaagagcttgaaagctttcaggatttcttctttagtatctttctcagacttaacaagtagaacataaaacacatgagtagggggacaccacggttggttactactgtcctgtagccctgccactgcctggtcaggtcaccctttcctttttaacaatgtaactcgagtctagacttgcggcaagtgtcaggaagcccattttggcctcaaagaaacaccaggcaagccaggcactccatccaaggtgacgtttgctacctatcgctatatctctccctatcccatatctatttcctaactgatttggaattctgtgggaagaggtatctgcttggaagtcttgagaaagaagcacaagggcttgttttgggagcccaaagtaacatgatgggagggcaggcctcctgatgcagttgctacctggactgctctgtggtcacatgactgttttaacaggaagacgccatggacctctgcagatgactggggctccataccatgataattgtcttagctacttaccattttctgggtcatcacagttaaaaagtcaccaaagttcatttttcctgtcccttccttatcaatttcacttatcattttcttaatttcttctttcttgggttcaaagcccagggccctcattgccacctataaagaaaacaggatcgtctcaataagcacatctaaagtagcaggagcaaaaataacagtgttgagagcattaagccagcatctgatgtggtcatgttaatatgattggggaacactatgacattgatctaattgatatttgcaatcaattttattgaataatactcaaagtaagtaaagacaggaaaacagcacagtacaacctcccctgttacttactgcagggagaagagggcaaaaggggtagagaggtgatagggagatgacaaggaagaggcagaggaaaggaagggcagtacggcaggaatgcacagagcttgccttcagttctttaacatctatggtgccagttccatccgcatcgaaaagatcaaaagcttcccggatctcctgcttttgctcttcagtaagctcaggcttagggctcattctttttcgctgagaacttgatgccatgtttgccttcttaaagttggaggcctttatatgttatgcaatacacaagcacaataatatatcatacagtccatatttacataacatagttacagacacccatatgtatttttaaagtcatttatataaccaattccaaagctttgcttaaaaagaaagataacagggtttactggcaagaacaatgaatctttccatgaacttctacccctcccttttctttactgttgtttctagaagcagggagatcacttgttcagtaaggacacctcttactgaaaatcatcccaaaagagagccagtcaagaagatgactgtgaataactagagataatcagctcttcccgaacgtggggatcctggttctgaaaacagtcttacgatgcccactcccagtactccccttcccagtaagtactccgacttcccaattacttctagatttggccaaatattagtaagttgttaagatgtatattgtgtcagtaccgagtaataaaactcaatccatctggcaccttcgtgccttctccaagaagctaaagcatcccctgaatgcccctgtatttaaattgtaaaaaacattgtaacagaacacgatacaccttttcccagctgtgtgtggaaattttggcagaatgaggaggccagggggccaaggtctgagagagtcaggggcctgtgagggattcgagtcttttttgcccagggaggttcaccgaggggatcagggaatgcaaggggagcccgaggggcgggtgtgggcctgttgtgggtgaagaggaggcagcagcgaagcgcaggcccagtaggttggttagcgtctgtaccctactctcccgggaaagagctcaaaggaaagactggtgcgctaaagccgagaaaggcgcaggagaggcggcgtggccgagctggggcctgggaagggctcagccgctgggcgtggggcgcgacagagcggcagcactcaccatagccaaaggagtccgctgccggttgttaggcaaccgacgtgtacactgactcggcgccgttcccaccgccccgcgcgcgcagccccgctccccattggccgtccgctcgtcgccgcctctccctattggtgcagggccgaagagggtgggactaacctggcaaagccccggcccagcgcggggaggggcacgctggcgacagagccccgtctttattgggcaagatcacgccgtgagcgccaattggctgagtcgtcgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacgggtaagagtcgtggccttgccattggaggtcaccctgtgtcagcgactgggcagtgcgggagggtggggagctacggggtcgcccgggtcgggtgctttctgggttgacctaaggctgagtttagggaccgagtgcatcagagcagccagaaacgattaccttgcgtgttggagcagggactgtactcacggggcaactgagacccggagaggggaaggggtgtgctgagtgttgtcgcagaggtcggacggctgggacctaggaactgaatccagccgaggctcgctctttgagggtggcccttcgagagcacccctagactgacccagatgtataggccccagaccaggttccaagagaggatcactttagatcttacctggctaaaagcagcccaggacggtgaactggggcctttgggaacggactttgaaaggagtgagggggatgtgagcgagcatgaggggcggggagaggtcatcaaaatatactctttttgacacccacacaatgcagataaggaggagcattccaggccgagacgccctcatcagcagagtcacaggagttttggaagtgagaggtatgcttggagaattaaaagggagcgtgtgcaagggctgtggactgacatagacctgcagaagtggagctggaggtccagtttgccctctttagctatccccgtggcttttagccttcacctgtttttcctccaggcataggggcagtaatctagggagacagagggcagagagtaagtttctcagacagagaaaggcccgaggcttattagaaccttttaaatggagctgctgccctttgccctcttctctcttcagcagtgaacagattcctgacttttgggtcatcatcatccccccaagtagtacgagccagagttctcactgtgatctccaaagcttggcacgacgtgtccccttccatcgctccacaactcttctctcgtctggctcactccagccccagaacactggctttgtggttgaacctcatgtgccagccacactcctgcctctcatctttgtctcagttgtcctctccgcctgcctcctcttaggcaccctatttaagtattgcagcccccagtacaaacaagccactcaccttgctctacttttttttccaacagttcttatccccttctgacctactgtatattttgcttgtttgttttgctctttgttgtccctccactagaaggcaggctgtctgagggcaggcatctttgttgtattcactactggtactccaggacctagaacagagaggggcacatattagacaactgatgagtagctcccctgtttcccagctctcacctagctagtcctccctgctctaccaggttaatcttcgtagtgaacggccctggtcagggcatctccctgctcttaaaccttcagagcctgaaccgtaaagggctccttagcctggcctgtgatccctctgcccagttttgcccctggtaacccttctagcttaatgtccctccataccttgcttcccagtccgtcaacctgcagatcggaagcctgacagagtacaagggaaaaacacaagttctgcgcaggctgtgtgcaggctgtgtgaccttgggcaagtcgcttaacctctctgagcctgtttctcatttgttgagtgagaccagtactgtctacctgatgggatacttttgcatctcaatgggatgaactacttatatgtaaagtggcctgatgttgagcaggtcttcaggcagtattacagttgacccctgaacaacatgggtttgaaccttgtgagtccatttacaggcagatttttttctcatctctcccaccgctgagcagcaggatcagctcctcctcatcttccttctcagcatactcatcaggaagaccgtgaggatggagaccatgatgatccactttcactcagtgaatagtaaatatattttctcttccttatgatttcatagtaacattttcttttctctagcttaatttattgctgggacacagtatgtaatacatgtaatgtacaaaatatttgttcatcaactgtttacattattggtaaggcttccagccaacagtaagctatattagtgaagttttaggtgagtcaaaagttatatgtggatttttgacttcggggctccgtgcccctaacccccacattgttcaagagtcaaatgtagttcttgtctctgatttgctcttgtcattcccccccgcccaccatgcctggagccttagacttgtccaaaatctcttccctgcactgcagccaaggtgatctttccagtcgcaacactcactcctgcttccaacttctaggggctccaccatctttccccccttgtaactccctagcttggcacacagcccccacatgttctcaactttgctcccgatcttgcttcacacttgctgtgacacagcttgtcactgttataagaacatgctggctctgtgccatcactttgtccttcccaccctggccatggaatgtctttcaggacaccatgcgctctgttttactcactcttctggggccttttgaagtcagcttagggatctcctagttggggcaggcttccctgagccagcagcctgcattggtgctctgggcttgccctcatcagagtggaaacgcacttctgtgactctttgcttgctcctgtctcccaccctagatggcgggctccttgaaggttggcagtgtgtctttgtcagcttctgcctggtagtggctggcatttgataacttgtgaatgaggaaatcaatgcatgaggtgacacctgggggttcttttacaagttacagctcccgctttaaccctgggggtttgtttgagcctcacagtagctctgaggtagggaagaaggacgctgttttacagataaggcctcatggccagcggcagcacgataattcactcaaacccatcttccattccaggctgtctgctgggcctccaggggctcgtggtgtcctacagggtgctgagtgtgaggatgagagcagaaacaggtgctgtggaagcgactcaccttccctggggagggggaggaagtttcacagagggggcagttcagctaggccttgaaggaagaggaggcactcaccgtggagaggagagagaaggtattccatgcagaggaacagcgtaagctaagctcacaggcatgctgctgggtttctgagaggtctaccacaaaataaaagctggcgactttttttgtcctaaaagtaaatagagaaacaaacaactggtggaaacatggacaccgcaggtccgtggaaggacaaggtcaagctgggttgccccagcataatcaaggctaaagtgacacctctaaagagaaatgacctccaagctattggcctcactaatcctaatctgggtattttctttcccatatcacatctttgaattctgaaagggaggctttattgttgttcctacagggctcctgctttgctgtattttctctaagaaatatgtccataatgaaggtgtgtgccgcctcaggtgaatccttctctttgcatctgatcatctggcccagtcctgcagaggaggccaagcatgaggcatgaggtgatgggaaataggggaatcctcttttataatccaaggcttaggcccccatttcaggattccaaagaaagttctaagaaacattacttggcattccttggatagccaaactctactgaggtgtttggggaagggcagtttgcctggcattgtctgcccatggactgaagggatgagctctcagtggccacattctagcttcctgcactggaccttgtgcaagggtggggctccgacaacctttcccctttacaaagatgtcacacttctttctagaaggacgggacgctctcatctctctccctagtttgagacagaatgttctctccttttccctccaggaaatgttccccagcaggaaggaggaggttgggctaactcgcttctctcttctcgcttcacatgaggcggcacacaccttcattatggatgtgtttcttagaaaaaatacagcaaagcaggagtcctctaggagcaaacgtaaggcctccctttcaagatgtgatatgggaaagaaaatactcagattaggattagtgaggccagtggctacaaggtcacatctctctttttttttttttaattattattatactttaagttctagggtacatgtgcacaacatgcaggtttgttacataggtatacatgtgccatcttggtttgctgcacccatcaactcgtcatttacattaggtatatctcctaatgctatccctcccccaggcccccaccccccaggccccagtgtgtgatgttccccgccctgtgtccaagtgttcttattgttcagttcctacctatgagtgagaacatgtggtgtttggttatctgtccttgtgatagtttgctgagaatgatagtttccagcttcatccatgcccctacaaaggacatgaactcatcatttttcatggctgcatagtattccatggtgtatatgtgccacattttcttaatccagtctatcagtgttggacatttgggttggttccaagcctttgctattgtgaatagtgccacaataaacatatgtgtgcatgagtctttatagtagcatgatttataatcctttgggtatatatacccagtaatgggattgctgggtcaaatggtatttctagttctagatccttgaggaatggccacactgtcttccacaatggttgaactaatttacactcccaccaacagtgtaaaagtgttcctatttctccacatcctctccagtatctgttgtttcctgactttttaaagatcgccattctaactagtgtgagatggtatctcattgtggttttgatttgcatttctctgatggccagtgatgatcagcattttttcgtgtgtctgttggctgcataaatgtcttcttatgagaagtgtctgttcatatcctttgcccactttttgatggggttgtttgtgtttttcttgtaaatttgtttaagttctttgtagattctggatattagccctttgtcagatgggtagattgcaaacattttctcccatcctgtaggttgcctgttcactatgatggtagtttcttttgatgtgcagaaactctttagtttaattacatcccatttgtttattttggcttttgttgccattgcttctggtgttttagtcatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttgtcaggtttgttaaagatcagatggttgtagatgtgtggtgttatttctgagcgctctgttttgttccattggtctatatctctgttttggtaccagtaccatgctgttttggttactgtagccttgtagtatagttcgaagtcaagtagtatgatgcctccagcttcgttctttttgcttaggattctcttggctatgtgggctcttttttggttccatatgaactttaaagtagttttttccaattctgtgaagaaagtcattggtagcttgatggtgatggcattgaatctataaattaccttggacagtatggccagtttcacaatattgatttttcctattcatgagcatggaatgttcttccatttgtttgtgtcctcttttatttcgttgagcaatggttcgtagttctccttgaagaggtccttcacgtcccttgtaagttggattcctaggtattttattatctttgaagcaattgtgaatgggagttcactcatgatttggctctctgtttgtctgctattggtgtttaggaatgcttgtgatttttgcacattgatttggtatcctgagactttgctgaagttgcttaaggagattttgggctgaaacgatagggttttctaaatatataatcatgtcatctgcaaacagggacaatttgacttcctcttttcctaattgaataccctttatttctttctcttgcctgattgccctggccagaacttccaacactatgttgaataggagtggtgagagaggggacccctctcttgtgccagttttcaaagggaatgcttccagtttttacccattcagtatgatattggctgtgggtttgtcataagtagctcttattattttgagatatgtcccatcaatacctaatttattgagagattttagcatgaaaggctgttgaattttgtcaaaggccttttctgcatctattgagataatcatgtggtttttgtctttggttctgtttatatgctggattacatttattgatttatgtatgttgaaccagccttgcatccctaggatgaagcccacttgatcgtggtggataagctttttgacatgctactggattcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgagtggaatagtttcagaaggaatagtaccagctcctctttgtacctctggtagaattcggctgtgaatccgtccggtcctggcctttttttggttggtaggctattaattattgcctcaatttcagagcctgttattggtctgttcagggattcaacttcttcctggtttagtcttgggaggatgtgtgtgtccaggaatttatccatttcttctagattttctagtttatttgcatagaagtgtttatagtattctctgatggtagtttgtatttctgtgggatcggtggtgatatctcctatatcattttttattgtgtctatttgattcttctctcttttcttctttattagtcttgctagcggtctatcaattttattgatcttttcaaaaaaccagctcctggattcactgattttttttgaagggttttttgtgtctctatctccttcagttctgctctgatcttagttatttcttaccttctgctagcttgtgaatgtgtttgctcttgtttctctagttcttttaattgtgatgttagggtgtcaattttagatctttcctgctttctcttgtgggcatttagtgctataaatttccctctacgcactgctttaaatgtgttccagagattctggtatgttgtgtctttgttctcattggtttcaaagaacatctttatttctgccttcatttcgatatttacccagtagtcattcaggagcaggtttttcagttttcatgtagttgtgcagtttttagtgagtttcttaatcctgagttctaatttgattgccctgtgtctgagagacggtttgttgtgctttctgttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaaccttctgtcttgttgatctgtctaatgttgacagtggggtgtgaaagtctcccattattattgagtgggagtctaagtctctttgtaggtctctaaggacttgctttatgaatctgggtgctcctgtattaggtgcatatatatttaggatagttagctcttcttgttgaatggatccctttaccattatgtaatggccttctttgtctcttttgatctttgttggtttaaagtctgttttatcaaagactaggattgcaacttctgcttttttttgctttccatttgcttggtagatctctcttcatccctttattttgagcctatgtacgtcactgcacgtgagatgggtctcctgaatacagcacactgatgggtcttgactctttatccaatttgtcagtctgtgtcttttaattggggcatttagcccatttacatttaaggttaatattgttatgtgtgaatttgatcctgtcattatgatgttaggtggttattttgcccgttaattgatgcagtttcttcctagcattgacagtctttacaatttgtcatgtttttgcagtggctggtaccagttgttcctttccatgtttagtgcttccttcaggagctcttataaggcaggcctggtggtgacaaaatctcccagcatttgtttgtctgtaaaggattttatttctccttcacttatgaagcttagtttggctggatatgaaattctaggttgaaaattcttttctttaagaatgttgaatattggctcccactctcttctggcttgtagggtttctgccgagggatctgctgttagtctgatgggcttccctttgtcggtaacccgacctttctctctggctgccctttacattttttccttcatttcaactttggtgaatctgacaattatgtgtcttggagttgctcttctcgaggagtatctttgtggcattctctgtatttcctaaatttgaatgttggcctgccttgctaggttggggaagttctcctggataatatcctgcagagtgttttccaacttggttccattctccctgtcactttcaggtactccagtcaaatgtagatttggtcttttcacatagtcccatgttatttggaggctttgttcatttctttttactctttttttctctaaccttgtcttctcactttatttcattaatttgatcttcaatcactgatatcctttcttccaattgattgatttggctattgaagcttgtgcgtatgtcatgaagttctcgtgccatggtttttcagctccgtcagggcatttaaggtcttctctacactgtttattctagttagtcattcatctaaccttttttcaaggtttttagcttccttgcgatgggttagaacatgttcctttagctcagagaagttttttattaccaaccttctgaagcctacttctgtcaacttgtcaaagtcattctccatccagctttgttctgttgctggcgaggagctgtgatcctttggaggagaagaggcacgctggtttttagaattttcaggctttctgctctggtttctccccatctttgtggttttatctacctttggtctttgatgttggtaacctacagatggggttttggtgtgatgtcctttctgttgatgttgatgctattcctttctgtttgttagttttccttctaacagtcaggtcactcagctgcaggtctgttggaatttgctggagctccactccaaaccctgtttccctgggtatcaccaatggaggctgcagaacagcaaatattgctgcctgatccttcctctgggagcttcgtgccagagggtcacccgcctgtataaggtgtctgtcggcccctactgggaggtgtctccagttaggctacatgagggtcagggacccacttgaggagcagtctgtcctttctcagagctcaaacgccatgctgggagaactactgctctcttaagagctgtcagacaaggacgtttaagtctgccaaagtttctgctgccttttgttcagctatgccatgcccacagaggtggagtctatagaggcagtaggccttgctgagctgtggtgggctctgcccagttcgagcttctcagccactttgtttacctattcaagcctcagcaatggcggacgcccctccccctccaggctgcagcctcacaggtggatctcagactgctgcactagcagtgagcaaggctccatggccatgggaccctccgagccaggcacaggagagaatctcctggtctgccagttgctaagaccgtgggaaaagtgtagtatttgagcgggagtgtcccgtttttccaggtacagtctgtcacggcttcccttggctaggaaagggaaatcccccaaccccttgcacttcctgggtaaggcaacgccgtgccctgctttggctcaccctccatgggctgcacccactgtccaaccagtcccaacgaggtgaaccaggtacctccattggaaatgcagaaatcacccatcttctgtgtcgatcacgctgggagctgcagaccggagctgttcctattcggccctcttggaatgaactgagttcacatctctttagaggtttcagtttagccttattttgctgtggcagctcagctcaactttgtccttccatgggcctgtggtgtggggcaaggtggttggatttcaccagtacaacatatctctgttttcctatattatttttagcttaagattttgtcccagtgtacatcgtgggtgcacatattggtttttaatggattcaaataactaacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcaccccatccgccttcagaactcttttcctcctgcagcactgagagtctgttcccatcagcagtcactccccactcacagagcatttgtccttttgtgtctagcttatttcactgaccataatgttctcgaggttcacgcatgttgttgcatgtctcagaacttcattcctttttatggctgaagaatatgcccgtgtgtggctagaccatattttgtttatctgttcatctgtcagtggacacattgctgctcctaccttttggctgtagtgattaatgctgctgtgaacatggatgtacaaatttttcttcaagtccctgcttttagtttttgggggtatatgcccagacatgaaattgctggatcctattgtaattctctgtttaatttttttgaggagctgccatactattttccacaacgtcgcaccattttacatgcccatgaacaatatatgagggttccaggttctccacatcctcactgacacttgctattttctcttttctggcttttgataatagccatcctaataatgggtgtaaggtgacacctcactgtggttttgatttgcattgccctgttgattagtgacgttgagcatcgttttttattttttgttttttgtttttttgagacagagtcttgttctgtcgcccaggctggagtgcaatggcggcaccatcttggctcactgcaacctctgcctcccgggttcaagtgattctcctgcctcagcctcccgagtagttgggattacacgcatgtgccaccacgcccagctaatttttgtatttttagtagagacggggtttcaccatgttggccagtctggtcttgaactcctgacttcaagtgtttcacctgcctcggcctcccaaagtactgagattacatgcgtgatccaccacgcccagcctgttgaacatcttttcatgtgctttttagccatctttaaagtagatcttctttggagaaatgtctattcagtcagagctattctcaatgtacattttaacccaagcgtatatcacatggtgaatttaggtgagtaggcaggggacgggggttgcctatgggatctgactcatttgcgcggctagctctgggtactccaacccatagagacagctaagctgtcaccaaaattcttatctgactcatagtatttacaaactttaaaataattggtatataatttgagacaaaggagattttgttttgacaagaggctggtttgcaaagaattgtgtgattattgtttcagcagtacagctccgttggggtgagacatgtttcttctttgacctcctacatcctcctctagcaaacgaggagaggaataggctctaaggcttcttgcttttgctagtcatacaaggggacttgtggaattggcagctctgctatttggatttcggcactacaaaggatactcgtatagtttgctgggtctgctgtaacagatgaccacaaactgggtgacttagaaaagcagaaatgtgtctctcacagttctggaggccacaagtccaaaatcaaggtgttgacaaggttgtgttccctctgaaggatccaggggagactcgttcttcattgtttccaccttctagtggctccaggtgttcctttgcttgtagccacatcactctaacctctgcctccatcttcacatggcctcctcctcttctccctgcctttcccctctgtatgtctcttataagaccacttgtcattggatttagggcctaccaggcctccaaggacctctattggcccattcttttcctacttttcatgcaaaacttaaggctacgggagcagttaaagttactttttggttcaagaagaactgaatgaagcatttggtgttagtcattatgctattcattgaatgaggccaaagaggaaatgattctttccacccaagtttgcttgcgagtcccagtctttctttacactcctgccccatgctgtcgctgtacacctactttacaaagcatgtccttggttgtttatttgttagccagcatctagttgttgcgacaaccccaggagttagcctttaggcaggacctgggagccgtttccaggacagataggacagcccctgcctgcccaagcttataccgcatggcagcagattagataggggagaactaaagtggtggagagagtccaaaggcagcccaagaggaggcataggcagggagactcctgcacaggaagctgtgttacaatgataataaaattagctgccttgaatggcgtgttgacaggtatttgacacaatcctcataatgaccttatgaggccatttactttacatatgaggaaaggcaagctcagttcttttaaataactcccccgagggctacctgctggtaaggaatagtagctgggatttgaacccaggcagccgactctgggttaatttattgccagctgcactgaggagtggcgtgatttgtgatttctcatgtgtagagggtgagcagaggcttacaagagcagaactccacaggggtgggcttgcttagcccggctggcctagttagcctgtcatgcggtcctgtcactgccccaggcacacgcccctcagatcccctgccagcagaggtcaataaggccttggtggggtcagaggccagatgtgagccatctccttgcccctgtagatgccatgtgccttttcatttgctcacatttccctgaatatctggggaatctggataagaagccagcagtgggcattcgtgattatatcatcactaaataacagtcacttgccccactgaagcccctgcaccttagatgggatatgcatgtatgcgatggagagcagtatgggagctctggtgggtgtgcccacacatggtagtctcatgacccccggccgatatgtgagtgcccactttgtgctgggcactatgcttcatgcccaagttgcaacagtgggcaaggctttggtgcaaggtgccaaaatccttgttctctagctgctttggtctagatacacattgagtcccagtgagttcaatatcagccacatgtctttcgaatgaacagttgacagggcccctaccaatgtgaaggggattctgggataaagggagggacagggcaggcacagagctacagattgacttcaatgcattctaaaaatggccatgacaagtcaagttttgacatacagtttcttaataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctgatggcccaagatgctaagttcctccacgcatcgtcagggcggctttaacttagccaagcaggagagctccgtctcctattgcactccactcatcccccgtcccagcatcccatgtcctgagctcctagacatgagcccttgtgcccatttcattgatgggaaaactgagctgcagcaaagggaagtgactggagcaattccgtacagttcgtgataggcccagagcaggactccctaggtgtgggcactgctacaccctaatgagcaccacaggggaaatccacgctgactgaagcgtgggagagccatggaaaaagctacaatgccaaagacgttttttatgttgtcactgataagtgagctgatttaactggcctcctgtgcgcctctaatctaacagtgtggtgagtcataggcccagtcgttggccccgttagccgggcatggtggcagacacctgtaatcccagctactcaggagcctagtgtcttgtcgaacagctgtcgctatggttcagctatttgtaaaaacatgaacggggggatggcatctgcccaaaacactaacaactaaagatgttttgacttaggcaacattaatgtctgtctctaactatgtctttaagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggtaaggagaaagttgacacgtacataccaacaggctgatactatttacctgtgggtgaaaaattgtatttgtacatgtattaatcaatgttgggtattttttatgtaagatatatagctttgtttaagatgtgtcagttacttattgctgtgtaacaatatcagaacacagtggtttaaaagaacaaccatttctttgcttatgactgtggtttcggctgagcccagctggggtgttcttggatggtctcccctgggctcttgcatgtagttgcaatcacatggggaccccttgaagcatatgctcccaggtggccttgctcacacctctggtagtaactggtggctgtcaactgggcaccttggtttgccttcatgtggcctccagtagaccaggctgggcttcctagtgaaatggcagcagtatttattaggcctaagatttagtgtcgcaagtctcagtctgagagaggacttgaagaaattgttgagcctggtcgttgtcaggcttcctggagattcttcacatcagtctgcaaaggtttgctttgattgattcttaatcagtgctgcacttcaaaaatgtggctgggcacggtgtctcacacctgtgaaatcccagcactttgggaggccgagacaggtggatcaccagaagtcaggagtttgagaccagccaggccaacatggtgaaaccccatctctactgaaaatacaaaaaattagccaggcatggtggcagacacctgtaatcccagctactcaggaggctgaggcaggagaatcacttgaacccaggaggtggaggttgcagtgagctgagatcacaccattgcactccagcctgggcgacagagcgagactctgtctcaaaacaaacaaacaaaacaaaacaaaacaaacaacgtaattacatcaagacaaaatgtgtttatatcaaatgttaataggttcaagatccctaagaggttatcatgggccgtgaaatcaccctgtatttggtgtagaactcagagtcaagcctcctctgggcctctgtggttgaagccacgtgccatctgcagttcctcatttatgtaaatttgggttttatggctacttggcagccagcaaacaaaggtggattccaatggttatagcaaactgccattttcagctagtttcaaatttttgtgtccttcgaaataacatttttttctctcattagtggactgattttataagaagtaaaagttctaaatttagactactaaaacaaaaagaacacatttgtcttaacttactatacgttctgcataagacctctctgagaaaagggtcccactgctgacaacaaagcaaaacaagaagggttggaaaaacccagcgccctagactattctgttatctcaagattctattgcaattagattagtttgcctaaatggttttttttctttttttttttttgagatggagtctggctctgtcgcccaggctggagtgcagtggcgtgatttcaggtcactgcaacctctgcctcccggattcaagcaattctccctcctcagcctcctgagtagctgggactacaggcgcctaccaccacacctggctaattttttgtatttttagtagagacgggatttcaccatgttggccaggctggtctcgaacccctgacctcaggtgatctacccaccttggcctcccaaaatgctgggattacaggcatgagccaccgtgcctggcccctattcttaacactgtctccaagaggttgatcttataactcacctcagtaacccattatggagtcttgctgtttccagtcttgagttttatacttgattgttagtacatgttcattcttgtccactgtggctgtgagaagtaaaaagtggtcatgaaaagtttcatgtgatctcctgtaatcacacagcattataggtatgattatcacacatttgacttccctggggtaaaggccagtttgattcccatcactacaagggtctccagggaacagccattggcctactcatcccaaacattattgatagaacatttcaatatcataaaataatccacgtcacattgtccaagagtagcgtactgattagtcacaattaaaatcgtgaaatgaaatcacactggactaacagcaaggttgttttttgaagagattagcaaccttttgaaacacctgtaactagagatgccaaatgaaataaacaaggcagtctgaaatctttcaggatgctttagtaacatatctagttctgactgtctttgggcttagccagacttttagtaaactgcagaaatccaggttgggaaacaggcagctcagagttattctaaatagctacagtttgcctgtacagctgacttgggaggaggggagaagaaagggattgctagaaaagggattgatgtgagttttgtatttaatttggctatgacttgaggaaatatacatctcagtccaggtgcaaatcatgtaacctggtatgattacatgtgtttaggaataatcagaataaagcctagaaaagaacaggttgggaagttagttttgggtggtagaagaatggtgaggctgattttgttagtagattgcacatggacagatgaaggtaaagtacagtgccagctccagctgggcctggtggaatccagtatgagtgctgtttcagatgggacaccccaactgggagggaggtggatctagagaggatgtctggccctggcatcccttgagtctcttgcatagctcaattgtgttgatgtttaaggaataagtagggagatttgtttgttttttaaatctagaacataatttctttaagatctttcatttccacaaacccaagttggatttactgtatatgagctaaggaaattggaggttgtcatcttaaggaggcccagatacagttttagaaagaccctagggaggagggatatcacaggtcctcctcacagacacccatagccagcttgtctggtgtgcagcagccacagtttggcatcaacatcctgaaatgagggtatttaagtgcctgcatgtgctactgtgtcctttcattatgcccagtcaccagagttggaattacccaaggaatcgtgtgtgttgtggaggctgagacataaacaccatggctctccccatttcttcaacttccttgtagttcggaggagggaaagcagagccctgggctcatccatcctcactgcagccccaccaggagatcccatcaaggcggtcttagatttctaggctgaggcaagaaggggttgggcgatgagcccagagccacacagcccagccctgttgtggccagagagggaaagggactgactttgtcctgcaagtatggagactgctttcttctttctgttgttttcagtgcaagctatcagctaccaaatggctgccgttttgttttgttttgttttgtccttagagaagcgcccagggatcagctatcgggaacaagaaggtatcactgttttttggggtattttttagattgtccagttttggtcataggtggtttgatttcctttcactgaatacaaagcatggatcttgtcatcaaacccaaccaaagtcaatctcagtgtcattcgctatctctcttccctccttactgatcccaggagagaaggttagggttgcactagtgatggaacaccaggatgatataaagcttccaacttggctcaagaagagttccaaacaaacaagtatatctgccattgcagtggctcatgatatgtaagtctggactctgtagcttccagtcctcactaccctggtcttccccaccgttcctctctttccacaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggtaatggaccatgcagccttgctgatttcccacgagcccacgaagggaaaccacgatacttcccttgctcagaagccagccaatttgtttgaaaaacaattgtttcattgtgaaaattttcaaagttataggaaagaacaccacattcttactgcttagaatgaataaccatcatctctgtcacagatactcagctgtgtcctggtagcacaaaagcagccatggtcagcacttaaatgaacaaatggctgtggctgtatgccagtgaaacttgacttcaaaagccgtccatgggctgtattgttccaactgcaaaacaagtgtgtgctgggccacagggtcttgattttttaattgagatataattcatgtaccacaaatttcacatttttaaagtgtgcaattcagtgattttcagtacatccacaaagctgtgcaactgtctcccatgatctaactccagaatatttgtattaccccaaaatgaaatcttgtagccatcccctctcttcccctcccagcccctggccgccactcatctacttcccatctatggattggcctcttctggacatttcatataaatggaatcatgtaatatttgtacctctgtgcctgacttttttcacttagcatgatgttttcaagcttcatccatgttgtacaggtatgaatatcttgaattttattagatggtgccaaatggctcagcaaagctgctatgtcaattttacctccatatccacaatgtggcacaagccccattgcttcacatctttgccaacactgggcataactagactttttggtgttgccattctgagaagtatgaagtggtgcttcactgatgttcagagtcacatgtcctccctgaccaagtaaccagccactctgccactgggtgatcggctttcaggcttcctcctgtgtgaaatgtttgtctgtgtcctttgcccctttgtctttggggttacctttgcttccttgttgatctagttgggatgccaatcctgtgcccgttgtacttattatggatggcttccctcagcctgtcactgggcccttattcttggctttggtgtcattcgctatatggtttgttgatgaaatattaaggccattgcttccgctgcaaagttacggttgttttctctcccgtgctgcccacacctccaggcctggagatggggtagacatctttcatgctcatcattgctgcctccgaaccgttctccctcatgctgctctaagcctctccagctttgaagaggataccctcagactgtacaaaccccgacaccgttccctccttgtggtggccacccacagccgcctgctccccttcccagtgactccacatcatttctcagtgatttcagctcctttctggcattattattggtgaattcagcgttcatgtagatgaccctaccaatgccctcgcctctctcatccttggcctcctctcacccaatgatgttgccctccactcccctgtcatcaccagtaagcacgtcctctccttcttctcagttgcaggcattctactctgagcactagctcctctctgtccagctcatgccctctagtgcctcagctgtcccgattccttaaccccacccagacatccagccatgcccaccatggctcagcctgttcgtgcctcactgcctttagttccctggtctgcttgttcgcttgcatagtcttcaccccttcccctttctcttctggttgtatgtatccataaagtttctccagagaaacaccagcagggggatgtgtggagaagggcaaggagagagatgggtgggtgagacggagaaagagaggttgagatttaattcacagaattggtttacatgattgtgggggctgactaggcaagtctgaaatttgtagggcagaccagaaactcaggcaggaattgatgctgtggtcccacgttagaatttcttcttacagaaacctcagtttcacttttaaggtctttgaactgagtatatactgcctgtccagagtagcaagggtaatctccttacttaaagtcagctggttgtagatgtcaaccacagctacaaaatacctctacagcaacacctacactgtttaatggagtcaccggggactagagcctggcccaggtggcaaataaatgtggccaccacagtgtacttcacattgtaacccccaccctggttaaatcttgccttgtgcatggccatggccctcaagcagacccttggtaccaccaagcaccatctccacaaacctgcccacatccacgtctctactcagcctcccctgctgttcccgaggacgcctcatccccaccaaagtgcccatcctggtgccagctggaagccacctcctcttccctacccagtcactgccaccagggaccttgaggcaaccatatctggtggttgaatctcagtcctcctctgacttggccctgtagcagcatctgatgctttctttgcttgccttctgagataccacctcactcatttctcctcctgcctcactgattgtctcctgatcactatcatttctaaactttgcagactccagaacttattctcttttcttctccaagtttagacagtgtcacagtgactccatcccatctcatggattaattactgtctagaagctgatgtgctccctgcttgttatctccaacccctagctctctcaggcacgtgtgtgtgtgtgtgtgtgtgtgtgagcgtatgtgtgtgtatgcctgctggacatccctgtttggatacctcatggacacttcaagcttgctacatccaaaattaagctcctggttccctgacgcaagcccctcccccaccacagcaaacctatttctgctaagtcttctctatctccataaatggcctactctgcttttccagttccatcaaccaaaaaccttagattcatccctgcccgattcctttctctctcatgcccttcatcccatccatcaggaaatcttgttggctccactcagaatagatccccaatccaacaacttctcaccccttccattgctgccaccctggtccaagccaccatcactgtctcacctagatgttagagggactcttaatggataaatcagatcacaccgccctctgtacagaagcctccagtggcgtccagtcccatgtcaagcaaacagaggcctctgtaatcacccatgaggccctgcacggcacgtccccactacctgtctggcccacttcctcccacacccgcctcatggctctgccccaggcacactggccaccaaccaagtttctgcctcaggacctttgcacttggtgtcctttctgtcaggaatgctcttcctgaaccacagaacttgctccctagcttcctgtaaatctccagccaccctgtgctaaggaacaggcccccgctggtctcccttactctgctctagtttctgcataacacctgccagtacggacgtcctctagatttacttgtttgtttgcttatttgtcctgattgaaacatgattgaccatgagcggatacagagcagaggaaatctctgaaatttgtcctctctaccatagaatgtaaactccacaaaagcaggaattttgtttttcgatcactgctttgtcccctcaaaggagacgagaatccttagcaagctttcacttctctccaaaaggctcccccgctgccatgctgttgttgctagtatgttatttcagctttccttgagtacagatttcaagggaaccctccagcatgccatgttgttctccagccacactcaactgctcagccgcaagcgtggagaaggggcgagttgcatttaaccagggttggagtttactagacaaatttaataaagggagaggggaacaaggcaaaggtggtgctggtggatcatgaaatctaagctaagtccaaggtcgatgtgatgtgggtgaaagacatggcaggagaggaccttttttattttattttattttattttatttttatttttatttttttagacatagtcttgctctgttgcccagactgtggcacaatctaagctcactgcagcctccgcctcccaggttcaagcgatgctcctgcctcagcctccctaatagctgggattataggtgcccaccgccacacccggctaatttttgtatttttagtagagatagggtttcaccatgttggccaggctggtcttgaactccttgtatcaggtgatccgcccgcctctgcctcccaaagtgctgggattacaggtgtgagccactgcgcccagccgagaaggacttttaaaatgtactttcacctgggtgtggtggtatgcacttgtagtcccccagctatttggaaggccaaggtgggaggatcacttgaggccaggagttcaagactaacctggactacataacaagaccccccccatttctttttttttaaaaatgtgtttttatagtcagtagagagagagagagagagaggagagagacagatatacatacatatagataaagtttatgtatatatagttatatagttttatacacacaatatgtattacataacacttttttttttttttttgagacggagtcttgcgctgtcgcccaggctgtagtgcagtggcgtgatcttgactcactgcaaactctacctcctgggttcaagcaattctcctgcctcagcctcccgagtagctgggattacaggcgcccaccaccacccatgactaatttttatattcttagtagagacagggtttcaccatgttggccaggctagtcttgaactcctgacctcaagtgatccacccgcctcggcctcccaaagtgctcggattacaggcatgagccaccgttgccaccgcgcccggcccatgacacttttaaagtcacctcggtcttgtgcatcttttgttgctgacaggaagtctactctcaagccggtcgttgttcgtttgtaggttgtctggctttccctcttatggtttttaggattttattttttatcatttatagtctatagagaatatatctgggcctgagttttagttttgattttaaatcttaacacctggtaggcctgtgcaatctgaagatgaatgtctttcctcatttctggaaaattcttcaaagattaactctaccccttttctctcttttctctctttctagaagccgtgctggacatatggtggtctttcattgtatcatctgtctcttatcctctctttcttgcattccttctctttctctttttgtactatttcataggagatttcctcctccctgcctctgctcatggccaatcgtgtttcacctatattcctcctcagattatgttgaagtcaatcctagacatcatatcattttatctgcaaatatttcagtatttgtctctaaaagataaggattatttttaaaaacattgacagtagttccttagtatctagccagcgttcagatatccctgaatgtcttataaatgtttttgtattattgtttttccaaataaggaaccaagcaagatcaagactatggatttggttgaaatatttagctctcttttaatttacgattcccttcatttttttaaacttcagtctatttattgaataactgatgtttagtagaaaccatgtttatggtgctgtagtatttcccacagtctgggttttgccgattacatccccattgcgtttaacatgcccttctgtcctccagtattttctgtatactggtagatctgggatggcgctgtccattaaggcagccattagccacgtgcaactattgggcacttaaaatgtggcaagtcagaattgagaagcactgtaagtgtgaagtccacaccagatttcaaaaactacctacagaaaaaaggaatgtaactgtctcattaaagttaatttcacctttttctttttactttttaatgtcattactataaactttaaagtcactgtgacttttattatgtttctactggactaaagacttgatcggactctggttcagtttttccctctggggtattattacttctgatactccaatagtaataagcatgcctagtgctcagatttgggtttctatataccatttcccataaaaagaactagggcttcttgggaaaattgctcattctaggaccctagggcaagggcagtacaaaatgagtctgggacattttcttagcacaaaatgaatggggacctgccaagaagatacaagagccaacttgaagggcttcccctggccaaatttgggacattttgagcattttgagcctctcaaaacataacagtagtggatgacaatgcattttgatttcaaaaagaatccgtgggctgggtgcagggctagcgcctgcaatgccagcactttgggaggccaagacaggtggatcacctgaggtcagaagttcgagaccagccttgccaacatggtgaaaccccatctctactaaaatacaaaaaaattagccgggcatggtggcatacgcctgtaatcccagctactcgggagaatcgcttgagcccgggaggcagaggttgcagtgagctgagatcatgccactgcactccagccttgccgacagagcgagacaatgtctcaaaaaaataaaataaaaaagaatccatgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggacacaccaccactgatgtggtattcttgccaaaaccattaagcctgaatctaatcttgaggaaacagactaatccaaactgaaggacagtctataaaataacccaaacccttgaaaaatggcagcattaaaataagacagaaaagacgggaatttgtctcagattaaaagagatggaagagacctgaggactaaatactacatgtcatgcgcaattggatcctggaccccaaaacaaaaggctataaaagacattactgggacaattgggggaatttgaatatagactaattattggataagaacatcatatctgttaagtttcttgagtgtgatcattgttttatggttatttaggagaatgcttttgttcttaggagatacctgtgaagcgtttagaggcagcatgatgtctgcaacttacttgactggtttcaaaaaaaaaatcatgtgattgtatgtagagagaggaaattgtggcaaaatattaattggcacataattgtcataattgtcttttggtgacaaacatgaatcatacttagatcatattacttaattaaggtttgacaaaatgatgacatgctattagtcttcatttagtagctccagtctttataccttaatgcagaataaatatttgattctttccctttatttacctgaatttttattcttgcttgtggtcaagctgtcccttctttgcccagtgggaacctcttcaggttggcccttgagtgcttttaacgtgaccccggtagtcttagctagctagcatcctcactctctggtacaaggtgtgcctggttcctcttgtgtgtttcctgtcccagatctgcaatcagccatttctctcaggagctcttgttccttttagcagtaaatcaaacagacctgttttaaaaatccctttcaggttgctgtattgtgtcaagtttcacaggaaggaatatgcctgtgtattggctatttactgtctttaatggtgtggaactttttcatgtgattcataatttctatctgagttcaccttcctggggagttttacctcctaggtgcctgctctgaaccacccaaaaggatgttgcctctgtgtggatcccacaggcttctcatgccccaaaccccttttgactggggactagttagtggggagaaggtgattaaagggacaacttggtttccatcccatgtacttcggtatcattgattcttttatgagaatgtatttccatattgattatagaattataagacaaggaacctacaagccacaggttggagggtgaaaacatgagaatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggcctgaggggatacgaattttctgcccatcatagcttgctgcatcgttaccaatcctggttcttagaattgtctttagaggactccagccactggctaaaacggctccctgtcagctcagtatcctgaccctcacagggatgcatgccacaggtactgcataaattaagagaaaaacttgaagcaagccagggggttcctctcccaacaacctgtcctggcactgttggctggtccgcagcatcctcagccggcccagcagggttggagctcttctgggcttgggccctggaaaagatcacttataactgacccctagcagttgacaagatgctttgccctgctgaagttttcacctaattagctcctcgttgggtgaccaggggctaaacgatgtctctttgctagtaaatgggagaggtggggtcaaagcagattctccaagtcccagactctgcactcagccatgctgatgtaactggagccctgggaagggccctgctgctctttgttaaatggaaggttgggggcatacaacaaagatttgtgccccaggtgtggcggctcacacatgtaatcccagcgctttgggaggccaaggcaggaagatcccttgagccaaggagttcaagaccagcctgagcaacatagcaataccccacctctacacgaatttttaaaagccaggtgtggtggtatgcacctgtagcctcaactgtttcgggacgctgaggcaggaggatcgcttgagcccaggattttcaggctgcagtgagctgtgatcccaacactacaccccagcctaggcaacagagcaagaccttgtctcttaaaaaaaaaattaaaaaaacaacaagatttgagaataaaacagcacctctccactcaccacagcatttaagaaacaacattactggcatgtgtaatgtgtgcccatcctcgatgccattgctctcttcttgtagccatggatagcaattctgaatttgggtttatttccatttgctccatgtgtaagcaatataaagtattggattgcatgttataagattttatacaatgatatcttattgaacagatcctcctgcaacttgcttttttccccagtgttatgtttttctttattcatcttggcatatgtaactctggtttatttactgaaggggcagagtggcttagtgggtaagagtgcagaaagtgattgctgtgttgtattgaaggaacattttccaacactgagatcaaaagattatttaatgtactttttttcctcaaaggttttaagtgttgctttccacatttcagtctttaatccaccaggaatttatgtttgcttatggtgtgagatagagatctaactttcttccatgtgtataaccagttcagtgccatttattgcataatccatcctttctgcatcgctgcacaccatctgcagcatgtcttaggtgtttgtgtcttacatgggcctgttcccaggctctcccctctgccccattgacctccctgtctgcccatgcagagaagctctgcctttttaggataagtctcagtgtaccgtagataaatcacgcccccaaccaatttcttcaaacttcacttggctattctgagccctttgttcttctacatatgtttggcttaaccagttccttgctaaagccagctgagactgctgttgtaattgtgttgaacttgtaggtaattttggagagaattgacatctttcccatattgagtgttcctgtccataaatatgggatatgtttctgtttatctcgctctttaatgtcatcaatagagttttatactttacttcgtaaagattttgcatatctcgttaaatttatttgtatgtacttcgttttttgttatttaataactttctattacattttcagttattgctaatatataagacgagttaatttttgtatattgatttttaattcagcaactttgccaaacgctaatattttctacatatttgcctgtgttttctgtgtagatttttctctcatctgtaagcgatggaagttcagtttcttttcaaatcattataaattcgtgtttatcttaccctaccactctggctagagcttctcatacaatgttgaataagaatgggaacgatatgattcatgctaatggtgttcagtgttggatgagcttctcttaaccagcaggctggacgctggggaccctcataagagaatatcttcctttagaatagcatttcttaagaggtcgtgtggtgtgtgtattcctatgtgtgttcacatggccaggtcactatcagaatagccagtgatctttttcagacatcttcctagaagtttgcgggctgcccttcacttacaacagagaatcgctgtcatagtgagataccatgaatgcaagtctattctatctctcaggtgtgatgggatagaaaaaatgtgttatcccttgttttgaaaccaagatctcttgattcttggttagaatgtaatacatagtgtgtctggaatccacatagctgcaaaagatggtgatctttggattattttaagaaggcatgaaaagcaaaggcattgcagcaaataatttcttcagtgcctcgaatgcgagggcaacaaagggatgcccctgattctctttcatacaggatcatgcactgtttgaattgtgataatttgtgacttttattttttctgaccttcctctgtcagaaactcattttaaccagcagtgccagtgtcatctttgagggcgtcgatatcaagaatggaactgaagaccttccctatgccatgaaacccattgactactacacagagactaagatcttacaggagagggtatgtaccttggaactggttgagtgagcagactgaagggtttagaatcctaagaaaaatgtttatgaacttatgaagtttgtattctgaggcctacgtacctgatttgagatgtaaaatttgtgggtgaaattaaatttaaaaatactgtgagaggccgggcacggtggctcacgcttataatcccagcactttgggaggccgaggtgggtggatcacctgaggtcaggagttcgagaccagcctggccaacatggcgaaaccccatctctactaaaaatacaaaaattagcccagcatggtggcaggcgcctgtaatcctagccacttgggaggctgaggtatgagaattgcttgaacctgggaggcggaggttgcagtgagccgagattgtgccattgcactccagcctgggggatagagagagagagacgctgtctcccaaaaaaaaaaaagttactatgagaacagctttatgtggccagacactgttctgagtgttttccaggagtattttccttgtttaaaggtcacaattatcgcatcatcaccagattatagatgaagactgtggtgcacagatgcacagagaggctcagaacctttctaaaactgtgcagctaggaggtggctgaccccaggcagtctgtctacagagcttacagcccaccctcaatgccatgggagcttcctcgcctgctatgggaatttacagcagttgcaagcgtgcagacaggaatcaggctggaggcaccttcctagtggcactctcaccccctcccttacttagaaaaacaaacaacggaaggatcttgctttattttaaggaaaaagtacttttccacttggcaaaacagcttcatcaaagggcacctgattttagtatggttggattcagccacggtcgctaccaagccttcaggctgctggggctgtggggcccctgacaactgctagctgcagatggggattgtcaccctgaggccatcctaagctgcaggccaggagtgctcctgagcctgggatagctcgtcttagctgggtagctgtgagtatacccctcccaggtgtgtgcagtgtatcacacccactgaggttttctcgcaaagccggtacatgctgtactggagctgaacactgacctggctacctgagagccagctgcctcctggctgtttgccgtattttttttttttttcttttttgagatggattctcactctgttgcccaggctggagtgcagtggcacgatctcggctcactgcaacctccacctcccaggttcaagcgattctcctgcctcagcctcctgagtagctgggattacaggcgcgtgccaccatgcccggctaatttttgtatttttagtagagacggggtttcaccgtgttggtcggatggtctcgaactcctgacctcatgatctgcccgccttggcctctcaaagtgctgggattacaggcgtgagccaccatgcccagcctgtctgctgttgcttcagctcagaaagtcctggcagaactggtccacagggagacacaagggccacccagaccaggggtggaggcttgaactttggcaagccacagtcctggctccagactatgctgtcttgctccttggagcactcatgtgctcgaacttggcccaaggagtactaaagcctccctgcgccttgcaggcagttcagtcaccatggagaccctgtgtattctcaacccaatatgcctgatactgattgccaccagagctgagcccatctaggctcaggagcttcaaatgatggccttggcccagaccatcagtgtctcgcttatatcaacttttgggttctcaactggaaataagcaaagcctgcagatgactccagcagtaactcaccggaagcctcctttcagccgaggttgacatccactgttggctttataaccttcctactgatcataaaccaaatgtgatggggagctaggactccttcacctctcttccctttagtagtagagatgagccttggtggaagccatttgagggtttatttagtcatttcctccatcgctgtggggaccagagtcctggcgggaagaggagggccagctctgggaatctgttgagaggcagcttttccattgttgagttgcttaagatcactggggccaaaacatagaccagcactttgctaccatagagtagaagaaacccgaggtgacatgacagcaggaaccgtacttaccaagcatacagacacgcactgaagcaactcacatgggccatctcatgtaattcgcatgcagccccgtcagggtaggtacctttatgatcaccacttttacccacgataaaacaaatcctttggaaagttttgttacttttgaggcgaaacccatttcactgtgctttagactcttgagttctagtttgtccatgaagtcacacagaagtcaccctttccttgcggtggcaacaggagcactggctctggaccaggcactgctctgaggactttacatgtctcggcctcctttgccccccagctgctggcctgtttctccccaggcatggtcttcagacccttcaccttctctgaccctcttctgggcccacttgggtttctcagagccctcccctcggaggtgatactcagaattgcctggaacagacccggcctggtggaaacgtgggcggcacatgcagttcaagtcactggaggctcacggctaacttgtttgccagaacctttggacgttttccacaaactgctgccgaggcatgtcttctggcagtgttggtggattttagcctttgaacgcaaaccagggccttctgatttgatcttaccagtttttgcccagctgtctgtcctgcattttcagattttggtgtgagggtgggtggggtagagaggtagcccagaattataccagccactgatgtaggttgtcagctcaaggcagaccactgctcagtggccacatgccagcagagtgtgtcatctgtctgtcccccacgagtggtgcttctcacccagcgaggcactctcttggcttgggcctaggaatttgcaatggacgtgccccttctcccactctcctccaggcagttctgggcgccaacgatcctgagaagaatttcttaaccacagccatccgccctcatggcattttcggcccaagggacccgcagttggtacccatcctcatcgaggcagccaggaacggcaagatgaagttcgtgattgggtgagtcagcccacagcggctcttccctagtccttcctggtccatgctcgcattcagagagcacttggcaggagccacatggcattgtagctcttttcttatgtgactgtcttggtccatgcaggctgctgtaacaaaatacctaagactgggtaacaaacaacagagagcttggaggctgggaagtccagatcaaggcgttcccagactgggtgtccattgaggccctgttcctcatgagtggcaccttttcaccatgtcctcacatggtggaaggggcaaacaggctcccttgggcctcttttatgaggacactaatcccattcccgagggcagagcccccatgacctaatcaccccctaaaggtccctcttcacagtaccattgcactggaggttaagtttcaacatatgaatgttgcggggatgcaaagattcaggcgatagcagtgaccttgtccgctgtcctctgtattcatttcttgtagttgccataacaacctgccacaaagtaagtgcttaaaacaacaaatggattctgtcacattttgggaggccagaagtcctcagttaagatgttggcagggctagtgtcttctggaggttcgcagggagcgtctgttccaggcctctgccctagcttctgctggcttccagccatccttagcattctgtgcttggagaggcatcactcctgcctctgcgtccctttcacatggctgtgttccttgctttctgtgtccaaatttccctcttataaggacatcattccctggatttaaagcccaccctaccccagtatgagctcagcttaactaattgcatctgccgagcccctatttccaaataaggtcacattcacaaggcccaagtggacagaagctttgggaggatactgttcaatccagtgtaccctctcaggtaggctgggaaggtatttgtgaccctgtttggaaattgaagaaaccgtgactcagagggaaagcaatgggccccgggtcaaaggccagggcttgactgtccttgcatctgggaaggcaggcgggggcattacttttctcctcgggttaagtgcaggtggaggggcctccacaggggacaacagtgtgcctctctcccaaataggctttctcttccttcatttcctccttttctcctctctctcttccttcctttttccctctgccttgccttcctgtttctcactcagcctcactgctaccctgacttgtcaccttgaaggattacagggagactggtcaataaacggaggaccagagcaaggcgttggccccgtgtctcctgggaaggggctgaaaagctgctacccaaatcgggacaggagagacagcaccagtgttggccatgctggaatgggtgggcaggtcccccagctttcagattccactaaccctgaagacccaggagtcccggcccagtgtacatctttaaccagtacaggcatccatgagtgcctgggccggccttgccaagtgaggtggcagccattctgtaggtcacagtctctcaaatgccaagacttgggagtggccctggccttcgtgcaggggctcccagcacgtattccatcatcccttgtgcacctgcagaaatgggaagaacttggtggacttcacctttgtggagaacgtggtccatggacacatcctggcggcagagcagctctcccgagactcgacactgggtgggaaggtaaggcctgctgcaccggtccctgcacaggtgcctttctgcgggtttcttctccttgccattggatttgctggcaagttgctcctgtgatcctgtatcatggaggatctgccttaggaccccctgtgccaagatcaagcccctctgatagagcatgtggtgtcactgcagcgtcacatcacttgggcagccaaatttggagagctgacgagctgggattgaacagacattcaggtcacggtcatctatggtcccctgacctggctgcccacctgttggcatggctccttgtggcaggagcccacgtagattgggcagggtgcttgctcctcaccctttctcccactcattcctcaggtctctccctcccttgctgtttggtcctcttttattctcctgaacctctgccgtttccccactgataaccttcaaataagttgggaatagggtgggtgtggcattttttttttctttttttttttttgagacagtctcactctgtcaccctggctggagtgcagtggcgtgatctcggttcactgcaacctccgtctcactggttcaagcgattctcatgcctgagcctcccgagtagctgggactacaggcacatgccaccacgctcagctaattttttgtacttttagtagagacggggtttcaccatgttggccaggctggtctcctgacctcaggtgatctgcccgcctctgcgtcccaaagtgctggggtgacaggcgtgagccaccgcgcctggcccgggtgtggcttttgatttaaaacaagcagaacaccgtcaagaaatgtaatatgaggaattcattgcatccaaagatatgtagatgagttttatgatgattaacaattatcaaattaacaaatgtgcctttccaagtgcaatctatgcttcatttaaaatcctggcccatagatgaaactttcattgtctgccctttctatgccttagcagttgtgcaattgagggcaggccacgtggaaagctgcagcaattaggcagtgagaatgcgatctgcacgggcttaatagatgcttcaactttgggcaggtgggggtggtgtttctaacttcttgttcttgttctcccgccaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggtacgttgccgtgcctgcctgcattgttttttgttgtggtcgttgtagagacagagtctgagtgtgtctgttgcccagctgagagtgcactggctaatcacaggcccaatcatagagcactgcagccttgaactcttgggctcaagcagtcctcccatctcagcctcctgagagcaaatgtgcgccgccacagcaggcttgcactgttttcacaaaacatttctcttatcaacagagttctgttgttttgagaggcaaggcagtgatccagcccagtggcaccctgtttcatctgttcagctcctctcctaatgtgggacactgggctgggcgacagtaagccagggagcaggaggggctccttccctgcagctcaccctcagaacccttcaggccagtttccaaagggcatagcgtagaggataattcctcggaatgaggagagactgtgctgccctctgctgatggggcagggggatataaacataaataagacagcctttgcccctaaggcacttagaatcatggacttaagatatgttcgcaagcccctgtaatgccaggcaggacatgatacacacacttaagacgcagtggtaaatgttcagcttctgtcgaggaggtgatgccttgagtcggaccttgaagaatggataagcagtgagacttcactgtcgaagttggcatttcaggctaaagatgtcagagggtcacagtcaatggcatgtcatagtttaattagcagcacgttgtgtttcttaggggtccatgagataacggtgtcttagattcagtgaaggacagacgtgccagcctggtttggctgatggtgcaaagctgaaggggatgtacttttatctcccaggcagtggtggccaagaatcaaggaaaccatcgtggctcttacgtggagccttcagacaagaagcaacaaaggcccacgcgatgatggagttgggcgggggcggtagggttgggggtagaaatgaagccttacaagaaatggcctggagggggtccgcgctcagcacctgatttcctgtggggagtgagagggagggaggaggccactcaggctggaatgaagccgcagagcagctctaagctggtgggaggatggtgtcgggcccggagtgggtgaggccagcagaccttgctgatgagcaccaaggaccaaactgccctcagcttcgacctaaccactcgctcagaaaaatactagctgccatctagaccaaagatgtccctcatggaacgtcttctctgccctctcttcactcattagaccacagataatcgttgggccctgccctgcgcttcagtggtgaataaaacacgcagcccacagaccaatagattattcaaaactgctgaagtttccaaaaaagaaaagtgcagggtgctatgagagggacatagggctgcaagcaagcctggcccaggtggcgatcacggcagaacagttgcagaaacagtgcctgctcagatccgaaaggtgaggctgtgcacagagaccctgagccccccgctggccaagctgacgacctcccagccgctccttgtatttccctgcattcctgacccacacctatctcgacccacccgtttggagaaagtctaaccaccaggaaaccataacctcagtacccgctgagagcttgttagaaaccatcaggccccaccccggagctactgaaccgagaccctgggcttgggccagcactctcttcacaagccctgtggatggtttctgaccagtgaagaagccttcctgcagatcactgagtccagctagaacctccccttggctgctgcaagactgaacttgccctactcacaggcccagggcctgggggccacccccacccatttctttcctgacagctgatggcatcctagagtgcggacccaggcctatgtctgtccctcgtgtcacatcccatctggagaatcggggccaagggaaggcagttctctcccagattggggacagctagaagccctattgccaagtgctgcgtgtcctttgggatgatcgcattcaatccctcttccttcccttccctatcgacactgacctagttcagcacctgaccccatctgcacctaggtcaggtgtcctgggacagccgacctgatctgtctgcttactttcgcccctcctcccatccagctgctatgtgtacacctagggtatccagtctctctgctaaaaacactaaagcagggtccgattttctcccagcccacatttccagctccttccactggtcttcacacctgctgtgttgtagccaaatggaaccacggtttcctgttcacgccctgtcatgcatcccctgctcaggctgtcatgactgcatgcgatgtcctctccccactgtgtcccagctccagaatggcccgttcccttcccctaaaaagccatgcctaatcctcccagttggaaaccacctcttttctctggattcccagcctggggcccctgacctgtacctcattttgtgtttcctatttgtgctttttcctgcccccaccaggccaggagttcttaaggacagaggcaatcagtgtccccacagcatagtgggtgctcaggaaacctccctgtcttggaatcctggagtcacagtagcaacaaaagaaagtggtcccaggaatggggaaaggcacagcccatgagactgggttgaagcagagagaggttcccaacctgccattcagatggggcttgaggagtctgtgaactccctaaattcgatgcagcctctgggggtgtgggtgtgtgtgtgtgtgggggtgtgtgtgtgtgtttgtgggtgtgtttgtgtgtgtgggtgtgtgtgtgggggtgtgtgggtgtttgtgggtgtgtgtgtgtgggtgggtgtgtgtgggtgtgtgggtgtgtttgtgggtgtgtttgtgggtgtgcgggtgtgtgtgtgggtgggtgtgggtgtgtgtgtttgtgggtgtgtgtgtgggtgtgtgggtgtgtgtgtgggtgtgtgtgtttgtgggtgtgtgggtgtgtttgtgggtgtgtgtgggtgtgtgtgtgttggcatgaaagggcacatggctttcaccagcttctcaaagaggactgtggcctaataaaaactagtgagtggagggggccagcagctgtcgggggaggggccaggagagacatgccaagggcagagtggggctcccaggcctcatcgtcacccctgtgtgtgtgtgtggctggctgttccatcatggggtccatggcttcaaaacagggaagcactggaatccacgaggaggagggcttgccagacaggatggcaatggttgaggcctctggccccagccctctgggctctggtgcccattgcccctggaagattcttagctttctggatgagacagcccttgctagtagaaagctctaccttctgctgaactgaaacaccattggatgtgacttcccttgtcctccctcatttcctccctcaccaaaccccagcaagtgcagcttacacaggcgctattccctccggtatcccgcagctcatcagcagcactgtcctctgctcagctcacctgcctcagggcacctggtcctgcagggccagccactcttcttcaaactccatctccaacatcatttcttctttgcagctgtcccccacaggtctctctggcttcatacaatggctggcctacatctccatcaaagcacttcctccatcacagggcaaccatccacttagctgcccagatagagctctatgaactgctttgctcctcaagggcttttgattcgttacctgttccagggaagtaagcatgcccagttcatgtgccaagactccaagggcatttacaggagaaagccagcaactcattggcaatctgggggagccccagagaaaagaggccatggccaagggcactcaagggcagtcagcagagccagggctggaccactagctcctgatcccccaggccagcgcaccccaggtcacccattcagatccaggcagcctaatgccacataggtgcccatgtgggaaggaggcagtcaggatatgggctccaccctgaggttctcttaacatgaagggctgaaaaagcacaaatggatcattaggaactgtgagaaagaagatatgttggcagacactagaaccttccattccagtctgtatctcttgtcaccagcactgcctagtcattgatcgtggaaggctccaaaagatggtggacccaaagtcgagactctttgccagctctgcctcttaccggctccaggaggtctgttcatattaactcattcggcccagagaatttcccaaagaactttctagagtgactggggtaggggagaaaaggagggaagaggatggaggcctctcagcttcttttgtcctgtatcacagcctggctcccagcaacacttttgggatgcctcttgtagcaggtactgggagacatgcacaccactggctttgttctccatggtgggcagggggaacatcaattcaaaacattttaactgggcacctgccatttccctcaaagagctcacagtcccatagaagaaatgaaatgcagaaattaataacccaagcactccttcctttaagagcagaggtcagcaaactatgaactcaggctccaatctcgcttgccacctgcttttgtaaatacagtttcgttgtcacacaaccacatccatttatttacataatgtctaagactgccttttcactacaatagcagagttgagtagttatgacagaggccatctagcctacaaagccagtcaaaatattgactatcttgcccttcatagaaaaggttttgtgatggaagaatgaggtcagagaaaaaaagaagaaaaggaaaggtttgtcaacctctgcttaagagggactgagaggccacgagcacacgatgcttagcatcactaatcattaaggacacgcaactcagtaccacgatgcgacatcgcctcatcccattaggatggctactatcaaaacaaaaaaataggccaggcacaatggctcacgcctataatcccagcactttgggaggctgaggcgggcagatcacttgagatcagaagttcaagaccagcctggccaacaggatgaaaccctgtctctactaaaaatacaaaaaattagccaggtgtggtgacaggcgcttgtaatctcagctactcgggaggctgaggcaggagaattgcttgaacctgggaggcggaggttgcagtcagccaagatcgcaccactgcattccagcctgggtgatagagcttggacttgataactccctggagggtgacatggtgacatttgtgtttggatggtggggagagtgcagggagagggaccagaggtggggcgccagtggggaactacctctagtccaggggagagacggtaagagtgtgtctgtcctgaggaacaggcaacggggctatggtgcagacgtaatgaagagatgattctgtgcaagaatggaccatccatgatgattgattggatgtggggctaagggaggggaagggataaagagaactaggaggctgaagcttagaagaattggtggccagccatgccttctgctgagctagggacccaggagaggatgagatataggtagcagcaaggaagaagctgaattccattctggccataatgagttgaatgaaccttgcagtttccaggtagaaaagtctagaaggcaagagatagttatttcggacatcttggcttattgctgctaccgaaagccacaggaaaagcaggaggatgaaaaaaatgggaccctgagaattaagaagtgaacgaaatacccaggtgtcaaggaaagctagggaggagggatcaagcttgagaggatggtcagcagcgtgggtggtgctgggaagttaaagaggctgaagactgagcaaggaaatgtccctgaaatctaacactgaacacccactttataactggccttgtgctgggggtaagggccaccgtggtagacagtctatccaagagcctttccagagctcctgatctagctaagggaaagaaccacagttgatgccagctgagctaagcggccccagggaagctgcagcacagcctatttggcagtacacttgtgcccagcgtggattttcataccctgctcatggacttgtgtcctttcttcatcctcccttccatattcttccttgatggcgctcttctcaaccatagattttcttagaccttttgggggcccttccagcttctgacccagacagtgctagccaggccgtgggcactacaggtttgttgagtggttttgatgggagcggattagaggaaaaaccaaagatgaatgctgagcaagatgataggagcagggttgtgggaaggagagtgcctcctcagccagccagtgccttcccaggtggtcaagcactttctccttggatcctcaacaagcctgttgagtccagcaaggtctcccaatatccccattccccattttgtatagggaagcccaaagtttcagacagggaaaggggcattctgaagatgcacagcaagttagggacagcatccttttcctcaatggccttctactctcttggaataatgttgagtggcctgaactccttgcctctgtactggctgggaacactggatgtactcctttcctatgactgctgtatcagattaccaccagttgagtggcttaaaacaatgcaaatgtattatcttatagttgtgggggccagaaccccaaaatcagcttcactgggctaaagtccaggagttggaagctctgaggcttctggaggctccgagggaggagttccattttctttcctcttttgagcttctggtggccgcttgttttccttagcttgtggccccttcttccatctttgaagcacattactccaatctctgcttctatggtcacatttcctgctcttcttctgtagtaaaatctccctctgactttctcttatgaggacacttgtgattacacttagggcccacccagataacccaggataatctccacatttaaagatctttaacttaattgcatttgcaaagtcccttttgccatataaggtaagaagagtaacaggtctcaggggttagaatgtggacatgaagctggctaagagaggcaagcccttgggtaaagcgtcacctcacaaaagaccctgcttggcttcagtaggctgaggaccttgaggaaactctgctagatcactacagccctgtctgccagaactatccagatcgttcactgggctggtttggcaccagctagtgattgtgaaaactgaacagaagtcaccaataggatggtgccaacttagtgctagaaaatgtgggaggatcggcagggcaggttcacaaaggcccgagaatccagcggcccaggtgagcaagtgcctgtcccagcactgcctccaggctcgggactggggcttccaatcctgggtctggacttcaggtcctgcaggggagggactcagacttacacatcctctttgtaccttgtttgctgctgggattagaatttaggggagtgaagttcagggacgaatctaaggcctcccagccaaaggccatctagccacagcccaaacaaaggggcttccaacatggtcctaggtggcactgagaccaagcctgcagagactgggccctgtgagagaggcaaggcaaggccccagggcactgcaggctgttcaggtgagggcacctcatgccactgtggaaccaggagctcccaaggtccctgttctgtcagcatgagtgtctgattgctcccttcttcaaagccggctctggctcggaacgctgggtgctgagacactgcctttggtgagcatgggctgcttaggagctttagagggactcctgctgaactggggggcctctctctgcaatgccttctgccctgtctgcctgcctgactcccacatgtatctctatgggctagtagcctggtcgagtgaggctccctctgtgcctgtccagtttggcaccagctaatgattgtgtccaggggctctggacctgcctctttctagaccaaggagtcctcaaaggcagggtctgctgggagcctccctgtgacccctgcagtaccagcacaggcattcgtgccatgagttgaatagaactgaagagaagggagaagcttcccgggggtgggcaagaggaggcttgagagcccaggaataatgataaaacagtaacggcccagggctaaaggaatcctccagaatccgagttctgtggatctaagttggcctgggactgcctgaggatggggcaggccctgcccagagccctcttggagccagcctccagcacctcctcagcctgaccttccaccttcagtgtttagagctgagagagcaggctacggggcacataggtcagccctgcattgcttacacaagtgggccaagactccaagaggggctgagatttggccaaggtctttgaagaaggaatgcccattcatgaaagaagagctattacaacttctgtctcttcccagagtcttctttccagctcttcctagaaaagcatggcctgctcagtcattctcaggttcctgtgctgagaacaggagtgaggaagggaagctcacaggaatgaagcacccactggccactggagatcagatgggcaccattatatgttggatagtattcctccaaaaaatatgttgaagtcccaacacccagtgcctgtgaatgtgaccttattgggaaggagaacatttgtagatataatcaagttaatatgagatcattagagtgggcactaatccaacatgatggtgtcctcataaggagagacagagacacagacacacgtgggaagacagtcacatggagatggaggcagagacgagtgatgcagccacaagtcaagaacacctggggctaccagaagctggaggagacaaggatcctcctctactcctgaaggagcgtggccctgctgataccttgttcttagacttctggccccagaactgggagataattcatttctgttgtttccagccacccaatttgtggtactttgttccagctatcctagcaaagtcatacagacactttcacaaatgtctcacaacagcctctcagccaggcagagatggcagcattggctccgtcttctcattctaatgtcaactccttgcattacctctccaggcttgccaccgccccaactgtgaataaacagtgctcctcatcttcaaagccctttggaaatactaattaactctcagctaattggatgaaagaacgtgaagctctgatgacatcatctccattctgtgcccagatctagccacaagcgaaatctgggactgctgggctatgagccttgtcttgtgggaacatgttgtgcccacgaaacatggctggggacggccgtctactcactttagctccatgggcttcagaaaacggccagctgtgggcacacttggccaatcaagcacgcataacacaaacagtttctgtgattaagagtttgtgtgggtgtgggtgtgtgtgtgcgtgtgtgttaatcacatacctttgcactctgcacatcactgagattgtcttattggccgttctaaacagaagcttacaaaaacatgtgtactttcaaatctcctcagaatgcatccctgtgatcctgagggcctgtgtaccccctgccttgtagaaccaagaagaatccctctgcgtccagggccccagggggtgagcatcagttgagctgggcaagtagctgcgtgcaaggcctggaggcaagagcctgcaagtcggaggccatctgagccaggagccagagctgagagagattccgaccaaggccagaagggcgtgaggaggaggtgcagggctggggctgtccccacgacagcagggtctttggtggacagacagcaggcatgctgcagtggacagggtcaggagacgagggttagaatcctgcctttgactttgccactcattaacctggacaacagtgacaggcccattccaggtctccctgactccgtgcgatctctccttcatcctccaccctgtggccaggagcaccatccatgcaccaggcagatctgctcctggcactgaccactaaaaacctcacccgtgtgtcccacgggatggacttgaacatgatgggtagtacaatgaccgtctttgttcaataacaaagaaagaaagaaaggccattcctgctcagttatctttcaatccttcagatcatgaaaaaagatcaaaaaaactaaaaaaaaccccaaaacctcagagttccatgctctcgtgttttttgactttgtattgaagcataatatacattttgaaaagtgcatgtcatacataagtataacgcttgatgactgcccacaaggagaacatatccatgtcaaagcacccaaaccgagaaacaagatggccactaccctgacatctaggagcagaaattagtttcacccatttttctgttttatttaaaagaaatcggccgggtgtggtggctcacacctgtattcccagcactttgggaggccgaggacggtggatcacctgaggtcaggagttcaagaccagcctggccaacatggcgaaaccctgtctctactaaaaatacaaaaattagctgggtgtggtggtatgtgcctgtaatcccagctacttgggaggtcaaggcacaagaatcacttgaacctgggaggcagaggttgcagtgagcagaggtcgtgccactgtaaatccagcctgggcgacagagtgaaactctgtctcaaaaaataaaaataaaaaataaaaacaagaaatcactctatatgtgctcttaggtgtttagctttcttccctcgacattatgtttgtgagctgcatccatttgtttctacactcattgtcattgctgtagagcattacattgtgtgaagacaccataaattacttgttccttctaccttaatgggcattagggttgcttttggctataacaaatagtcctgctctgagtatttcttgggtacatgtttttaaaaacatccgtaggctgttgagtgggaacctgaaagtgggattactaagtcagaaagtatgtgtgtatttggcttcagtgggtaagctgagtttcccaagtggttgtaccaatgtaccctccccaccagtaaaatatgagtattctagttgccaacaatcagtattttctgtcttcttaattttattttattatgttatgtatgtatgtatttatttatttctttttagagacagggtctcactctgttgctcatgctgcagtgcagtggtgcgatctcgggtcactgcagcctccaactcttgggctcaagcgattctcccaccttagcctcctgaatagctgggacaacaggcgtgcttcaccatgcctggctacttttttattttctagttttttgtagagaggagggtctcgctgtgtttcccaggctgttctcaaactcctgcactcaagcaatcctcccacctcggcctcccaaaatgctgggatcacaggtgagtgccactgtgcccggcctggagttgtttatttgtttgatgtattctggatgagggttttgttgaagatgtgtatggtgaagatctcccacatgttgagtatcctttcactttcttaacagtgtgttttgatgaacagaagtttctcactttaatatggttcaatttatcacatttttggtcacactcagcacttttcgtgtcacacttaagaaatctttggctgttgccagttcacaaagacactctcctatgtttttcttctaaaagctttattgttttacctttcacatttaggtctgcagtttgtgtggaactgatttttttatatgatgtgtagtaaggattcatagacatttttttttcccatatgggaacccaattaacccagcactttttgttgaaaggccaatcctattcctactgccctgccctgtggtgctagtgtatctttagcttctcaaacacttgataactctctgatttgctgttgtaagtgttaatgagttaaaacagttcagaccccagttatcaatcaagcacttatctaggtggtgttgtgaaggtggtttgcagatgtgattaaagtctttcataattgactttaagtatggagattgtcctagatcacctgtgcaagcctcagccaatcagttgaaaggatttaagagcaaagctgagactgccctgaggaagaagaaattctgtctgtggattgcagcttgggcccacgtccaagagttcctgcatgcccttcctgacgacctgccttatggattttggacctccccagtcagcccccaccaccacataagccaattctttctcatagatctcttaatatgtatctcctactggttttctttctctgatggaaccctgtctgatacatgcctccatctcccaaacaagaccgaaatggtttcaatagtaaattcactagccattcaccgcagactaggcgaagagggaaccctcactaatgggaatggaatggaggaggaaaatgagtctaatctcaatcatgaacatagatttaaaaaagaaaaaactctacaaaatcttagccaagtattcaaaggatcttatgccatgaccgagttcatgttggtatacactgcaattgcaaaccaagtcttgccaggccaactcatcttaatggaaatgatgaaattcagttgagaacagtggcaggccaacagtgaaacttttgaatgaaatgcactttaattcaatgtcctcatccttgaatgtcttcatatctttattatccttggtactttcatgccccaggacccaaagctgagaaaccagcttgaggaagcatcctgggcccacaactgatttggttccacccctacatctctctcctaaaactccctttctcactgtgtccacctcactcagaagcagtagtcctcagtccttggagcacacctgagtctgcagggatacctgttaaaaatgtgagctgtctcctggggcaggttagttgacctagtggactcacgtctctgaaaggttccagctgacttgcactggtatctaggctcacccactttccagctgtatggccttgggcaaatgatctccctgctctgaggttcagcatcctcccgtgaaccacatagcctccctagcccaaaggggagggaagagtcacagctcctttgcccaccatgcagggtgccgcatggtggtaagggcagcagccagtggggagcaagggaagatatcctttgggcagcctgagtccaggaaacacagctctgcctcgctcagccccagaaggagccacacatctgccaggatctcagcagggtcaacaggagcagccaggctgagctcacatctccctgaaagaaagacagccgtggggcgtttcctgctggggacaggtggagtgaagtccttgctctccttgcaagcagccgaacattcaaagcgaggctgacaagttcaagtcatcctctgatccttctagaaatatcctgctaaaagccaatcacatgttttctttcaaatgtgtcattttgcacagatgtttaaactctggcataagcagcaggttgcatcagcctctcttacatctaaggcctgcaggatcccaataatttaatgttgaccaaaggaagaaagcctccttacaaagtggcagaaagaagaggatcaagacctcaaggagggttttctcaggacacctactgacagaagcactgtgcatcatacctagcatgtagtaagccctcaacaaatattagctttattattagcattgttagcacagctcccacgaacagtccccgatgccgcatgtaagtggctaactgagcaatttgaacccagtggggtaataatcttggaagttaagagtccgggctctagagtaagacagcctaggtccaaatcccagctccaccactcactagcccttccgtgccatagagtcctcatctgtaaaatggggataataatagtatttacgtcatagggctgtagcaaggatggaatgagatgttttcagtagagcgcttgggacagcacctgacataaaaagcattaagtcaacatggaccctcaaatcacccccttcagctgagctttgtcaaatcggccttgcccatctattaacagaatcttgagcaagtttccgaagttactggtgtcttgcagttgttaaaactcagaccagattaaaatgtcaatctcagactcagtttcactcttccctgagcccctggctgctctgagaccctcctgccgccctaccctgtttgggaaaatcaaaggacactggctgtctcatgggaagggggaggagtgggggaaatacatgagcccttttgaaggctctttgagacttgagtaggtttctgctccttgcctcagaggcatcttaacaaaggtgactcctgacaccttcctgtaggctctttttgcgtgggggatctctttgaggggagctggttggagctccttcctggccttctctgatcatccaacacacactcaaccattcccatactgcctaggtgatgtcatgccctcccgtggcctcaaggggccatcgctagctgcctctgcccctacaagcttggcctctaccctggacggttcctctgagctcctcccctgtggtgtcctggtgtcagctcatcttatccactcggttgccatacaggccccacagcctcactgtctcccaagtgaaaatcagatctctatcctattcccttcccccaactgttacccgtggagtctctaattcctgaataaaagatctgtgcaagtaactgaggccagcaggcccctctgtctctccttcccagcccagactctctttgggcaaagctcattcctggctattatgcacaccaaacaccagtccttcaatttggggctggggcaaacagtttaactctccagtcttaggaggagaggtctcccttgtcgaagatgggagtggaggccagagaacggggagatgaaagtatatcccagccacgtaggaacatttctgctggtgcaagaaacctacatcaaagtggccacaagatgagctaatagaaggtggataaatatgagtccatgtttactgcactttatgtggaatcttgaccatgtagggagggaagggcctgcctgcgccattctcctgctcccacccctttttcccaagctgagcaggagcccccttgggtcttggggttgactttatagcatttgagattcttatctcttccttctagtcttttgaagtacatgatgacactctctccttcctctgccttttcctctggggaaatataagaaaggaataaagacttatttgtctggaaaaaaaccaagtccaacttttacaagtagagaataaactacaaacaacttcaatctgatggttgactttcactgacaagaaatttcctcctttcctctccatccccatctctccttccttccctctttttctaaacatctagcagcctccttaactgccctgtaggcatagccctggctaatacctgtgactggaggagctctcatccacccaaggtagacatcatttcaccatgccaggatgcaagctgtaggcgaggcctgaggctcaacagatcttggaatccccctctaaatgggtatggtctctgcagaattcaggctccccttctagtctattcttctgaggaccatctctttctatttttccgtcaacaccctctgcccctcctctgactccctctcccatcaccgctactcctccatcctctggctaccagtttttgcctcagtactaggtggctttttaccagactgaacccctcagggtccaggcctggctcaaagcaggtgctcaggacacaagtatgggccactggaagccctgtatcgtggggagggagcagggagtagggcttcaggaagtgtctgcaggagtgacttcatacaatccactacgattctgatattttaaaacaaataatatgtgtgactttttaaaatgtcatgtaaaaacacgatttaacttgtctttaaaatataccaggtatttaccaggttcgtacttgtgaacaaatattgtcttcatccaaacgttaagaatggctaaatgccatcatgttccctcctccaaagctaccctcttggaaaagacaaacttgtccaaagaggctgccttagtctagaacccaaaggacttgtcacctccataatttggagacacagcatgagcaagcttcgcctgccaccccacagccccgccccgagcctggcatactgggccattgcagattgggtggcaatactggcagacatctagttctaaaccttgagtttagaaacatgggcacttgcaaatggcatctctggtttctttctgtcctggaaacgatcatcgtctgttccctccaatgctcactgagcatttggtgcgtgccagcccccatacctgttacctaagactcagggaggaatataagctggtttctgccttctagagctcacgggctgtcaggtagacagaggaaaacccagtcaccaccacatgatgtgctcatgaagggactgagccacgtgcgttggcttggcagtccccagtagctcagaagggctgccatggggaggaagcattttcttccggtggtctttgagaaacaacctctctacactgacaccaagtacagcagcacctgcctgtgtcccttcacctgagtgaagtctttgtttgtctttgtttgttttaggtaaaattaattctttctcagttcagagtggcccctgattctgccatacaagtgtgtagtagataagttcacgttcagtgtcgctacgcctttctgattttgcagtctttatttccttctagctctcacctttacagacttaaaaatgctccactggaaacataggttgtttgctattggagttttttggcctctgacacccctttggctccttgcttgtgctcctcaggtttctctgggccttctggggggctggcttctccttcccacctgctttatagggaagacacattgctcttggctcaaggcaccacccagaagcagaaggaactctctcctgggcagcccagtgactggcacgggctcaacagcttgaaagctccccagccagaggaggtctggcacagattgaacgggcttgttgggaagtacttgggggcctcagaatggctgagtgggctgggcccacagcagcaggggctggcagggctggcttaagtgttaagaataactcttttctgttgttgtttttattagtgcttttttattacgaaagtaatacactgccataaaaattcaaagagtacagaaaggaataaagagaaaactcaaagcatcttcccagtcagcccacacaaacccacttcctagaggcagcagttatgatcagtttcatgtgaaacctttaatataatttttatacatatgcaaatgtaacaaatataagaatgcattttttgcaaattgcttttctttaaaggaaaaaagtatatgcccattttttaaaaagtcaaacactacagaaaacacaaaataaaacataaaaaataaaaacaaggaaaagacagctctcaaaatccatatcttagaagatagcaagtgttgacactctggaaggtgtttctcaaagcctttgggcaatttgacagaagtgaaatcacactatttacgctgccatgtaacttgctttgatgcaaactgctatttctctctttcattcaacaatatattattggcatttttcatgcccctaactagagatctaaaatcaacacctcgattggccacatagtatcctgttataactttggaatggatcttctgatagaaacttatcttgtaacgagttttttaaaatatcatgaataatgttgcaatgagcatacaggtacttagttatctccccctgatgcagttactacctgaggataaatgcctagatgcgagggtactggcaatacaaccccaaaccacactgagctgacactttctatccactgcattgagaaaatagaacacatctgacaacaccaagtgttggcaaggatatgtagcactgggaattgtttaggcaggaaagtcagtgttctgctgtcagattgaacatgcacataccctgtgacccagcaattctgccccaggatatattatatagatggttcatgacttaacaatggcccgacttacgatttttccactctaccatgatgtgaaagcgatacacattcagtggaaaccaaacttgaagtcccatacaactattctgtttttcactttcagtgcagtattcaataagttacatgagatattgaacactttattataacgtaggtttcatgttaaatgattttgcccaactataggctagtgtaagcattctgagcacatttaaggtaggccgggcaaagctatgatgtttggtaggttaagtgtattaaatgcattttctacttagggtattctgaacttatgatgcagttacatcccgataaactcactccacatctgggaatgttaaatgctgctgacatgtccagtaaaatgcaaactgaaaactgatcattggatttagcaacatagagggggttgatgaccttgacaagagccatttctgtgtagtgatgggagtgaaagagaagggaggaagaggactctgagaaagtgtagagaattctctgaaggattgttgatgtaaagggaagaaggggaatgaatggacagtagctagaaaggtgtatggggtcaagagaaaggttttttaaaatggtgggaagaattccagcatgtgtgcatgctgagcagaatgatccggtcaagagggaataattgatggtgcaggagaaagggcgaaatgttagcaagatgttcctgggtaggcaacaaatgggatttagggcacaagcagaaaacctgacctttcatctgcttcaggacacatcgttctcttgtatcaggatggggcagaatgtgtagataatggtgctgtggaggtaggggatgaagatgtttatatgcatctcatttaatataatatatatatgtactatttttgtatgtcagataataaaaagaattttaaaatgttagcattgttgagtccaagggatacctcatcattcattttgtggcatatttttagatcaccacccagaaggttgccctgacttatcctcccactctcagagcccctggggcagaagagtgcccattttcccacacgccaggtaccccagggttttgcagatttgttttaagttttacatacctgaggcaggggtggaaacagttgactttctttgcatttccttcatatgctaattggtgacccgcaaatcttcttttgtgattatctgttcacttccttggtcctttgctgattttcctactgggttgctttaaaaggagtccttttttattttcggaagattaagcctttcgctgtcatatgcagttcaaataactcttcctcatttgtcatttgtctaatgacagttatggtgggttttgccatacagaagtttttaatttctccatcttttatggtttctggttttcatgacatacttagaaaggctgtccccaccccaggattctttctcatacttttatggtttcattttttttacattaaatttctgagccatctggagtttattttggtgtggagagtgaggtaggaaatctagcttctttttccaaatggccagttattccaacatcatctcttgaatgatacacttttaatccacagattcaaaatgccaccttgatcacacactgcatttgaaactacactctatccctccgttcatcaatttggcagctgcttcctgtgtgcctactcaggcatcatactagcatgaggtgtgtttcctacatccaggaggaagggagaggagacacaggagacagcgaccctgcagggtaataagtgctagggtggaaggcggtggaagagacacttagctgggtcttggtggttagggatgacttcttgtgaaggcaatgacctctgaacagacatgagcatagtagcagttaaccagtgcgagggaccgcagtcagcactaagttctagagacagaatggaggcctatgttgggaatcagcaggaagtccagtatggcttccatatgacaggagcttagagcgtgaagaggctggagccatagcaggtactagacttggatggcagagggaatgaggagtctcagatggtgcccctgtttctagcctggactgctggacatggagtcaccttatcacccaagcagggcagaggggaagatggctctggctgctttgcagaaagtagatgcaggagtcaagcgcagaagccaggagactgggaaggaggtgatcggggacactactgtgtcccaggatagtggcagtggaagtggatggtttggagctgcaatcaggactggctgctggattggacatgggagacgagggaaagatcagttaaacacctaggccttgggaggtgcctttgatgatgaagaaaactgagggaggagaggtttggaaggtgaaggatggtggcacaagagtttgttttgaacatgtttcatttggattgactcagacattcatgtggtgatttcaagtaacaaaagtagcaatagtaaacattcactgagcaccaccatgtaacaaactccattccaagcactttatgcacgccatcccatgtcatctcacaacaacctatgaaggtagatgctggcactctcatctctattgtacaggtaagaaatggaaactcagagagggcaagtaacgtgcccaaggtcacacagctattaattggcacagctgggatttgcacgcagtccagttccagagtctgtgctcatagccttcatgcctccagataagtgggtgtcagggaagccaagagaagcaagtttttccagaaggggaaagtggagtgatcaactgtggccacggggtaagtgaaggcagaaatgtgaacactgggtttagcaacatggagatgactggtgacaagaatgatgtgaagggagtggtagggttgaagtcctgatccgggtgagtttatgagagaatgggaggagaaggagagacagtgagtctagacaactcttttgaggagttttgctcaatagcaaagtggagagatggggcagtaactagaggtgggagtgtggtcaggtgagattcttttttttttttttttatgttgatgggaaagctccaaatgaaacagacatttttatgatgtagaagagaaagggataattataaagagggaagagtctatgaaggggagaaggagtggaatccagaagtttatattggcaccattctgcacagttgcgtgacgtctgccagcatggttctttgccttggggcaagcatgaagaatatagacatttagctttgtccagatttgatgccattatcatcaggtggaggtgacaaagagacagtagggtgagaagattaggatgttcacaagacagcggttgagtaagctggatagggagggaaatgaagagaggaaaggactaatggatggatagaaagtggagcagccaacagttgggagcttgaaagatagttgtcacagaagtggttgaacgagcctgctggaaagagaggaggttggggcaagaagttggaaagcctgcattctctattctggaggaagcaacagcaggcaggctgcacctgtgggaagaagcggctgtggtggagctgacagggtcttgggagatgcctggggagcctgagggttggggatagctaagccacaagcatggatgctcaagtcacacactcactaccacacctcactgctctcaccctcaccctcccagtcactttctcacatccagggcaaagacctgcctgaatgtcaggtgggggatggtgttgccagttggcctgggcctcaaagcggggaggttttcatccaatggcaaactggactattctgaggtagctggggtgtgggagaaggaagagcctcctctggattgagctgccgggagggtgcctggcttcagtttaggaggaagtggatagctccctccaagaagggcagcatacggggtggtgcaatcctagaactttctgtgatgatggacatgtccactatctgtgctgtccaacacagtagccactggccacatggggctattgagtacttgaaatgtggccagtgtgactgaggagcagaatttcctattttattcctttgtaattcactgaaatttaaatagccacatgtggccagtggcacctgcagtaatcagtggatttctagagacatgtgctggttacaggttacagagctgcagtccccaaggcctgggatgggacaggtcagggaagaaggagaggaggaacagacggcacaatgccaggaaggctagagttatttggtcgagttcaaggtctccaagtacaggttacttgggccaaatgcaatcaacaggagccaaatgcatcccccagccaggctggtccaatcctttttgatgagagccagccccttcccccatgctgagaaaattagagttttcatcaagtgaggctctgaccagcaccagcgtgggcagaagaaggagaaaagcagcaggtctgactccaaaggtcggggaccacagtcctgctcagttgaacaaaggggcaccctctgagctgttctcccctctaatctccaaaggctgctctccatgaggaaatcaaggcagctaagcacccagggaggtttctgggaaaaactaataaagaagcatacaccctttaagaggtgaaacccagtaacctttcctctcctgtgtgaagaggacttggatttgcaatggtgttttagggatccactgcatttcctcttcccaggtgggcatttcccaagccaagggcagtgcccagccgaaaggaacatggctgggcatggtggcttatgcctgtaatcccaggcataagcactttggggggccaagtcagatgagttgattgagaccaggagttcaagatcagcctgagcaagacggtgaaacctcatctctacaaaaaattagccaggcatgacggtgcgtgcctgcagtcccagctactaggcaggctgagatgggaggattgcttgagcccaggatgttgaggctgcagcgtgccttaattgtgccactgcactccagcctgggtggcagactgaaaaaaaagaaagaaagacagaaagaaacaaatccgcaactctcagagccagacataccctctggttgatgtagtttcagctccctcagccagtggtttagccaggccaggcttagcagggccccagagtcggagctccctccctcgcaggacagatctagctgctcggaagttagcgttcacctgcagcctgcatctctctgccagacctcccagcctggggccccagagaggtctgggcggggggtgctcacagaccccaacactgactctgaccttcccatttcttgagcatgtggcagcttccacacctttcctcttccaggcgcacactcacaatgcccactgagcaccagccctgccagagggtcctaggagcctgggctgcttctggggcagcagcagggcccctggggggcggggttgggcccagctctgggggaggagctcccagctgaggccaggcagcctccagagtctccaggctgaggaccgcgggggccctcggcacggcccctagccggcagtggctgagctgagcttggggggatgagggggcgctgggcagggagcccactgtctccttctcatggcttcccttcctccttatcccaggagcctccctgccggccaactgtactaaaactccggaaaaccatggcggggaggttttccaattagaacattctttttccgacctgtggatgattcttaaagcagcaaaaagccattcttcagggcatgcagggagtatctgccagcgaggccttggctccactcgcgcactcgtgctcaggaggcctggcctggggctgcttcagagccacagacaaaaggcagagcctgtgttgtggggcatcaggtcacacagaccaagactgatggctgagagtttcctgggctcattcgaaccagtagattcaaacggcagtggggatccaggctacaggagtggcagatgtcagaccacctctctccttgctttgtgacaaggccactgctcccaatgagaccactgttcacacagcaaacaatccccaggcatggctgctgtcccttggagtagaactgggctgcctcctcccccaaactgggagccgcaacaggccgggacagggtctgactggtctctggccagggttggggtggcagtgcagtggggcaagtaagaatgtgtgtgtgttccagagagggggaccacaaccccgtagcttggagtgcaggctgagaacagggggagaggagcagccactccacatgctgagaggctggaccagctcctagcaggagagctggttacaaacacaagggcctggcctcacgggttcggggctcaaaggacccatcctacctgcaatcacacctggggacccctgcctccagggcatccaccctgcttggagtcagcagagtcacccagcaagtgtaaaccggttgaagagcttaagaggatgaggtggcagggcgggccccgggaaggaggggattagggatcaagcaggagcccagccctccccgcacatgaacctgagcaccccagcttctctccagctgggcaggggctccatccagagcagctggaaccccaggttctaagcccagctctgcctcagactagctgtgtaatcctggcaacatcttgtccctctgtgggcctctgttttcccatttgtacaactgaagtgttgaggttgcctgcctgtcttcagtcccctctagctgaggacactgcctgggggagctttgcggcctgacagctttcagggcccaacccctctttctccccctctagcctggtaactctttttgttttctgtattttttgtagagacggggtctcaccatatcgctcaggctggtcttgaactcctgagctcaagcggtcttctctccttggcctcccaaaatgctgggattacaggcgtgagccactgtgcccacctcctagcctgggaactctggggctagatcaccttgcttgagttctcttcccagccctggagatcagaatggggcctcccctggagctgaggagtgctgctggccagttctttcccagcagccacctgccgtgctacccatctcattgcttagatgcagcctcccagagacgctgcctccacggcctgcttgtgagctatggcttctccagcacagggctcaccacctgctactccctgcctctacctttcagcctcttgcctgcccagacagcccagcctggccccaccctgaagcccctacctctcacttagagccttgctgagggcctgcttgttggtgggaagagactgtccagtcccctggaggtggcactgctgcctaagctggagggacttcaggagaactctgccagagccagggggtgggagctggcctgtcttggagctgcggatgggtggaaaagtgcaagagatgtgaataggaaaggatagggccaagctcaggccaggtagggacagagcccagcctggaggcaggcagcagccaccacagccttggcctagaacttgagggaggtctaagggaaggttcatgaaggagataatgttactgctgagagaaagtggaggccacctggtgtccctggggaggaaatgtcattccaaacaaagggagcatcttgtgcagcgtcctggtggtatttgagcacttggtctatctgggtacatgtcatttgggcatgtctggtgcttgaagaggctgaagaagccagcaggtgcctgaagcctggctgaggtgactagaggtgccctggcaggcgtggaagtggaagactgttggggcaatggacaggtgggcagggcagggcagggcagttaccattcaagtcaaacccgtttgcaggcaagatcagctgcagggcctggcagcctggcagggagggaggggttcagggaaggctgatctctttggctggagcagtcgtgacagatcgggcctgggcagagactgagtcacctgggacatgggaagagcttgaggccctggggcggcccagcctggggcagtcctcacttgctggccgtgccgttggacaccacatttgctcatgctctccagctgggccccccacccctgactcagggctcttgaacaagtttgccttttccctcttccttgccctacatctcacccatcatgatgtcttctaccttctaccctttcaaactaggggctcttgaagaggactgggacccagacaaagagtatgacacagcctaagtcatacagtaaacatgtttaggaggtaagatgccaagccaaatccatggccaccagtagccacagtggaggaggggaggtgttagttgctggccaccagacaggggcatacaatattggaagcagaaaaatgcttgttggcaagagacggacatgaacagaagtgactttatatacaaccccctaagcacacacagggtcgccttctccctatctcatgaaccccaagaagaaaaggatgaggacagcttccacagcctcactcacccatccatcacttccttctgcaaattcttcggatgccctgtgctggtctccgtgacccagtgatgaatcagaaggggccctgccctcccagagctcaggatctagaacaatagagggtgacagccactatgctggattgatgtcatctgagggaactaaggggtgcacagaaggaagtgatcagctcgactgggtggcaggcaggggaggctttccggacactgggtggaggcttgaagaatgactaagagctcactagcccgacggggatgaagagcattttagggagtccgaggagcaggagcaaacaccccaaggtgagcgccatgtgatgtattcagaaggcaatggaaaaaggccagtgtggctgtaatgtattgaacaaagggaagagtggctggacctgcagggataggtcgtctcaaggagtctggcttttaccctgagagcaatgggaagccatggaggagttgcaagcaggagagcacctgatcatattgacacacgtgaacttttaacctgacctccgtgtagagactgagggaaaggaaggcaagaccagaggcagggggacaccagcaaggaggctggtcttcggggccaggtctggactagggtggtggcagcaggcacagggagaagtgggtggactggagggccatggaaacaccacattggcaggccttgatgaaggagaagcagctggtccattcttttgagcctaccaccctggtaggccaactcctggccaagtccatgccatttcttgggctggcttaattgtctccctgtttgggaggccgtggggtgaggggtctttcctccatgctctctccatccttagccccagcccagggccttgcacacaataaagcactcggtgagcaccaacgcgtgacacaggtacatcaaaccgcattggctctgggagtctggctgtatctcgtcgcccagcctgggagatagccccgtttgctgtgccttgtgagccccgggtccgtcccaggatggccttccacgatgagcggctccctcactcttctcctcctttcctgcctgcaggacttcctggatgatctcagccgccagccccccgcccccctccccgcccctgtctgggatctccatctgtaaaatggatctaggaacggtagttctcgactgaattaacccgacagcatctgtggaagtcgttggccctgtgccggggccagatcgcgcaactaggagcgggggcccttcacgtggcggaggcttcccggcctgggggccacgggcccggaggaatttgcctggaagttttccatcacggcagagccttctggagctcgccccgtgctcgacaaggggagccccagacttgatttctccagcagccccgcggggcggggccgagaaggggcgggcgggcggaggacgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagttgtgttcttgctgagccgtcggcacgaagccttggcatcatgggaggccccaaagctgtgagccccgagagagggcctctcacaccccatccagcagtgcttgaggcttcagtacctggactaagtcctgccttggtctcatggcccttcagacttctggctgtcgtacctggctgggggcgggaggcaggggtgcacaggttgataggcctgaacagagctgcagaggtcctgccttcccagggcctccgctcctcatctgaaaaacaaggggcagctcagaggccagcaagtggccaagacacagatgcacagatgaggggccagccttctggcaggccttggtgcctccgctgttcccctcatcgctcccaggccacttcaggatgggaaggaacagatccctctcacctgcccctccttccagcaattcccagcccctggctggatgctgtgcattcagccgtgtggagctgatggaaggcactcagtgcagggccagacacgcagcaggtgctcaagatctgttcatttccatcctctggacactcatgactcaagcaacagaggtggcccaggaccacttaggatgttgcagctccgagtagcatgaaaacattaggggttcctcagtcctggagcagcgaggcacccctggctgggaagatcagggaaggcttcctggaggcgaagggcttggaagcaggaggaggagctcggcagccaccaggtcaaggcccgcacgtcctttggagctgctggagtctaacctccccgttactcctgaaagatcataaaccacttcttgctgagctcctgcatatgggggcccacagagaaatcagctccatgccttgccctgaggagtgacagagaggccatctgtcagtaagaagttgccatctgaatccaaatggcagcagtgcttgtccacctcacttcctgctcagctcaagtccagactccagaaaaagcctttcccacgtgaggccagtgatgccaggggcagccagcgcctcagctcagcctccctcagcctgacttgtgctccttgtcttcctgcccagtgtccccaaggcctcctgagatctggcagggcagggactctgggtccctagcactgggcccaggacctggccacgataggcatcggcacttgttccctgaactgtcttcagttgcatgccaagcaaactcccccaattctggctcggtgcattctggaagccagaagcctgccttcctccttccctactcaagcttccacaggtgactgccccctttggtgcgggttttgcttcaagccacaacttataaggtgccaggtcacatgtaacacaagctttccttctgttgctgagccctgaggctgcccccactgccagtccctggcggcatgggacaggaccagtgccagagaggagagctgctctccagtgcggcaaccccttgcagtccgggcctttgggctctcatgtttagggtcagtccagggactttgcattcgttaccactgtgcccatagtgaaccggctgatgccaagacaagggcagtgccatcaggggaccagtccctgagagatgctcaggagaggttgccatcattgcttccaaaggccgggaagaggaggaggggctgaactgtcccacacctggtcaggtgtgtggcaggtgagggtggcaccttcatagcctagtggttaagagaatggctcagaggtcagcctgggttcaaaccccagctcagccaccatccagttgtgcaaagttcggcccttcatgcaaccccttgaggcctctgttttctcaccagtactgaagggtggctaaagccaggagcacctgctgcactgggtgcctgcaagtgctaggttcctggcacagaggtgctctgtcacggaaggtagctgagccaggactatggtgccctccttcagggctgtggtggcaaggagtgaagtgggactaggtggagagagagatgctgactgggatgtgggcccctacctgaggaaaacagtttagaaattactgctgatgatgcaaacagtatctacccacatttaaagtgactcactaaagaacacttaattcttagggtgatttctcatgcctactaaagtctgactcgctttcttttttgttttcactttttttttttttttttgttagagctggggtctcgccttgtcacccaggctggtgtacagtggctagtcacaggcatgatcatagcacaccgcagcctccaactcctgggctcaagcgatcctcgtgcctcagcctcccgagtagctggcactacaggcgagtgccaccatgccagcactgttgttactttttatctttaattttttttttttttaccttgaattgatttaaaactcatagaaaagttgtacgaatcgtgcagagaactcctgaagccttatctgaattcccgctattaacattttgccacatttctcattagctttcttcacttgtagcctttggatgggtcagagggtgggcagggctgttgtcagttcatttttccaaagggaaactgaggcacagagagggacttgctcaagtgccattgattagaaactgagccagattaacttctctcagggacacatattgatgcatttggcaggtgttttcttgatcactttctgtgttgggcgctggggcacagaaatgactgagaactgacagcaaagtgggagggacaggtctgagtggagaagagactggaaaaggaaaagacaagaggccctgtgggtatcactctcaatgtcggaggtggaatgcaggaaggaatctgcagcttaagcgtgtctcccagggaatttgactgccgaagggtcccagaggccactttcagaaacacggtctaggcttttcctgttgggagtgtgctcatttctcacctcaaaagggagctaggaactgggagggtgcctgcctggagcagggaggtgggtccaggccagccaagagagcaattcctcacccactcattaacgcccgctgagccatccctcttcccgcagagctgcccttggggctgctgctgctgagatggcggcagagctctgaagccacgccctgggtcagagaggagacatagcctctggggccagtgggcaagccctaggctgctggtggttgctggcggtggtccctggccttggccccatctgtaggcccagctcgggcacccagtccgggccccttggtctagtccctgtgatctttggctcagcacgccactttgtgatgactaggtcagtttcccagagagcttgatgtggcgaagagttgctatggagagagcaagcacaaggattttaatcacaagaaccggcatccctggtgaaaatgcttacatcaggcagtgcctgctttaaactgaaataaaaataaaaataaaaataaaacccaaaaccccaaaccaggacttgcttcaccacttgtgccagcgatcccttactcatgctttcattcctttgggcctgagcctgggcacctccttgggaaatgcagtgctctggcaacattccgctaggccgatccccccagcacccagcctggcggttagggctctgaaaatgcttgttgcatacatggcagtgtgatcctgggcaagtgctttcttctctctggacttccttattcttatccaaaaataggggcagtgttagaggtaagggtggggttgaggggactctgggtctagagtgggcagaaagatgagaaagagggttgtgggaggggagaaggaggatagggagtcagagctttgggggaagtggggaggcagcgggctctttctgttccttttgctcctaactagtgatcacctgcatctaggacagaaggaattagctttggctgatgttagtcaagggcaagaaggagtgacttcctgtcactggcctgctctggcaaagactgaatggatggcagcagtggtgtgtgtgtaggcgggggtgttcctaggggagagcgaaagagggtaaaagaaagtggccgagtgcggtggctcacgcctgtaatcccagcactttgggaggctgaggtgggtggatcacttgaggtcaggagttcgagaccagcctggccaacatggtgaaaccccgtctctatcaaaaatacaaaaattagccaggtgtggtggcaggcgtctgtaatcccggccactagggaggctgaggcaggagaattgcttgaacctgggaggtggaggttgcagtgagccaagactatgccactgctactccagcctgggtgacagagcgagactcgtctcaaaaaaaaaaaaaaaaaaaaaaaaaaagaaaaggaaaaaaaagaaagaaagaaagtagggggagagggagaggtgctgtggagattggagtgtgggctccatgacctctgagcctcctctgatctcactggctgccttgtctgcaaatgggactagcatctctgcatgactgggattggctgaagaccacattggttccctggctgcagagacaactgcaggatgaggggtacagaagcagccagggccctacaagagggtccctgcccagccctctgttctccacagagacatctccaagggcccttgaagccaagccagccctgaaatggcccagttccctgaacggtcgcttgtatctggctctctgagaacgagaaaatgggcgcatgaaagccaggaggaatcccgaggccccaaggagcggtgggtggcccagctgccttctcccctcctcctcacccccagcgccccaccaccttgggaaggagctggcctgccttaaaagtctgcctcccagggcccctccagtgcagacgccgagaagtctagatgctggggtgttaggggtgggatggggagaggtgaaattccagactttcatgcagaagtcatttacctgtaaagcacatttacaaataccacccccgccatgcgttctttttccatattatattttcccctctgcaactcaagtctttttcagctctttttttttccacttgctgagcctttttcctgccaccctgttggcctccaggcgagagcccctgggactggagcatcccaggcaggtcgtgcactctggctctggcaagaggggcccagcctaggcctcctgggagctgcacgctgagcagcagactaggaggctcagacgggatccagctgctcagccctgcccacggtccctaaatcaccgttgaagtgccccatccccctggatctcagcaactcctggaacagcagctacagccgctgcagcggtgcctgtggcggtgcctgctccatccccttcccagaggaaagcaacctgtctgctgactgttgccttgccagctgctgagactccagtgcaggagactgggaatcagaatgtcctgattcaccagacctggccacaggaggctgcttcatcaaatggaacgtttcatcattccaacccttttggtccagaaaatcagcacccgcaccggcttaaatcagcctgggtccaaactgagtcagccaagtgcgtgccttgagaaaggacggggtgagggcatctgagtgggggtggaggtggtgcttcctgactttataattcctcaggcttgtccttgcacttcccatggcagcctccagggggagtctgtgccacagccaaggctctccccactgcgctaggcttttgaccttagccccctccccgggaagtatcattgcttggggtcctgtggccttggtgatgaccggaggggctgcactgaagcctacaccttcctcacatgaccaggtgcaggggccagggagcattttgagaatggggcttccttaagcccattccccctcccatgggcacagagcattctcttttacctcaaagtttagaagtgaaggtcagggagggtgagtgacgcgtccagtgactaaaacccaggtccttggactcctcgtcagtactccttcctttgctccagagttggaagagccagcatggatgtgtggctttgtggccttgaccaagccctccacatctctgacggcaccgctgtgcccgtctcatgacatgacagatgataaggcatggctggctctgcgccggggcctcctgaacatgtcatgcccctactaccctctcagcatctgtttctgctgccccatctggctcagggctgcagtctggccgcagagagggaagctctctaaggaaggagaatgggctgggagaagccacctgctgccccttgtttagcaggctgcattccctagcaagccagctctgactatctcagtgtcgcccttctcctggtcacccagaccgccctgttcctggggcagctcatgacactgcgaggggtttgtgaagggtctttcgtgggagggcccttactcagagctcacaggcatttgctcgaaagacagcaaaagaggacctaagacatggggacttttctttgagtctttttcctgacactaggtccagtggaggctctttgcccaaatggaacatttacagtgagaaatggacaggagcctcgacacccccaccctatgcagaatttgacctccacccctattttaccaaggcaagccctccagcaaatgaagctgtcagacaggcttggggggggggcggggtcacagcctgggagggaactgcctccctctcaccccttggtgctggtgctggtggtccccaggttgagttggaccagaatggaggggtggagggactcccctccaggggactcccctcccctccagggactcccctccagagtccctcccctccagggactcccctccaggggagctacctgggctggctgggctctggggcttgggcagcctggagccttgggtttgtaaagcccaactctggctcttgtaggaggactggggggaaaggtgtagcagctggggtcacccttgcacatgtgtttttccatggtttggtcattgccacccttatcgagtggtagggaacccagacaccatgaggggagaaaggatttgcccagggcagcaaagctgggatgagtctccttcccagagaccagccatcttctctgagggttccagcaggcatgagccccagcaggtatctaagctgagggatcagcactgcctgggtccgcccatctctaggagcaagttcttgggagacaagggagttatcccttcaccacttacctcatgaccagatgggagtacttatgtttctgctggagtgatgggggcaggcctatgtgctggtccccagctatattctgggcctctgcctccattaaagctccttgtcccagagccacgtgaaagtgcttgcagacagagctttcctgaaacacagccagaggtttcctaaaacatagcaatcagcctctgcagtgggcagcccaagtcttgatggcttcatccacttgtacttgacagatccatatttggtccctgtacttgactgcaggggcagcactctgggctgtgtcccccttcttgccctgtccagctgtttctttatgctgactcctgacccaccccaaaggggtccacacagatctgagctgtgagtgatccctgtgagcctagctgaggttggcacacgtggggtggcagagctgggtgtctgctcagctcctggatgcaaagcatcccaattcacctttgggaaagaagcccttctgcttgcacctctgcctgtggcacacctgctcctgcttgtgcatggcgcccagtgcccagcacacatgcactgagacaagccctgacacctgtgccctctggctgcatctcatccatgagcagcgatattcagtgctccgggaaggcaaggctgaaggcgttttgctcccttgccctcccagtttgcttaggaggccctgcctggcgtcctacttcccttctgcacagtttgggagccatcctaatcccctgcgagccagcttctctgggaggtgccgccctcggggagtcaggcagcggggaagttctacaaaactttctctgagttagtcctctcatcttggaggctgagcacgtcctgtggtgtgagagggagtcttttctcctgccgctcccgtctgtgtccatctcctcacgctccagcacctgcgtcattgcctgctgccgcccccgctcctccagcgcacgggaatctgcatgcatcagccccctgcgtcagctcccctctcactccactcgctgatgacaccaggcttgctgtggtcgggataacaggctctgttcagccacctcattggctcctcgctcctatctatccaatcagggccaggggccccttccttcgaggttgctgggcaaccttcagaggccacagaggcagggagaaaggtagagcaggaacatgcccatgggcatttggaggccatctgaattcagggaaggcctgtcctcatctcccccgcccagccctgccagggacacttcctcagattgccatctctcagcccacttggccagagacaggaagagggagaaagaaggggatgaagggcgggccggggcatctgcctggtgtctgaggtggcctggcctgtgcaagaggagttggacttggccctgaactgccctgggacaggctggtgttgcctgagtacggggctttgctcagagtcagcacagagaggggtactgtggagtgtggccacatcttgtggggcttcgggggtgcaccacgagggacagttcatgcagagggtgtcagaaaagccaaccattcctttggtggcccaggccaggtcctaagcaggatgatatggagatttccaaaaaaccagaagtcttctccaaatcaaggtagaaatgagggccatggtactgaaaaggcctagagtggctgtcctgaccagaaatgtgcccacacaggccatcaagacacccgtgtcatggcatgagagatccagagaggcacatgttctagcttggtgtatcctgtcaggaagagacccagtgagcaggcccacagatgccaccttacagatgaggagacctagactcggagagtgggatgtcacagccatgtgaggccacttagggaagaggagcagagatgtaagcacaggccacagcccatggggacagtgtttgcttttgggttgtgtggcctctctgggtgtcagggctaatggactttgaaagaagcctgagttcgcagaggaagaggaagactggaagacttgggcaggtagcaagcccctggcaccactttcaaaggtggctaaggaaggaacatttgctctccatcttcttggcagggtaaatgggaaggtgcagggaaccccagttacagcagtttctttttcttcaggaactttttctgagtctttctcaggcacaagcccagaggcatgagagagcttgacatactggactcagatggagagtgagagtgtagggctgcgggagtgggtggcctgctccgtggggtcctggagtcacatgtggcaggcctctgtggctgcatcaggccgagcagcacaggcaggcacggtgcagctgggtgagtctgaagtgtctcctccctccagcgggtgagcattgctgctggggcccagcggtttggaggaagccatagaggcgactggcagtgggtgtgccccaggagcactcgaggccgtcgtgcatgggcttacctgggccactgcgtggctgggactcagagccctgggagtgtggccagggccagacacgggcccactcctggctgactctgctgaaggggaagcaggagcattggcacagctcttgtgcgtgggctgcacacggtactgctggccttctgagacctgatcccaggagtgtgcatgcagggtgcccgcctgacacaggggtggtgctccagcaagggaagccagtgttgttattgcttcccagaggacggcatggttctcatcgcagagcggagcccaggccactgtcccagtggttgggtcttctggccgctttgctgggacctgggtgcagccctggggagggctggagtcctgcacacaggctctggaggcttcactggcttcccaaatggggttcacatccgctaatgactgccccggagagcggagagctgagggtggccctggggcagcagccatggtggccagagggtttatctgccaggcctctgtggtgggtgctctctccctgggtagactgggcctttccccccaccccctgctgccacccatatgaaagcagacataggcatcgcatgtccacacctgagccataaccggtccctgtaccaggctcttcagatattctggacgtgagcctcgtgagcagggagttgtccttgccccctggagtactttgctttctgtggaggtccctctggctgacttgccatgggctggggagccagggcgggattgcgtggggtgggagaggagccatcagtgggcctcatgtgccctcctgtcccgtcatctcttccctgggccccgtacatgtgtgaacggagaagccggcctcctgcttccaggggtgccaccgccactgccactgccgctgcagcaacctctgtttggcatccggcccgaaacacccctgcctgctctccgcttccttctccaccccagcttgtgggaaaagacgaaggaggccccgggaagaggcccaggctgcagcactgcgtggcccaaagcagtgcacagcacagctgggccccagaggctgagggcctgcccttgctgctgtggggatttcctcctcggagtgagcaagcaagagaagtccctgcatctgttcattctcctcacctcccatccttcctaggcactgcttgcctggcatcaactctttttttttttttttttttttgagatggagtctcactctgctgcccaggctggagtgtagtgatgcgatctcagctcactgcaacctccgcctcccaggttcaagcaattttcctacctcagcctcccaagtagctggtattacaggcacatgccaccatgcctggttaatttttgtatttttagtagagatggagtttccccatgtcggctaggctggtcttgaactcctgacctcaggtgatccacccaccttggcctcccacaatgctgggattacaggcatgagccaccacgtccggccctggtatcaactcttgagactaatcccttggctgctcaagcatactccactcgcacttcatttgggtaaaccaccgtcgggctcatctttagcacacagaagatacacgttcatgacaggaaaattagaaatacacaaaggagcaaaatattttggtgtatatctttacagattttttcccctgtgcatttttatgtaaatatattttgacttagatgacaccatcatacacatcctgctttacgggctgcttttcactgagtgatgtatagaaactgtacacaatacaggtttataaagcatgttaaatactacatgtctcagtatgatttgtaatagctgcatagtatttgcttgaatggatagattacaatatgtttaaatatgattgatgggcatgtagattattgccacattttcacccccatactcaacactgtgatgacacctgtttcatatacatctttgctgtactcgtgcaatttcttcctcaggctacttggctgcgaggggaattactggaccagcaggcctgcccttaagccttttgatacatacagaaactcattctgtcgagattcctggtttcccttcccacaagagccaccaggaagccacctctggaggggtccacattccatccttcaaggctgcttacatccgtagcaagggtcttcctggctgtcactgagtggagggccactctgccctgctctctgtgaagggctggacaaggggaggggacggtggatctgggaggagacctgggtccgagcaggggtaggtggcttcaggcaatcactccctggtggggtgtgctgggctgtcacagggtgcctgggcttggtccttgctgaggttgggggaggagcagggcttgcctgggaagacttggatctgcaggtctgtgcctggctgtgggagttaggggaggggagcacccagtaggagcagggctggcctcgacgtgccgggccctgagggagaagcagggcttagctcggcggaagttggaagggcatttcaggtgggcggaccagtataagctaaggcacaggcattcacttggcagggctaccttccagggactccaaggcacatggtctgcttggagcacagtgtcggcattggggggaaagaggctggctcaggggactggtgattttgctcccagtcttagaaacagtgtggaaccatcaggtgctgactgagaattgaaggctgatgtgggccaagtgggattagagaccaatgagtgttgcctggaggaggtgcagataaaggcagcaggccagggaccagggaggaggtctcaagggatcgtggcctagaccagggcaaattggagggagaagtcagctctgtagatgggatgtacattccaacctcatttgcccaccccacccaccccaccccgccccatcccatcccatcccatcccatcccatcccatcccatccctcccatcccaccccactacatctcatcccatcccatccatcccatcccatcccatcccatcccatcccatcacatccatcccatcccatcccatcccatccatctcatcccatcccatcccatcccatccatcccatcccattccatccatccatcccatcccatccatcccatcccatcccattccatccatccatcccatccatcccatcccatcccattcatcccatcccatcccatccatcccatctgatccgtccatcccatcccatccatcccatcccatccatcccatctatcccatctgatccgtctatcccatcccatccatcccatccatcccacccatcccatcccaccccatcccactgcctgacactcatcactttaaaggctccttgtcccaaagaactgccttacacttcatcgtgtggaaagactctactttggcagagatttttctgactctttcatatttattgtctcatcaaaaaagaaatttcacttgtgagactcagccaggcgtgagggaaaggagcccatgcagaagcaccagccctggtctttgtctggcaataaacccggagtcttctgactggagtctcagctataaagacgggactgaaggcagcatggtgccctctgcaggggacggatggtgttcccacccagccctgccctcctttgccatgggtccctctgcctctgtcattctgcatgtgcaaaagtgtctgtcttgactttggaagtggcttatttggtcctgatttggcaggaaacttctaggcaatgtggccatcaggtttgacaaggggtaactgatgagtccttgtgcctggtactgggcctgggatggagtccacccccgaaactgtggatgaccgtcacctgcttgccacgctcatatgtggaagctggtggctacagtccctgaggccttagaaaggagtacgtctttgaggtgcccagcgcaaaataagtcatactagctagtacagcctagcaaggttagaaggaacctaaagacgaaagactaggaggtcctcctgcaggtgaaaagctgaggcccagatgaagtgaggaactgtcccaaggtctgtagtcagtcagtggcacccagagactctgcacatgtgccctgcccatggggccactccacaggttgctgggatggggacagttaggcctgtatggccctaggaacacctgtggagtgagcgccactcaacagaactctaacgtggcagctttggtgcagggctgggcacgcggggctcccatttgcagtgatgaggtgccattcctggcacacagcaggctcgggctgtctgggctgctcgttcagtgcagtttatggaagagccagctcttgctgatgtggcaaatttggtttgctctcgtccccctgccctgcccatttgagtgtgcccctgacctccacagaaacacatccaggccctgccagctggcagcagtgctgagctggtcagaccctagccctggaggggcccaggggatgaaaggccctggagagaaaggctcttctgctttgtgactatgccagcacaaccagggccctgcttcctgtcatgcccacaagcctgagcccccagcccctattttgaggcccaagggttcggctgtggccactcagggctccctgcagctctgggtcgctcccagcctggagagccagcttcatcaccctgggcccttctccggagcaaatggccctcgagaccaccacagctcacccctcatgggcacgagagggcagcactgggctcaagggcagagaggctgaaggcagtgtggcaccgtctgggcagcatgagcagcaccgggctcaggggtagagcagggcgagaagacacagaggaagaggaagcagagctcaaggcagctgtgggccagggcgtaaggaagcctaacttaccacattgccacactcgcctgttccctgagggccactaggatttggcagtggggccctgggctttccccactgaaggtggagccaacccccgaaggaaacagggctgcacaccccagaccattcttggcgctgtttgaggaccaccgcgcctctcctagcagatgacttgagagctactgctgcttggctccttttcaggtggtgccgggtacttataggagcatcggcgcattccatcctcacagcagtcctgaaaggtagaattttttttttaactatcattttacaaatgatgaaactgaggcagctcggagaggttagctgacctgcccaaggtctgtcagaaaactcctaaggggtgagaagcaaggtccaaccccaaagcagctggtcccccagcccgtccctctccacaggccatctgcctgccctgaagctgttcggctttggatgcactctctcccaccctctgagtccaccagtgccagctgtcttccccacaccccccagcctgagccaggctgttagcactctgtaggagggctcatgttctcccgttatcagtgatcgctttgaacagacagtccctggcagcccctgagctccacattctctaggtgagcagccctgggcaggcaggtgggtgtgccgctgggcagcagcaggtacagtgagtgctggccccctggcttctgcccatacttagcactccaccaacgcttgccacccccgatgtgcagagggcagtctggatgatcttggtgtaccaggacccatatggtcacctgcaagacactacaaatgcatgaagtgacagcatttgcttacctttatccccagaagccctgctgaatcaagtgagaggagagctgcggagcaatcaccatgagtatctcagctcttggaggccgcaccaaaggtgaggcctgggctccctggtttcccaggctctgtttggggctgtttgcttccaagcctgcccctacaggccacaagcactgtcccagcagcaaagggagagcagcatactgggagaactggaaaggaggtcgagggtcctggggctgcattcctcttctgaggcggttggcttttcccaccacagggaagcctctgccaccaggcgaggaggagcgcaataacgttctcaagcagatgaaagtgcgaaccacgctgaagggggacaagagctggattaccaagcaggatgaatcggagggtcgcaccatgtaaggcaaggaggcggggagggaccgcagcaacgtgggggcgcgcaatccgtgggggaccgaccatacctggggatgcgaaggggcttccaccattcagagctccgccaggccatgtggagggcagagcgtgggaaaggctatccagcaatgtcacagggtgggagagcccctgggtgcctgggaaggagaatgtgtggcagaaatggcaggacttgctgggcagcctctaggatggaggccacaggatggcaggtgacagggagtctcggagccaatccttcaggatgcctctttcccccagagagctgccctcaggccggagtcgcgccacatccttttcatcagctggggaggttccgaagcctaggtaagaggtggtgctcaggtggctggtgggtcagccccagggactctcctgcagcttggggccagccctcaacagggaggggtgggcagtccacaggggacagggatgcagccccagccaagggtctgcaatgagtaatttgaaatctgcaggaaggaggggcttctccactgcaccttccttttgggaaggggagtgtaggagtcacttggtccaggcccttggcctggctgtgtggctgtggggcagctgacttccctgctgggcctccgtggctccagctgttaactgggattgaaattgtctttaagaagaagacgacctcccacccattccctgcagggagtgatactgcctctgagatgctttgggcagcttccagagtcacagtgactcactcctgcaggtcaccctgactgcttgagtgtacttgggactcagcatgcctgtagagaggcacgagtttgctctgactgtctcccaagtttaccgtgacatattttgtcagctgaccaaggagaactggcttctctctcttttgggggcttttccataacagtgtctaggggggctctgaagcgtgggcacaccctgctggcctctggaggaactgctcctgacagagaaagggaactgaaattcaggctcgctccttgctccaaacagccggcaggcggcttctcagggggtggtagaggcagtggcggcctctggaagggagggcctcaagtttacagccagcacacagggctacctttagtaactacggtctctctgtcacccctcgatgactcagcgcccactacctgccaggtcccatgctgggcacagaggatgcaggagtggtcaagacaaaggccctgtctttgggcaactgacgtcccagcaggggactcaggcaggaccctagtaaacagttcaatacaaaagcgagaacccccaagtgtgcctgcaacatggccacctctgggaggctgtcccctgttagagatggagattgtggggttggagactaccggaggctctgtgttgcccttgacccaaaccccgatgctccagcccacatcccctccactgcaggacagaagggtctaccctgaccccttgactcctcccctaactctgaggaggactctttgcaggggcccctaactcctgcccggaggccagaacttccaggctgaccacccctggctgtcagctccctgcccgctcgtcttggctgccccctgagttatctgagccccctcagttgctgccaagcaggaggtcccaagcacccagagcctaatgtttcccagccgctgaacaaggcctggccgcgccctctcgtctcaaacttccaccaagacttggggtgtgggcatgcaaggagctggagcaaagagggccccgagggacaggaagggggacagctggcttcggctggctgctgcctgggctctccccttcaagccctcatgcaccttcctggtggaggctgttgagggagatcaggtcagaccccgggctgaggggaagcctctggctctgactggggagcctccagcttgcactggttcagccccaagcacagaggatgggagggctgtcagctgagagcagtgctccgtcggcgcagcactgggaactggctggccaaggagaagctggactttggagaggccatcaagctgccttcctaggcacctgccatgaggagtcacctggggcacttttcctgggggagcatgagggaaataggcagagcatagcgggcacctgatcaggggcacagggggctggcacccctcgtttctgctgtactgggacacctggagcacttgccagccaatcttatttgctatcgttaagggcaggataaagtaggatgacctcagccctccagcaagcctcgcttcactccaccccttcttctcttcggcaggcctccgagcacaagggctcccactggctacatcatccggtaagtgaccgcaggactctgccggccttcctgtgcccactcacgccaagccctgacttcttacccctccagtccctccagggagctcaccggcatctcctgggctctctttcaggggagtgttcaccaagcccatagacagctcttcccagccccagcagcagttccccaaggccaacgggactccaaaaaggtatgtccatggggtgttggccagtcggccagtggggaggtgtgagggcctggtctgggctcctggcagagacagtgctctgcctatcaggactgtggggccttggaggtgccagctttcatcctgggtagggcaggaccctggagagcagggtggggtgaccagaggagatgggctggggtgggactggcagtcccaagtggatgtgtgggtctctgggaggtcctgggccactaacagtgtccttgtcctggggtcagtcctgactaggcctggctaatgggacagagaggtgcaggagtttgggaggggctgggtgtagagtccccctagcctggcagtgggcacccttgacttgacttgctgatggcattgagaaggctgaagttgcatgcaattcaagcaccttggcatcaggcattgcctgggactccgtcagactggaaaggccaaggggacccggaaacaggaagcaaagacacaggcaagagcccgctgggctgttccctgaagctcggtggggtttgcctacacagctgctctgagtggcgcagttccgggtgtctgtcagggccaaaagcaaagaggaaaggctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagatgaccactgaggattacaagaagctgtgagtatgcaacgccaggctcagcgtggttccctcctccaaggaacaagtccaaactctgggtccactgaaggcagctgactacttgccaccgagcacagcccgggaagtcccgcctgcctgacactccctgccagttgcagctgtggcctggagcccaccagagggtaacaagccccagaaaactggatggctgtgcacattgcacgtctgatccgaggcagagcggagaccgcaggaagcttgtaggaggggccccacggatctggggaaagggtcatgggtcgtgaggctgctgctggctggctgtgcttcctgggcttggccctgcacccggccgagcctcaggtgctctgcctggctgcactgggctgggggcctggggatcctcagggtgctgctgtcagtctgagcattgtgtgcctaaatctgagctgcttcttggatagaaaccttcgggttttcccttagtgctccccttggggtccctttcaaagccccccaccccccactgcatgctcagggaggagggttctctggacagaggtgtgaattgtgtctctagttcccaggggaccacatctttccgttgtttgtcccttgcctccatcatccagggttggggagctgctgggtaacctttctggggaaggggagaggctcgaacagggagggaggggagagctggtctcagggaggaacaagtggcatgacctaaggcccaaaggcagagatattgacttgcctcgtcattgttgttgaaagccaggaagccaagctgctgagggtggcagcctatgacaggaaagcgcctctcccctctcttagggcaccctacaatatcaggcgcagctctacatcaggggacaccgaggaggaggaggaggaggaggtggtgccattctcctcagatgaacagaaacggaggtaatggaatggtgccttttgggcatcccggggggcagggcaggagcctgagtcttcgaagactgctggaatgaattgtactggttggggtgacaaaatgcacaacacgtaggccatcagcggtagcccacggagcatgagaataggtgtcattctctgagtgccagaaccacccactcagtgttggaccagctgaggggcccttgagaaccttctgtggggtagaacctaggtaatgtgggtccggggaaaagcctcctcatgtggaggctcttcagggctctaaatcggtttgttagaaagggccctgagacagttgaacaaaaatattcagggagaagccacctgcacagtgccctctatctgcatgatctgcatgccttgggggttctgaatgccccggaccccaaactgagctccaggcatgcacagcagtgggagtgtgccccatgctgctgaaattctaccctagtctctgcgccaagctgccctcgtccacacaggccagcaaagttccatggacccttgcccctcctcagtcctctgtccatggggactgaccacataccacccagtgctggtgaactatgacaggaagggtttgttaagcaccttttgtatgcctttggcttggggcctgtacagcagttgggccctgaggaaataaagccctcccctccctgggctcagccagccaccaggtccatatctgctgacccatctgtggcgcaggaatcacagcaaagccccattgccaaaggccctggcagattggctatcctcagggaacagttcacagtggcaggggcccccaggcctgggtggagcaaggaaaagagccagaagctaggagctgcctagcattgaatgccagctctgccacctgctaggtgagtgctcttgggcaaataatgaaagcttcttggactcagtttcctcatctgtaaatcacagaggatactagcgtctactttcctggattgagaagagcaataagccaatgcgaggatgttggcatctggcgcagagccgggcacatgccacatgctccataaacatgggctgcccttccttcaggttctacatttcctttgaatagtccttggagcaggtgcaaatctggtttctctcaccccttgcctccctggggtggccctaagtcaccccgagtccatcccaggctaggctggcagagcatgtccagcttggcacccatcagatgctcccccatcccgtgtcaccccaggtcagaggctgcaagcggtgttctgaggaggacagctccccgggagcactcctacgtcctgtcagcggccaagaagagcactgggtgagttgccaccaactggctccaggctctaggacagctctcctctcctcagagctccagccttctctggctgatgaaagggtgggtggagagatcacccccaagggccttcctagctgagccttctcagattctcagatgtactttctagaaaatggagaggtctggcggctaccaccagggacagtgaagtgccgggaatggagagggcccaggaccctctgaggtagagcggtcttgatgtcacctgcccacgggctctgcccaaagcattgcctttctgcttcctttccagcagtcctacccaggagacacaggcaccgtttatcgcgaagaggtaagtgtcatcaagggacaccttggaggcctgttactggccacaggaaggccttccgtcagcaggggtgtagtgtgggagctgtggagaggggatgtggatgtgggggactactgtccctgagcagggggagttgtgaggggctgggggcttctgtctggaggcctggcaagcacctgggtggctgtggtagcatatgtggtcaagctcttccatttgccaatggctaatggggctgggcccctgacccaacgtggagcatttccaaggccctctgggagttgttcccctgcccctgttgcttgcctgatgccttgccttctgctctcatccaggatcaaaacctgggccatcaggagaacttcccctgggaggtgactgtgacattggagatgggccctaaagggtgaacagggcttaacagggaatgatcagaacgtcgggatactccagctgaatgagggaggggtgtcaccattagttgagacagggcaccttctggaggaggaaaatattcgggggaaagcaagaaagaaacttctggaaacttgaatttgagggacttccagttgagtggacagggaaggcctctctctgtgctgaggtggctagctggggactgcaaacccaagagaagacagcatgccaactgccccaggcagagggccccagtgcacaggcccggggtgggactagcttgctgtgttggaagaccaggaagttggcaggaatacagagagcagggatggtggcagcacaaaggaagtgacagagaacggggggcggtgggggggtcttcctggctgcatttggttcctgtggtttctgtaacgcagtaccaaaaactgagtggcttaaaacatcagaaagggattctctcccggttctggagaccagaagtctagatcaaggtgttagcagggtgggttccttctggaggctttgagggagaaaccatcccaggccactctcctggcttctgctggtggttggtgatccttggtgttcctcggcttgtacctgcatcactccagtctgtgcgtctgtcttcacatggccttctcttctctgtgtgtctgtgtccagatttccctcttcttacaaggacagcggtcattggatttaggacccatcctactccagtatgacctcatcttacctgattacatctgcaaagaccctatttccaaataaggttacagtcacaggttccaggggacatgaattttggggggacactattcaacccagtatgctgtccttatcctgagctggagtcactgaacccccagcctgggccacctcttggccgtgatcctgaagggttgggtcagttagacgccactggaagcatgttctttgaggcctccaagctctagggcagccaagaagaccacgagcgctgtttctcttcttgctcaaagggtggaggtggtggaagaggacgggccttctgagaagagccaggacccacctgctctggcaagatccactcctggctcaaacaggtaatccattgcgctcatctctgcctggggctggtggctgccatacctgccactcagtcactgaggaacctcagtcagggcacctccatgctgggcttcgagatcagtgtccccatgtgcccagtgacaagacgggacaaagaaatcagtaagagcccatctggctggatgtcccagggctgaaaggagcaaaacagtccagccccccgggagagagcacctggctctggtctgatgagtacgtatctgtgtcaccttaacccttgcaccactgagcctggtggcaacttgaacaccccaagaaaaagtaccatccttggggtttgagagggccagccaccatggcagtagcatgccattgtcagacttgctccttgcactccaataagttagccacattcagcatgcccagggaggaggctctgacatctccagagcctctcacagccaccttctttgccagtgcggatggaggcaggaccaaagcgtctcgggcaatttggatcgagtgcctgccaagtatgcctagccccgctgggagccaggagctcaggtgggtgccgagagctgactctggcttgtgagtgggtgtgatggcttcccgccagcctggctggctggttctgccagctggggagggtctggcagtggggtgatggggcaaggacaggctgagcactggtgatctcactccaggaagggccgtgatttgtcttgatttctgatccctgagaatctgggcagataatggtgctctcttgtctgtggacaactaataccttcttgtactttgtgcagaatggtgctaagtcctgcagggagagccaccacctgctgttgctgctgtttaaagtgcctgcctggattgagacctttgctcaaatctaggtctcctaagagctgcatctctgtagcacccttggaagacccctgcatccagaaggggagagggcctgtccctaccggtcacttcccaggcccccaagggctgttcaggctctcctaataccatagcaatcccccaatttgagctccacagccatttatagacaggtgaccactgtcctcagggttacttcctcagtctgggagggagacagaaatgctggcagagggagccaggagcatgaggccagctccctccatggccccaggcagcagactgccagggtgcttctccttttcactctctccctctcttgatcttctctggttgtctgactctccccataagaactttggtccatagaagatgtggaaaggaagatttgagaattctttacaaggcaatatctagggcagagctccccagtctttttggcaccagggattggtttcgtgaaagacactttttccacgggacggagcaggggatggtttcaggatgaaactgttccaccttagatcatcaagcaccggattctcataaggagcgcacaatctagatctctcacatgtgcagttcacaatacggttcgcgctctcatgagaatctgctgatctgacaggaggcggagctaaggcagtaatgatctctagcttacctcctactgtgcagcctgattcccagcagaccacagactggtactgatcctcaggctggggttggggacccctgatctaggggacttggcaattgagggatatgggggcaaaggctgccacaacaaagtattgtaccacaccctggggcgcttaaaccacagaaacgtatcatctcccacttctggaggctagaagtgtgagatcaaggtgacggcaaggttggttcctcttgagtctctctccttggctggtagactccatcttctccctgggcccttatatgctcatccctgtctgtgtgtgcctgcgtcctaatcacttctgtttttttgagacagagtctcactccgtcgcccaggctggagtgcagtggcacagtcaccactcactgcagcctcgaccttccaggctcaagagagcctccagccttagcctcctgagtagctggggctacagtcacaggccaccatacccagctagttttttttttttaaatttttgtagagacagggtttcaccatgttgcccaggctggtctggaactctaggactcaaatgatcctcctgccttagcctcccaaagtgctgggattgcaggcatgagccaccgcgcccagaccctaatcacttcttataaggacattggtccaactggattagggcccaccctaacaactgtattttaacttagtcacttctttaaaggccccatctccaaatgcagtaacattctgaggtcatgggggagttaagacctcaacatatgaattttgggtggcacaagtcagcccataacagtatacagttctcatttctccttatttctcttttaaagaaaggcaataaatggtttcaggtgcctttctgtttgttcgtttgtttgttttgtttgtttttgagatggagtctcgctctgtcgcccaggctctgtcgagtacagtggtgtgatctcggctcaccgcagcctccgcctcccgggttcaagcgattcttctgcctcagcctcccgagtagctgggattacaggtgcacgcgaccacgcccggctaatttttgtatttttagtagagacgggtttcaccatattggccaggctggtctcaaactgctgaccttgtgatctgcccacctcaggctcccaaagtgctgggattacaggcgtgagccaccgcgcttggcctcaggtgccttttagaagataatataggaggctgggcatggtggctcatgcccgtaatcccagcactttgggaggccaaggcaggaggatggcttgaagccaggagtttgagaccaacctaggtaacatagcaagaccccatctctacaaaaaaataaaaaataaaaattaaaaattagttgggagcattgatgtacacctgtagtcccagctacttgggaggctgaggtgggaggactgcctgagcccaggagtttgaggctgcaatgagctgtgaccgcacccttacactctagcctgggtgacagagcaagaccctgtctctaaaacaagaaaaaaaagagagaaagaatggaggagaattagattgtgctgtattatagatttaaaaggcactttgacatttattccacaaaattcctttcgatgtttaatccccatcatatggttgtcattgcaaggtggctttttaagtttgctcaggttgccataacaaataaaggctagagattcagggtccggggcaagctcccaacaggaggctcagcttgatgcttctgatagttctttcctccaattctggtcactcaatatttggagctcacccaggcagcttccaggaaagctgctggctgatcctgaccctggagggccgtcttctctgaccctaccacgttaggtgctgcactggaccaagcagccaccatcagtactcccaggcccagctcctatctgcctggtgtctgagaagcccagcccgtgaggaacaatgactcaatcaaactcagggtcctgcagcacttcagaaaaggctggtttgtggcagagtggaagaggagaatgtcacagccttgtccccaggcacagacctatcgaggctaccctctccccaccccctgccctgccctgtttcccttagctacagtgcaaaggtcagctcctcataactcttgccccccttgcaacctgaacccagtttagggaccctctcttggagaaactggttctacacatgcaccccttctcggcccccaggcctggctgctttacccgaagcactggtcaagcttgcctcacctgaccagggcatggcctcctgggtcccggtcctaggctctgcccagcatgctgcctggcagagcgtctggggagcagggagtaggagcacagcttctggcacaggacaaaaccctggctttgcatcagactgactgtgtgaccttgagcaagtctcttcatctctccatgcatcagtttccccgtggataaaatagggagagcagtaatagctacttcccaaggctgtcccaaatgctaaatgagatcgtgcacctgaagtacttaccacagtgcctgggtgctggtatcctcgggggctcccagtcataggcgtgctgagctgcagggcccttattcaaatacaggaagagatcaatatctccacctgctggcatttgagggaaatgtggccaaaggcagtgaaaaggaggtatcccctcgccccacatccccgcctcctcgctctttggcagaatgagtcacacactgtttggcacaggccacagttggtcgcattcccacaggtggctgtgatcagttttgggcttcaggcttcagcagatgcctgcctctcttccttgggtgccttccaagggtgtgcagccttccagcgtggtcctggacttcagcttggactggagctgtctgtggttgagagtctggggagatggtagggtagcgggttgtgggggaggagagacccttgtattagtttactggagctgctgtaacaaggtaccagaaactgagtggcttaaaaccacacgcatttatcctctcacaattctggaggctggaagtctgagatcaaggtgtcggaagggccatgctccctccaaaggctctgggggaaaatctgttccatacctttctcttaccttttgttgcctgcaatccttggtgtttcctggcttgcgcccgcctcactcccatctcggcctctgtcttcgcgcagccgtcttccctctgtgtctgcccacattgccctagtctgacatcagtcactggagcaggctggggtgacactttgttcccatttcctctgtgacagagccagaaacgccagtgagaaaatatgttgtgcttgcctgtgacatccctgttccctggcaccacctgatttaaatgaggcagccaggggttttatactgtcatcataaatgacatcatcctcaacaacgatgtcatcgtcgttatcacgagaggagatggggagaagtcagagctgtctgtgtgtctagggcccctcctggctttcatgatgggagaggccttgtccttggtagcccttccatttccctctggtcactttgagcactccaggccctggccagggtggaagtggagggacagagatgagcagcccgctgacccagccctccatggctcattccttgctttcaccttggccactccatcccctacccctcctgggacccctgagtggcctctttaaagtgccagtctgaacctataaaccccccacctccacttcaagcccatcctgcatcttccctttgccataccagatctagtctgtacattcaggacccctgccagcctctacctcctcctcctcccccgatctcccttcagctggcctgggtcgggctatgcctccatgaagcttgtccactgctcccatggctaaacctgttctgggccctgcagcacagcaaggtcagtttccatgcctctctgcccctgcctgaccctgctgggcccagagcttcaccagggcaggcctggggctcaggcttgtctgcacttccagggcccagggacaaaggcaggagtgactgcaatgtggcttggaattaggctttgctccatggacctaaggaggtctggtttggggtgaagggtccacccccagaaagcctgggagctctatattctctctggccctggccacaccatggccaagcctgctgggcgtcatgccttgcagtacggccagagaatgcatcagacttggagggatgtgtgtccggggtggcctgtggtcatctgggggagggctctgagcgtggctggcaagaggaaagctcaaaggggccctttgtcctcatccccgagtctgcgacatcccctcccactggttttcattccatatttggtctgtgggttttctcagtctctcgtacccctcagtccccaccagtccatgaatgcagaactacccctggcctcacaaatggccactttggataccctggtggggtcacaggctgcggttgcccctgcaaatggttggtagaagcacgggttgggaggtttcatttctacccagaagggcccttgctgtgcctgagggagggctgggctcaggtcaggggtgggagaccggggaaggggcctacaggtcagtggcccgagctcagctgcagcaccaacaaggctcaaggccaaggaggagatgagagcacatcaaaagggggcagtgggtctgggcggcccaccgcactcaccagcccaagaagggggagacttttctcacctgcaacccactgggtctctcctttggcccgcagctcaagaggtgaggaaattgtccgcctgcagatcctgacacccagggcaggactccgcctggtggccccagacgtggaaggcatgaggtatgggggtcctgctgctgtcctggctccctggacaccattctagagatggaagcagcagcctcaggtggcaaatgatgaggcctagggccggctctgccactgtagggccaacaggttgatgggaggcatggtcgacctgggttttctgccccatctcattctttcactcagaaaaccattatggagcaagcgcttagtctgtgtaagggcacaggcccgaccctgggacacagtagtgaacaggaccccctggctggaattgccatctgcctggtgggggaggcagacgccgacatgagcatgaatgaggtcagccagagatgctgtgtgccaggagcccctgggaagtgacagctcaaccctgccaattgctgaagatgggaccagtcagccgtgctggggatgttggtgggggtgggaggaggattgggtctaaggagcccgtgaaggccactgaggccattgccctgcctgtgtgagagggccactgggaatagagtggggtcactgggtcagagtccacagctctccatgccactaggctctgtgctggggaggggtgggtcaaggaggccacaaccagcagggagcacgaggggctcagcctctgccctggggtgggggtcagacagccaggtgacatgcaggcaggattcgggggctggggtggaggctaggagagatccgagcagggagactgggcccctaccttgtgaaggccagggactggggagagaagcgggagtgtacactgaaggtcatcccttaatccctggggtggcaggaacttcgagcagaggcctctcaacagtgtggtgggtgggagtgcttggggagggcttcctggaggaattgacatccaagatgagtcctgagcgatctctaggtccctttaccctcctccttggctcctcccactttaattctgcccccaaggcaccaagtcctgtccactttattttagagatgtttccatccctattgctctgcccctggcccaggcctccactgctactcacccagttgtctgcgaccgtttcctactgtcccatccctggactcccttccacatctacctgggtgatgtttccaaagggcagaagtagttatgccagccccctgcagaaagccctgcaaagcccctcccactatgctctgcagcctgaactcagtacctggccccacctgcaggctcctccctccctgggcctttctctgtgcaggctggaggctctgcctgagatgccctttcccctcttcatctttctgttccacctcaaatgtcctgtcttctgggtcatgtccttctcctgagtttcttccccaggcagcatctgagggcttgtcgattctgcatggcagcatccattctgcatggatgtagatacaatcactatgcccattttacagattaagaaactgagaccctgaatggttaagtaacttgctcaaggtcacatggtccagagcaggcagatccgctcagcctgccctactcccaccttccaccttctgcaccatagctcattgtactagttggggcagggagcagggggacagagaggggtgatggaaagacttggcatttgctgagtgaactcatttgacgagtttattcgtaggcattgaagtcaaaatttccaggagggaggtattttaaggtttgtgattgaggtttgagagagtgattagggctcaagagatttccacgttatatgcagacagaatagagctgaaatcatgagcgtaaactagctttacatggggctcatggtgagccaatggaagctgggcaccgacctcagtatgcaggtggcagccacctggccagccctcctggggacagctgggcgagggcagtctcttctcgccatgttgagagtgggcctcctgagggccagttgggagttagtgggtgtgcaggccagtataaaggagaggcaggaacaagtggagatccctgcttcaagggtggcagttgacaccttgggaggggaggagacagcccagcaagtggtggagcacgccaaagggaggagaaaaaggcggagaccaggaaggtgtgtggccagggaggtaggcaggtggtgttgacaggatcaagggaggaggggtggtgagaaggctggagtggcccactgggtcagcagtactgaatggtggtttgaaataatgatgggactgtctctcctggatttgacaacatggggctccctgaggacctgaaggagaacagaagggggcttaaattaggagattaggatcagggatatagtccagaactcaaatcccagctactcctcttattacctgtgaaatttggggcaaatcacaggggctttgtgtgcctccgtttgctcatctgaaagatgggcatgggtgataacagtgcccatatcctggggttgatttgcagagttaatgcatataaagtcacgagaacaggctcaaatgctcaatcaacagtagctattgccaggcacagtggctcacacctgtaatcccagcacagtagctataaaacaacaacaacaaaaaacaaaaaacagtagctattagtaatgaagttttgataattggccaatctgtcaatcagcagggtttgtttgtttttggttctgttttttaagacagcatcttgctgtgtgtgcccaggctcaagtgcagtggtgccatcacagctcgctgcagcctcaaccttccaggttcaacctcccaagtagctgggaccacaggcacacaccaccactcctgactaactttcaaaaatatttttgtggagatggagtctagctgtgtttctcaggctggtcttgaactcctggctcaagtgatcctcttgcctcggcctctcaaaatgctgggttataggcgtgagccactgcacccggcccagtagcaggttttaagctccgtggagacagctggcgtttgaggatgaggtaacagcccacacctgagtgtgaatggctgctgcatggttaacttccatttctttcctccataggtcttccccaggcaacaaagacaaggaggccccctgctccagagagctccagagggacttggctggtgaggaggctttcagggcccccaacacagatgctgcaaggtaactcagtgcaggaagcagacacttcattcccagaacacggagcccacatacacccagctgaaggacttccatggcctccggtgcaatgtcaatggatgcagctggggccaggaaggtcctgttcccactgttcccccagtacctggggtactgcaggtctttaatgaacatctgttgaaagaaagaaagaatgaatgaatgaggcctggagggaggtaggcccctgccatgattcctcagggagccagttagagagcaggaccaaactccagggcaggctatccccagctcctggcctgtgctgagttccttccattcccctgaagcttccacactcactgtgcttttactgcaggacaaagcagccctgccaatggccagggcaaagcaaggccaccaagctggcagtctgggagagtcagtgaccaaagtatgtgggcccccatagagcatgtagcggagactttcaggatgacccgtggactaagggagacattgtggcaaggggtgaggggtccaggacgggaagttggagccatagcggtggatgatgagtccagatgggatgattgtccccagtcgctgcacagccagcccactgacctgtcctccaagccagaccagtgccaaatgtgtctggtgagcagtggctgcaggctgggcatttcttcagtgagaacctggtagccagttacagctaagaacccacacacccgtcttctcagtgtggatccctggagcccctagctggaaccctgagccctggaaatgaggaaaggaatccctctatggcttattaccagacccacatgtcttgccccttgctctgttggcaatcagctccccccaccaccaacgaactaacctcctcctgactttccaccttgctcccaaccaacccatcaggtttggaaaaaatacagaaatacttcctgttagagtcaacttgggcttggctcagctctggtcagagcagcacagagtagcagccaaaggcctgtgcttctggtcttgaggcccactctcatggcatctgggttagatgagatcaaaacgcaactagagtcagcaaatactccacttctcataacaggtcaagtgcacagttgagtgatggcaatgtgggatccggagccacgggctcccggcctgaaggcttggctgcagtagacatcggctccgagagaggaaggtgagctgcccgggggaggcaggttctctcatgcccctggtgacagaccagggtcaagctgccaggctgcttgggctgctatgggtggggcactggtcacttcctatggctcctgtctactgcttctcccacactcccacattccaccacatcctgtgtccttgggctttccactttttggaatcttgttcatttttctgatccctgccactggccctcaagctcctccagagtaggcactaggcccactcacagctggaggcccagccctcacatggtgctggtcttgggctggtcaaatgaacgtgtagggaatacatgaagggacaaattaatgagtgaatgactgaatgatggaagagtcggcaccttcttacttcttggttaagctctgaggaccagctaggaggccctttgctcctgctttctcccttctctccttttcctgccccatccctaccccaggcagctctgctctgaggttcagggagaggaaaagcggtagccctggagagaccagcgtgtccagctgggctctggcttcttggacctggagggagtcaggggccactttctcaggtgatttgcagagtggcaaggtccctcttgtccctaagtggttccaaaccaagcctgaatcattcttggggcaaaggctaggtatgcagatgttggcataaatagtttagctccaaactatgctagagtccttctggttcagagcagatggctagggaggagtggcaaagccagtgtctgcaaagagctacaaccgcaagatatcatctgcctcctgcatcctactgcagtctggccaaggagggaatcctgtggggaaggccctgctgatgctttcctacttccctcagcacacccagggcccctttccctcactaacttcaatagtttgcaattcatgccatggaaccagagcccgaattctaaatccaggcccacaagtcaacacaggaaggggacagcaggtcctggcctctgaaaccactgtctccgagcaggtccaaggagaggccaccagagactctgttctttaagctgccactaatggggaggactccgctagagccctgtccatgcagcctgcatctttttgccatctgcagaggcattggagggatctttttaaaaataagctagatcacatttctcccctgctaaaaccttctagtggctctccattttccttagaatgaagtccaaaccctttcccatggcccactgggtcctgcatggcagaatctttggccttctatccagtcggggctcctgctactctccccacagtggtgcagcttgactggctctgctgatggctgtcgcggaagagacttctggtctactgtgattgggtggctctggtctcctccatgtcaccccgcctgcttatacaccctcataacatgaagcctgtgctgt

SEQ ID NO: 837 - DNA, 6475 bp, Homo sapiens
gcctgacctttaaccttcaggttagccatgatggtaacattgttttggtcattggcagccaggcagaagtagcgtccggtgtcattggcctggaggtctcgaatgcccagggtcccattggcataggggaagaagcgttcgtcctgaagcactgttgtcccatcctcgtccagcctggagggagcagggcgggcctggctctgactggctggcctgggctccctgccctccctggctccctggccactgggacacgacactcaccactaccaggacgagacactcaccactgaacactgggcacaggcgctccgaaggccttgcacagaaggtaggcagtgctgccctggacagccatgtacgtctgattgtccgcagtcaggatcttggctggcagctctaggggaggaacagcctcaggagacagggcaggacttgggaccacagctgggccaggagccagggaccctctgcacggcttcctcgggcccccaagagccctgcaaatcttggttccctgctcccagctgaggcccccgccaggctgtgtctctctctgccttcagacactgccctctgcctcagatgcgcctctggtcacagccacccaacttttacgttattccaggcctaactgacagtcacctctccccagaagccttcctggcctagtccccagccttccctgaagttccaggagaggtgccacctgggctggccttggtcacatcctgtggcacagcggtccgctcagtcacagtgacaagacctttcccctcttacatctccctcggctatcgtgaggctgagtgagatggggcgaagggtgtcagcaaggagaaaggtcggcgccagcctggtaggccgaggacacatcagctgccagctgagccactctggtggcctggcccagtgggctgcagggacagactgggagttaggaggtaaggaagggagggcactcacggacaacgtagatgtaggcattggccagcaagagcccgtgccggttgcgggcctcacattgggtcaccattgtgtcactgggctgcacgttgctcaggatcagggcgccacgctgaatccggtacttctggtctttggccagctctgtgcatgcagcaggtgggcccatgggccacagcccggcattgagctgcgttgaggcccttcctcaccctcctcttcctctcccccacagcccccagggctcgccacactccccactcctgcctgaggccctgctcaccctccacagggatcccgttgattctccaggtgacctctggttggggcctgccctggacttggcagtccaggcgggcagtctctcctggcccatatagatggctctggggcttgtgcagccagtacggggcagctgggaggaaggggagagccgccctgagcccgcagccagcagctggctcttgacccggcgcagaccctcccctcccccatgacagtgggcatcacaggccactgtcccaggaggtccataccctccacggtgacatagtacgcatgccgggcactgcccagtgagttctcggccaggcagcggtactcgccatcatcctcctcgcccactttcagcagctgcagggtcttgttgtggttctggtaggtgacacggtcggctggcatggggccactggggcgcagccatttgatggtgggcgtgggactgcccgggaggcaaagggaagagagcagaagggagaaaggacaaggccaatcaccccagccccctataccccgcggtggtctgagctccctgctagggctccgccaccctgccctgccctgccctgccctgggttcccagactcacaagccctcggcgatgcactccaggaccaatggctgcccctgcaaggccaccaggtggctgctggagttggtggggaagagcaggcgcggcttcctgtcaatcatgctgttggctgccaggagaaagtgggtgggtgggctgcccactcttccctccaccccagaattgcaaggctgagggactcgacactccagccagcccccggggcctctgtgtcttcctccattaaggagagtgtcctgtctctgctctcgacgcctgggaaggggtctgggcagggtagaggtgggagccaagctgttcttgaggaagcctggagttgtcagatggacctatggtgggaagggccatgcctgagggtgaaaggagtcagggagagagtgcagagcctctgagactcactggccttgacccggaggtcaatgggttccttctgaatgatggtcctggtgcctgggaagtgggcgtggcagatgtagtctgagtggttgtcggaggtgagcacattggcaaagtagaggttgccgttctggcccatcgtcacccgctcgtcctgcttgatgtgcaagatctctgcagggggcaaggaggccgaagtcatgaccccgtccaggaagacacccccgctaacaccccgaccccacgaggcagccgctcgccggcacccactgctgttcatccagtagatccggagaggctctgcacttgggggagggttgcaaggcagaaccactgactccccttcctccacctccacgggcttcactgtctcctttggccacttgggggcacctagaagggacagacgggctgacactctcctcctggtccagatggtgctaggcaggagaagggaggtgggggcaggggggtggcgggctacaccagggatggacgagggggcgagagggtcaggccagtagaaacttcacagaaaaggaggcagacactctggataccttctggactcatagcagagactagcacttagggaggccagggtgagcaggagaccaggaggccaggaagggttaaccttccacggttctcagctctccctgcccaccctaggaaaggacgggtggggggaggctgaggctgaggtgcagtgatgggggaggggagctgtggagggatgcaggagtcacagacccttccatcatcctgacacagaaaccatggcaacggttcccaaggtaactggaggggtggggaggggagaggagagcgctcaggaagcagaaagctcagggaggatggaatgcaaagggaaaaccccagggaaaaggcgacacagatcaagacagagccgtggagcaagagagaccaagtcggaggtggaggggaggagatggagagccaagtggaaaagccagagaagaggggccctgctaaggagtgcaggtgtagacagagatgactgcagtgactcaggcaggtctgcccagaatcagtcactccccccaccagcccgcccccccctccccccgccaccttcctgctcagccatgaggcaggcaccaggaaagcctgagggagtgaaagggcatgagatgaccggaagtgcaatggagacagagacagggcaaaggaggagactgcacaagaaacaagatgggccaggggagaagctggggtggggtggagggctggcaggacacccaggcccctcgccacgagacaactggctgacagcagcttccagcccacaatcccacacgaactccgggacctgccctccctggtccctgcagcgcctcgcaccctcggccatgagccggatctcatgggacatggcggtgcccagcttattgctggcaaagcagcggtagatgccctggaacctctgagcaaagttgctgttgttgcccgtgatggtgaaggagccagagtggggcgactggtacacggtcacacccagctcttccttgggtttgaagtggacaccatccctcgtccagcggaacctgtgggcggaaaaaggcccagaggcctgaggccctggaacccaacgggggctggaacaggctggagggacaggtgcaagcagccagggcccccaggggatggactgggagatggcgaggacttggggtgattagcaaggtttggggcttctgggcttagaagttaggcagtccagggaggcacaaggccggggtcagtggcaggcaacaggggctgagacggcagagatcactcactgcacttcgggcttgccactggcctcacacttgaggctgatgtcatctgtggggaagacaaccaggcgccgtggagactgttccgtgatgacaggtggctccatcactgaagacagggtggagagagcggtggtgagggtgctgcctggctggtgtcatagcctcagcacctgtcccatcgtgagggaagcagggtccagagcccctggaggccccatggccacagggggacgaacggaggggaagaacaaaagaggcttgtgggacatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgtccttcatctgagaaatccaggcaggcagcaagggagggaatggagagaaatactgacaggcagccccagagtggggcagatggcaggggacatagtaagctcctgcagcccccccgtggagagggaatggcaggagaggaggccctggcagtggcaacaagggggcacacgctgggctggagcagtggcaggtcaagcccagggagatgggacagagagatgcccagggagaggagctccactggatagacacacagggcatgtagcccagaggcagccaggccatgcctccagctctagcagacagggagagagaaattcttgcctttaacaaggagtgtccttgcagccccctggcagggcctggcagggcctgcagaactgaccccacccattcaggatgccttggaaggcaccgtcccctgctccagcctgcttccctcctaatccaattagcacagctgagtgttttcaattaccagggcccagccttcagagccctgctgccccctccccctgaaaactatcccaaaggccctgctgcctctgagtttccatagcctgcggggttggcgccagccctcctcttctccctccttcctcccagacagccaccaagctctctggggcagaggccagagctgctgtcccagccccaggactctgcagagcactggccagggcggcctcgaggaagggagaagagggagggagggagcagcaggctgcctctgaaagctttgtctctgcagaagacctcagtgtgaaggtccagggagggaggagggggctccctggggacactgcagagggccctgagctggggagggagatggtgacagggatgacaggatgcagaaagccaactaggtggaggaagcaggaaaagagacaaagggggctggagtggctggggagggagagatggaagacaggttccaacagggagggccggctgcctgccactgcccactgtgtcgtatcagggtcaagaacaagtgctggtcagtgaccagggcagccttggagctgccatggccttttggcctagttctctctccccactcccatctttctgtagagaatgcacggcttgcattccactgtacagtgttatattgtgtatccacctctgtgtcctctgggtctaaaagcctcactggtgtgtgtttccacctgtgtggcctctcagcggctctgctccttcatccctgcacctgccttgtcttcatgcacctgtgtgcatgtgtccatgtgcatctgtaccaagggagtctgcctggccctggccctccatgtatgtgtctaaggggccagcccctttacctcctccaagccctcactgcctcccaacgccaggtgcctccccagcctctctctcgcagcccctgtcccactgctggcacagacagtcttcccaacccctatccgccaactcgtctctcagtgacactggcctcctccttgtccaggcccagagacaaaggtgtcaaggtgaggctgggaagggactggagcctggtagctcaagagacacaaatgccctcacacatgataccctgtgacatgcccctcacacggcctgacagctacttacaggagaaaacaccatcacggtaacaccccccacacgcaagtgtgtacttacattcagccccactcacacatacacatgacccaatgcaatcaaatgtcgtggtcaaatacctcccgacctccacaagcctggccagtaagtaacagagtgactcacacagtcacccatgtaaggaagtcaaaatcacattcacgaa

SEQ ID NO: 838 - DNA, 23574 bp, Homo sapiens
cacaggcttctgttcaaagcctttagacctgagacacgagaaaaactccacgtggtgggcaggatatttcctgccgaccccaagcgtgggctgcacccggccagagcagaggcctggaacccagagctgggccaggggggtcactgaacacagggccaaggcctggtctctgcggtggctctggtctgtccgggcccaggagccccaggtgggcggtttctctcggtgcctcacctgaaggctagaaacagtgaggcggcgggcgtcgccagacggagaagccacaggcaccacgaaggggctgtcgggaatgtgttcctcgttgaacttgactgagacttcgtagtcacctgggcagggaaagagtgtaagaccggctcatcagcctttgggcctcccacctcccacgaacagcctgggtggccctgtgacctcaaagtgaagagtgagtgccaggcagggctatctgtgccagccctgggtccaatacccacactcaggccccacctcctccaaccccagccgggttcccagtacctggctcctggaccacataagccacaccacaggagccgtccttgcggtcctcaaaagagatctcagccttgctggggccctcgacagcaatggccaggcctccagcaccagcttcccgggtccagatactgaattcggctgtgggagaacagtttgtcctcactgaaggctgcttcaccagcctcggccccctccaggcatagccaaggtagacatgcctgccggctctttcctccacccccaaccccaccctggccaacgcaggagagcgagcactcggggtgtgagcaggcctacctggcactccagcttcagctctctccaggccagggcccccagctcggaccttgtgggctcccccttcccctaggggccccacggtgaactggaaggggctcccaggcacgtgctggcccttgtacttcacgctgactgtgtgtgtgcccatctcagcgggaacaaagcggatgcagtaggtgtggttctccccttccacgatctcggcctcatgggtcttgcccgatgggctggtcacctgggctgtcatatcctggatgctaatttctgcagggtggggatgggctagtgagcagcagccctgggctccacccctcctcttggggctgcttgagccccaggacccctccccaggcttcccacagcccctaccagggattttcaggctgaggtcacaatgactaccaacgttggccactgaaggagcccgacgcctgcgggtgatgctctctttcacccggccctcgcctgtcaccttcacagagaaggggctgcctgcaggaagaaagcacggcccacgcccctccagtcacatactgcctgtgggccctggtgtagtgaggggggctgccgaggcactgctgcactcaccaggcacgtgctggtcggcaaacttgatgttgatgatgtagttgcctggctctgtggggcagtaggtgaccctgcacgtcccgtcctccaggtcctctgtgttgatgtccaccttgctggggccctcaatggacaggctgagcccaccatagcctaggggatggatacccctgagcctcggtgctatgcacagtgctcccgccccagctggtgggcagccactgcctacctgcatcgcgggtatcaatgataaactctgcaggctcaaaggtgtggccttcgtgaaggccctgaccagagacccgaacacgactggcatccccaatttccgactggctgatcaccaccgggatggggctgctggccacgtgctggccatttttcttcacatgcaccaggtgctcccccgtctccttgggcacgaatgaaatccctggacacagggcatggctgtcagtcagggagggcatggctccccacaggctgcctcctttctgaaccccctggacccttcagccgcttacccacgtggccattacgcagccgcttcagcaaacagggctcctcccggcccgagggcgggaccacagtggccgtcagcaggctgagatccgtctctgagatgttgatggggatgtcggcagcagagccgacctttaggtgggacatacgcatggagtcgtcacctggtggggacaggccagccatcagtgtgcgtccagccatgggagaccatgcccaccctgccacccgtttctgtcactgctcccagtgccacccacctgtgacccgagcagtgaaggggctgcctgggacgtgctgttcattgtacttgactagaatgctgtagtcccccggcagcacaggcaggtaggacacgctgcatgtcccatcctggttgtcagtgcagctgatttctgctttggacgggccctcaatggccagagacaggccccctggagagagccgtgggtgagcatgggaactatgctggggacactccagttggcctgcactgaggagctccgatggccagggcagcagggcagggagccccattcaggagtatctcctgagtccagcccttaccccggtgagggcatcccgggcacagagcaggtcaagaccagagctattgctcaccctctcctgcatccttggtgttgacggtgaaggtggcaggcttgttcactactccatgggtgaggccaggcccataggcagtgacatggccacagttgacgtaatccacatagaactgcaaggggcttcctgaggcaggaagaagggccttgtggaatggcagcctcgtgtgtcccccagccccatctctctgtgaggtggtggcggtggagtgggcagaggcagggcaggcccacctgggatgtgcatgttgtcatagcggatgtccatctcgtgcaggccagcctcgctgggtgcataccgcacggtcacggtgccgtctttgttgtcagtgatggtgggctgcgccaccttgcctgagggcatccgaacctcccctgtggggcagtggggctgaggtcagggcagctcattggcacagtctggcctccttggctcccgagctccttcccaagtccccactcacctgtgatctcgcccttcttgatggtgaaggggatgacaaggtcaaagggcctcaggctggtcacatccagcccattgacacccaccaggggcctctccggggcctgcagtggagacacagggcatgggtgagggacagtgggaggatctggggtccctcctcacacatggtaaactaggggctcacagaacacccagctggctagccccagtgtccctagctggccaggccgtacccaagtctgctggccgccctgggcgtaggtgtactgtggggccagctgctgagaccgtagagggggctgcaccgagggctggtccccagccagagcctgcagggcaaagcagagagctgctggagagtctgttgtcacagaggggccccaggggaacaggccgggacctgccagacacccctgctgacctaccccccacccctcctcaccgtcacttggaaggggctgttgggcacgtgctcgccaccaaagcgcacacagatgacgtatttgcccggctggggggccgtgtagaagatgtcgaaagtgccgtcctcattctccaccacgtccacatccacctctgagccatcaggcgtgcacacggtgcacgtcactttgcctttgcctgccgccttagtgtccacagtgatcaccgtctcctccccaatctgaatggtggggccgatgccagcacctggtggggcagggtgggtccccaaaggggggccagcgtgtgagctcgggttcaggttgttcccgtccgcctgccgcccacacaggcctctcattgccaccaccaagcacagccaggccgccaggcctcctgccccgccctgcccctccaagctgggatggcgagtggtttctcagaaggcaggaaggtttctcctgaccacctcaagtgcccatgtgggagaggcccgacagtagcacccaggtgcctgggaggaaaaggaagggcccactccagcctaagtgttgacagccactcccttgcctactcagcctcgtccagcaccatggcccacactgctgaacgccagcatctggctgggcacacggctgcctgcgcccttctggcctggccccggcccccattgctgtgtgtggacgcggtgaggcggagtcctgctgcagcgtggggggatgtgacacttgcctccccaccccccaggcctgatggtgaaaccggagtttcctgacaactgagaaggctcgcggtgaaaagcagcccggtgcagacaggagtgggagcggggaagcgggaggcagcggggttagcacccgagtagcgcagcgcagcaggcttggcagagcggggatagcacccagggagacagggaacaggaggcccaagctacagccaccactgctgggttgcgagggcagagcagctgagcaggctccagggccccagagtgcccgaggaaaggggagagacagtgacgttatgatctgggtctccgccgtggaggcttggggggctgtgggctgtgaggcctggcagtgagagtgccccctgcagcctggcctcctgccagggaagcagccaggagcacgaaacctacttgaaggccaagctcgaggggccctgccaccaagtcccactatcggccgagggctcctgctgcactaggctccatgctggcctgccgcggccaggcagctctcccaggctccagacctggctgccggctgcccacgctgccctgggaggcttcactcatgtgcaccccatgccatctagttagtggcttgggccccaacctcacaggtacccgactgcccccactttccctgcccggctcccagccaaccgcaggtctcagccactccatcctcaaagtatgcctcctaatttggctctcactgaagccccgtggccgtcaagcttgccagagagcaacttcagcgcccccttccccaccccgggctccctgtctccattctgcaaacagtagccagggaaactgaggttactgagtcttgctcccaccctcaaagcccccaaggccctgcaatcagtactccccagcctcccccgccctgcgcacacacgcctgtcacacacacatcggatcctacggcctgctctataaagccatctcgctcctgccgcaaaactctagccaccctctcaccctttccttagccacctcgcccaagtgccaggcctgtagcctctcatcagcatccctgggtgtccctggctggggcaggtgaccctccatgcctgttggggaatgtctgaataacgtcactgctgggggataggggaagggggaaggagggagacgggccacagaatgcactttggggctctgaggctgggccgggccccgccatgctggccgcccaagcagtcgacactggcgctactgcactaccagccagccccacccgctcatgcacctcccccggcccgggacgcagaggcccctggaaggtggggatgggggtctgtggatctggccagggctggggctcccattgagttggggagaccccttgttccctcagcccacgcaggagcccttgtgcctccctgggtgccaagatcccgagaccccaaagtccccagtggggtgcctctcaggatgcacctcaccccaaagctctcagctgcaacccgagttctcagatggggaaataaaggcccagagaggggaagagctggagcggtcatgctcagctccggaagcctccctgggccctcgccctccagcccacggcctcatcttctgcaccccacccaactctgtccctgcctagagctgcagctggaactgtcctgggaatcggccccaagaggaaaggaagctgcccctctgggcaggaggggcattgggagtggccccagcaagcagcttacctagcccgtgacctccgattgacactgaggtgagagggcagagagcaaggagaaaggtcaggtgagtcactcaagggggcggcccccactcccacacgccgccccaagcagcgagcccttgcacacaggcacaacccaagccccgtgccgagcgccgcagcggccaacagcgggcgggctcacctgtgacagtgcacttgctggcgtccccggtgggcacggcacgcacgcggtacggggagaaggggatctcgtcaccaccgtacttgatgaggatggtgtagcgacctgtcacgtctggcacgtaggccactgtatacgtgccgtcatggttgtcttggatgtgtgtcttcttcggcttgccttcgggatcctgtgtggcagaggcaggggaggcagttggcccaagcccgagtagccccgggcctgcctcaggcgctcccagagtgcccagcgctgctgctacagggacagtctctgggcctcaggcatcttaactgctatggcccaaaagggctgcctgcacctggcagagtccagaatggagactaaaacatcccacacttcccacatgacaacaggcgcggccagccagcttggcacccatcctcagccccagggcctggccagcactaggaggagctcaccggggtgatctcaagcttctatcctatacctgccccatgagaatattacaggtggggaaactgaggcacagaaggctttggtgacgtgctcaaagttagcagcaagtgcacgtctggggaagcctgtgcctgtcaccaccatcctaaggtagtcacaaccttagcaaaccaaagacaggggccctgtccttccctgccctccttggtgcagctccgcagggagatcagacaccagccacccgcagcccacactccagccgcccaggcccccctgcctcccctgcctgtgcccggagctcaccgtgatctggacagccagcaggccctccccggcgtcctttgcatcgatggtgaactccacgggcaggctggcaggcacgccagtggtgttgagcccggggccactggccttcaccttgctggcatcatgagtaggcagcaccttgaccttgaaggggctgtgagggattggtgttgtgagcagtcagacaggttctcagcatccagcctgggccactccccacaggcagcaggccctgcctcttacctccggggtacctcttcatctccatacagtactgagatgctgtagggcccttctcggctgggcacataattgacggtctgggtgccatcagcgttgtctaccacgtccactggctccaccaggcctggccccagccccagggacagagcatcagctagtctcctgggcctccattcctaccccaccacactggacggccaggacccagccccaggcctagacctcgctttatcctcatccacccgaccctgggaatggccttgaccccctctggcacgaaagacacccatctgggtgccagctgggacccttgcctgcctgccttcctgccacatctgctcagtgaccagtcccatctgctctacctcctccaagtcccccacctggctgcactgtcacctgaggctcttccaaaaacacctacacacttgcaccacctctgcactctggtcctcactttgggcctccagtttcctttcccggccctcaaacaggacactgccctcctgacccctggctccaggcatgcaaacactcacctttgggcccttgcactttgacctgcaatggggccacaccagccttgcttgtgtccacctggaaggactgagggaggttggcacgaaccatgcctgggctcaggccgggcccagagcacttgaccttggacgcatctgtcacatcatgcacagggaccttgaaaggactgcctgagggttggggcaaagggatggcggctgtatgagacagggtggggacgagcagacagtcccagccctgccctggccgccacctcctcacctggcacttgatggccaccataggtgacgttgaggctgtaggtgccagcctcataagggatgtactcgaccgagcagctgccgtccttgttatccatgcaggacatcttggcctcggaggggccctctacagccaggcccaggccgcccgtgccagctcccctggtccaaacagacagccggtcattcctggggttcccaggcccaccagccacacgggctcctgggggctcccttacctggtctccacagtgaacttgttgggcttgttggtggtgccactttggatgcctggcccgtggacacgcacccgggaggggtcgcagccctcggtcacgggcacctggaaggggctgctgggcacgggactgccgtcataggtcacgtccacggagtgcagtcctggaggagtgcaggccaggtcaggaggagcccgggccaccccacccaccccgtctgccagcctgtgggagtccccagcacgcaccctcctcgtaaggcgtgtactccactttgtacatgccatcgccacggtcctgaacgtaggtctccgtcaggttgcctgaggggttggccacacgggccttgacgtgcggccctccggtctgtgtcagagcccgggcgtccacactgaactcagtggtggcctcacggaagacacctgcaaaggcacagagaggaggcttggggctcgggggttctggtccctgtcccccgtcacataccccacggcagggcaactcaccctggccctcaataccaggcccatagcactggacaccggaagtgtccaccgcaggttccacctgcagcttgctggggaagttgggcacgggctggccgccgtacttgatggtgacggtgtaggccccggggcagaggggaatgtaggtaatggtgtgcgtgccatcaccgtggtcctggatgtacacctcggccggaagccccgcctccgagcagatctcaatggtcagctccgcgctgcccgcgctcgagcagtccacttggaattggcccacctccccagcggtggcccgctccagcccggggcctgagcacttgactttggatgcgtcaaagcagggaaccacgtgggccttgaatggggagccagggatgtgggtgtcagcgaagaggatgttgatgttgtagtccccgggctcggtgggcacgtaggacacggaacatgtgccatccccattgtccaagcactcgagctgcgcctcacaggggccctccaccgtcaggcccaggccacctgtgccggcgcccttggtgtcgatggtgaagcgggcgggggagcccgcactgcctccctgcagccccggcccaaacgccttcacctgagggaagaaggggtcaggagccaaggccacactatgccccgatcccagacctcctgcttgactttccacctgcctccccttgccctggcttcctgccctcaccaaacagggacacgggcgggcccaggctgcctgccagatgggccatccatcagtcataaggacaaaaaggagggcagggcgcggtcactcacgcctgtaatctcagccctttgggaggccaaggtgggtggatcacctgaggtcaggagtttgagaacagcctggccaacatggtgaaatctcgtctctactaaaattaccaaaattagctgggcatggtggcgggcacctgtaatcccagctacttgggaggctgaggcaggagtattgcttgaagccaggaggcggagggtgccgtgagccaatatcgcgccactgcactccagcctgggcgacagagtgagactctttctcaaaaaaaaaaaaaaaaaaaaaaaaaaaaaaaaagaaagaaaaaaaaaaaaaagaaattcttcaaccctgatgactttttgtgggtttctatttccctcctcccctttactctcacttaaacagggtcaaggttgacagtctgtctcaggaaaaaaaaaaaaaaaaaaggatttagggcaggtctggagaagatggggtacctttggggccctcagagagcacagtgggttctacccttagggcctcccataccccaattaccttgctaggcttggtgggggccacagcttccagaggaaaggggctgccaggcacgggcacgccgtcataggtcacctccacctcatagggcccttcctcacggggcaggaagcgcaccacactgttgtcagcccccaggcctggctccaccttgcagggcaccgctgcacccgaggggcccacaatcttggatgccactttgccttgaccaccagcaccctttgatttgactgtgaactcctggtctttgccaacgtccacctctgtggaaacgatgaaaggaaggagagagacatgacacccagctcagccaatccctggatgtgacaaaggcctttgcgacaagggccccaactacttactctctcccaggccagacaccttgatcttgctgaggtccaggcttggagatactgccactgagaaagggctcttagggatgggatcccctccataagtgacattgacgcctactggaccctgggaagggtgcagaagggaagggggtatttagagacaccagaattgctccccaaccccctcctggacctccatgcctgtcctctcccaggtaaggaatgagagtgggcagaaagtccctcggagctgtcccctaggctgctgcatgaggaggctggggactcggtgactgtagtggagggtgtggctacctgctggacaggcgtgtacttgactgtgtaggtgttgtcatggtggtcgatgatgtccacatctcgcactgcatcccccttggtgagtcctgagaactggacgtccagcttgcctttgccagcagctttggcatttactgtgaagtgggtgggcttgccaagctcgacacctgaggaacacacagggaccatgtaggggcaccctgccccaagccctcctacccttgatgccccgcaacctgccatggggtacctgtcctcaccagtgcgactgaggccagggccctcggccttcaccttactggcgtcatgagagggctccaccttgactcggatggggctggtgggcgtggcctgcaggcagtgggaggagaaggccttagaggagggcagacgtcatccgcaatgacatcttagcggccaggagcgcagcacccacctggtcagcaaagaggaccataatggtgtagctgccagccccccggggcgtgtacttgaccgtgaaggtgtcattgtcattgcggatgatgtcgaagtcgatgtcagcttcggcggggcctaccactccaggggcacacttgatgccgatgctgacgtcccctgcggcggggagaggagcggaggctgagacctcgcagggacaccccagccacctgccctcccacccacagccaggccttaccctggccagcctcggcgcagtccacagtgaagtaggtgggctcgtgggccttgagccctgtcttggctactccggggccgtatactttgaccttgttggggtggctgccagctcccacattcacctgcagggcacaggggcaagggcaagggcatgagcagcctggaggagactcagaagctccctcagctacactggcaggcacacaaaatggtccagctgccttgggaagagtctggcagttcctcagttgaccacagagggactgtgtgatgctccggttcactccgaggcaactacccaagagaaatgaaagcaaatgtccacgcaaacacctggactcactgttaacagcactgttcatgatcaccaaaggcaagctcatcctcaatatctgttagcaagtgaacggaaaaatggaatgtggtctggccacacaatggagtattatgcggccataaaaataaatgaagcggccggacgtggtggctcatgcctgtaatcccagcactttggaaggccaaggtgggcggaccacctggggtcaggcggttgagaccagtctgaccaacatggagaaaccccgtctctactaaaaatacaaaattagctgggaatggtggcgtatgcctgcaatcccagctactcaggaggctgaggcaggagagaattgcttgaatctggcaggcagaggttgcagtgagctgagatcacgtcattgcactccagcctggcaataagagcaaaactccggctcaaaaaaaaaaaaccaggatgggcgcggtggctcatgcctgtcatcccagcactttgggaggccgaggtgggcagatcacaaggtcaggagatcgacaccatcctggctaacacagtgaaaccttgtctctactaaaaatacaaaaaattagccgggggggtggcgggcgcctgtagtcccagctacccgggaggctgaggcaagacaatggtgtgaacctgggagaaagagcctgcagtgagccgagatcgcgccattgcactccagcctgggcgacagtgtgagactccatctcaaataaataaataaataaacaaaataattataaaggaacaaagtgccaagacatgccaaacatgaacgaaaacacggaaaacttcgtggtgagcgaaagaagccagacacaaaaggccacatggcacacagttccatctatagaacatgtccaggataggcaaagccacagcagaaagcaggttagtggtcaccaggagctgtgggacaggggagtcaggatggtgtgccacaaccacttgaaatggacgaatcgtgtgctacgtgaatgctatcgagatggactaaaggccggtggaggttggctcaccctgaaggggctgttggggatgctgacgcctccccaggacaccatggctgtgtgcttcaccggcttcctgggcacgtaggagcagctgtaagtgccattgccgttgtccttgaccaacgcctccacagggcagccttcattgtcctgtcaggcagataggagcaggtggcctgctggtcagtgcccaggcctgggtgcccacacctgccctgcccccaacacccgtgggtgctctacctggacttggacccgaagtggggccttgccaccgtgcttggcatccactgtgaactctgctggcttgttgacggccacacctgtcttctccaatccaggcccacgtgccttcacctagcgggagaccacccagctgtcagggggccaggtccaggctgccagagctacaacccaggcagggtggccagggacacagagtgccatccccaccagaccccaagcaggagcagcagggcgagacttaggccatcacagcctgctctttaccctgtctgggtggaagtcctggggcgcgtcacggatgtcagccatgaaggggctgaggcggatgtcttcgctgttgcacagcacgtgaacggcatactcgccagcctcctgcggccagtagcgcacatcacaggagccgtcgcccttgtcgtcacattcgatcttagcctgcgatggcccttccaccgagaagcctgacaacagccaccagtcccctcagtgccctggagcctcagggtgggccgtccttgccatcgtctgtccccaggtgcccatgctgcagcctccaacttacccagcgtgcccacgtcgtccccgatagcctccaccacaaagtctgctgacttgccaacgacgccgccctccagcccagggccccaggcccgtaccttctgattgccacactcggtgcccaccttcacttcgaagggactgcaaatgcgagagccacacagggaacaccgaggatcaccacatgagccagcgtgggccccactgtggcggccaggcaggaagagcccatgtggcccctcatcatcaggtggggaggcagaaggaagagaagaggcagagtgtgcagagctgggagagggatgcctgggggcctcacctgcgcccgatgttctgaccaccccacgtgatggtgacgatataggttccagggaccatggggtaatactcgaagccatacacgccatcccccaggtccttctgcttcacgcgctcctctccctctgccaagacaaggagggcctcaggcctgcccagcagtgaacccgggggctgccgccacccatcctggcctggctccaggccaacttactggggcccttcacggtgaccttcagctccccactgccagcgccctttgtgtacaccttgaagtcagctgtctccttcacccgcacacccttgggctggaggccccggccaaccgcccggcaggcactcgggttacaggctgcaggcagaggggccagctgagcaccagcagctcggctgggcgacccctcccttgcctcccacagggccgggctgtcaggattggtgggtccctcagagcttggctggagggggacatgcaagacagaactggaagggactgtgaccccaggaactgtggcctgggccaggacatggcaggcctcctcccacctgctccacaccagcccagagccccccagcctcccccttccaagaagaagacagatccaagtaccgttgaccctgtgggcagagcagagagcagcaggtttctagacagctggagcgagctcttccgaaggtgaaagcgtgaggagagagatggagaggggcgaggagaggagaggaggaagggccccagcaggggaggaaaaacagcatgtgcccagacagtagaagctcaaagagtaggggccccggggcgggctgcagcgggactggcccagggggtccccctcctgtgggaggcccagactgcagtgccacagcagagggcagtcagggccgggcctaccttggccaacagtgacagtgtaggggctgcgagggatgggcacgccggcaaacgtgacgtgcacggtgtggacgccctccatggtgggctggtagctgcagcggtatgtgctgtcgccccgggcctccagctgaggctctaccgtgcccttctgtcccatggggtcctggatcacaacctcgacctcgcccgtgccagctcctgccacgaggcacctgctcagctcccaggccccagtgcggctctccccacagaccagctgggccttggcagcctcccctcacctgccgtaaagatctcaaagtaggtggtcttgttggcgatgttgccactgggctccaggccgggaccttgggctgtcactttgctggcgtcaccctgtgacttatccacgtacacctcgaaggggctcttggcgatgtgctggccagcaaagagcacagtaacctgtccccagaagggtgggccgtgagggtagggctgggggcctccagccactgcctgaggtcacaagcctcccccctggccaagggctcaccttatgagtccccgtcacctcggggacgtaccagacggagaaggtgcggttcttgtcgttattggcggtcacttttgcctgcagtgggaaggagcctgtgagcctttgctaagagcagccccactgaaagggagcgctgcggggcctctgctgccagcagctggccctacctcctcctggtgtccggccgggtcctccacgtacaccagcacctctccctggccagcacttctggtctccacagtgaactctgcccgcttcttcaccatgttgcctgtgggctcgatgcctggcaggggaaggcgagccaaccacgggccagctgttaaggccacagcctcacccctccacccttcagccctccctgctggcccctaagtcaggcacattccaaactgggcaagttcattcagtgtgagctgtggcacagagcctggcctcgggacccagctgtgctctcgctgctgggacaggcccagcctgttttctggaacattcattctcaccgcactgggcccttgttcctgtgtgagccttgactgggttttaggtccctgttactgagacctggttcatctccatttataataaagaccgctggatgctacctccccgaggaccccacgcagcaggcttctgtgactggaggaacctattagcattctcttgtcgttttcactagtcccaaaaacccactcttgtctgactcttgggtggcttgatcacctagccgccatgtaacccaagacccctggggaccgccacgtttagatgggacactgtcttatggggaagacgttggcacacgggtgcacccctggtggggctccctcacctggcccgtaggcacgggctttcttcgggttcagtttgggccgcaagggagcccctggcttcagcttggccttggggaactgggacaggtaggtcatgacagagtgctcgtccacgttggggtccacaatctcctcgggggtgatcacctgtcacaggcagaaaacaggagccatcgggcctccgagtctctcccaactgccgatccggtcccctacagctgtagccaggccgggcgggtgtacctgggggatgcccagccagtcatccgcctgctgcatggcctctcgcgcattggtaacgggcttgctggcgtcccaagagtcccagtcaggacacaggcctgtggcgcaagggaggctgtgagtctgggggccgcagaaccccctcaagggccacccatgggtgaccccagcccagtctctcctgcctctgcgccccctcacccggggcacagctgtccaccagggcgcccagggcccggccgctctgccagtcccggctgaagttggtgatgggcagctgcggcagcttgttctggatccagcccaggagcctctgcttgggggtctgcttcttggcctcctcatcctcctcctcgtcccacatgggcatggagatggagtagtgcaggatcagggtccagatgaggcccaggatcagcttcaggttcccgtccacgatggccttgctgtctgtgagtagaagagtggccacgctgggcacacggctgtgcgggaggggccgatcccaggctttggggtcagggtctggcagcacggggtagcaggggccaaggaggaggtagacaccccctcttggccagtggtaggatgtggatgaggccctctctgcccagggtcccagggggtgttcagaggtgaaggagactttggggtgagggcagatacacacagacacacacacacgatgccagcagggtatgattactgccagaagccctgggcccagaggaagggcagagggcagacccagcctgcagatgggcagctctggagaacagctggacagtgtccacagctgccagagcaggggtccgccacacacctcaggggcctatggggaaccaggaggaggaggctgactccagctggcccagaatccagggcccatgacctggagtggggctggggctgaggaagaggaaggtgggtggccctgggtggttgggaaatacaactgttgttccagggtgggtggggtgaggcaggggaagtgggggagttgggcaaacgccctttgggtgagggattgtgacccccgccaccacccccacttcctctaccacctcgaagactcaagcttggagttgggaggccacaggcctagccaggggaggggcccagagcccaaaggaaccagcagttgggccacatggccctgactcactggggcccatcgggagatgccggggtggcagcaggagacactgggaacccccttgccacccactgcctgacccacttgccacctaacgggcctctgggcctcggcaggctcgccacaggggaagtggttagggcgggtccctgacaccccccatcaccatggcaaccctgctgggctctgggccccacccaaggctacttctgggtctcaggctcaaggcaggatggctcatctttagaagccctgtcagcctcccccataatcagacaaaatacttctctggtgagtcaactagggggcgggcctatgaggaggggctgggctgtccatggcagctgcttcccagcccagcaggcagcacctggagggccaggtgagccgctcagagtggcctccccagttcccaggttggtcctggccccacgaggctgcctttcactctccccaaatggcagcagggagggggactcggagaggaccaagggtgcagggccagggaacaaggccagccagggcttcccatcaggcccccaccccagtccagcctcagacccctcaacgacccccacacggggagcaaccaggcccaccaggtccatgttaggccagcctactccgtccccatccccctcccaaaagagagagggaaggaccagggcccagggctgggagactgtctggctggatggccccgccccatcccacccccctttccccagcccctgggccagccaacccctccctcccctaatcactgctgctttccaacatttttttgccttatatggcaaagctctgggaactaggcctgctccagccagctcacaaggaggaggggagctgggaggagggaggagaccccccctaaagagctggggtgtggcccgcctccccacatccggtcgccccccctaccatccaggactgagatgactcagcttggctagactgaggctgggacttgtgggggtgggcctgcccctcgcctcaactggcattccaaagaaagaactttggttcttgggatctgccctctgagtggctgggggaacccaagtcttggtccctcactttcttgggttcagcaagggccattccagggctgcagggtaactggaaggcctctcaattctgaagaagagaagactcatcatccctctcctctccctgttccacatcacccccgagtcacccattctggggcctgccctctcatgcagcccctatcttgagaacgaattgggctgctgcagcaggcctggtcaatgccagcctctccagtccagtgacacagacactgggctggcacaatgcacgctggagcatctaccaaccaactcctgcgtgctacacgcagaaaagcaaggcctacatggaagcaagagtttggcccaagatgaagagaaaagttggcgtccaagtagtctacaagccaggtctctcagtcaaccacgcccaactcaccccgggtgcagttttgctaactatgcttctttctggcccccaggttgcctgtgtgtgtgtgggggggtagatctaaactggtggttggagccatctccgatgggcgacccatcctccagggacacaaagagcccagagccccagacaatgggacgcacgagctccaacccacacttcagaaccaacgggcctctgaaggccagagggccctctctaaacagctgtggggggagagcccgggcctcctcctcctcggggacggggcgcagggccaggagcctgcccagtgcccgaccccccaggcccactcccaccgcgagcacagccgcggaggcgcggcctgcggaggatgtgagttcagcctgggcgccggccagccggggcgcagcgggcgggggcgcgtagcggttcgcacgcccggccggccagccagccagcccgcgcgcctttgttctgcaggcccgcgtggagcagagcagccggaggcctcgggagttgcgctgcggcccggaagggggtggtttggaggggtccgcccggggagatggaaggacgcacggagtccccgcccccgcccgcccggcgcttcggggcgtccctcaccgatggacaccagtttgatgctctcgcggtccaggaactcgagcgccaccgacacgttctcaagctgcatttggcggaaagtgggccgctggttgtgcttgcggtgcatcttcttctggctgagcacctccaacagcgcgataagccgcagcccgtcgctcaggtccgtctgcaggttggcgatgcgcttgctcacgcacttcaggtgctcgttgcaccagcgcgtgaaagtgttctgctggatcttcttccacggcgcgtcctccgccaggtccttctcggtggccggcatctcggcgtcccgcgtgtcgacgccgccgcccggagccgcgcctgctgcgctctggcccgcccgagagtgggagctactcattttgaggcgcgagaagccgggggggcggtgctgcagcctcggcgaggggacggccctttaattaaagtcgcaggcacctaggcgcgcgggaggcgaggcagggagcagaggttgcgctgcggagagagcgagccctttaaatgcgggaggagggcggggccagagggcgggcctcctgcggggaggggccgtggggtggggcttcgagggcgcgcctgccccaccccgccccgcccgttggaatgcccccactaggcccccgggttcggctgatcagacgcgaaacccgggctccagggtgggtcgctgggcagtggggtgggcaaggatgctcccagccccgcagcctcgcgttggcgctgcaggaaacgcgccctagagcgaggaaaggctgagcagtgtctggcgcgggactgcttggcctgcagccggcgcgccttacaagggactttccttccccagggcccctgcggggggtggggtggctctcttccctaagtcacttgggctctgccccgtccctgcacatccctaccccccgccgtcatcccccttccccgggcccccagggcctagggttccccggcggcatccccgtccgccggcccggcagcggcgggaaggggccaaccctaagagcgaacccctggagagcggcagccccggaccaggcactgccgagggcgctttgtgtgctcatcacctgggaagcggctgcagggcaaggcctgcgcctacgcggtccccgcagaccccctgccacgggcccgccttcccagtccgtagggccctcgcccgcgcacctgtgcccgctgcttcccaccgcctccctctctgcttccctccacccgggaggatatggggcactgggccaggaggccgccggcactccaggagcaagcagccttcgaaggggtccgggcatgcccacgggcacgccagtgggcgcgggcagagggcgccgtgcgatgcatgcagagacgtgtgcccgcctaacccttcatgccagttcacccggggcactggggggagctgaagcggggggtcctctcctgtcggaaagtcccctcagcccagcgtggccagggcagggggcaaacacgggagtggcattccagacccagaggggcctgctcagaggttcccataagacttgtcaggctctgagcacctgggtctgggtgggcttcaggtgtggtggcaggtgcagaggaggcctgaggacagggatcaggggcctggggggttgtgtccccagagctgtgggggctcttcactcaaaattttctggtagataactctggagatggtgcagtggctgctgtgccgagatgtagactgggaccaggggacggctggggacgctcactgctactatcttcagtcagaagccagcctgcctatggcttcctccccattgtgcactcccctccctctcagtcctcggtacctcccctctccagaatgtttcctcctctgagtgttttttttttttttctaggaaggcaggtatctgtccctcctgttcaattctagtaataattaatttatctgctaaagaccagtgagagatggaggccctgggttggccagcacgtcatgcccaaatatggttgactctcctgtagccctgggtgtctacatgacacgtggtggggctgtgatccgcccagcacattcacttcggggcagcctgtggccccactggtttttcccactagtagtggtgttagggggtgcaaatggcattttccagtactgaggccaacccctgtatattgtcccctctcctgaccactttgagacacacctgcaccaagtgcgcctgggcgtctgggagctggggtggaggtgggagggagggctgggaagggggaacccatacagacccctccctgcacgggccccattcaagacgggcttgaagttgtccttctggtccccctgccccactggaaagcaagttcccaggcacggaattccatcaataattgactctctctccactaagggccattgagctgggttgtctgggttcattccttaatcttcagagctcagggaaactgagtcagagtgaccagtggtcaattccagcagaaagagtgtcaggaggtgggtgccgtgtcttccagccctagcttttccctatttagaggaaacaaggaatgggcgtgtagagggttcttgtccctagaacatagtatcaaccgccagatgtcgcccgatcccaaagccaccagatcgggcagtcctgggaagccaaaatccagctctttcatattttcccttatttggagtagattcttggatgttaggcacaccccgcccaccacaccacccctggccctcagaccccaggccagaccctcccactgggaggtatagcccaagcccaggagctgttcagctgggatccctaaggagctgtttccaggcctgcgtagccagggggcgcaggagggaaggaagccgcagactggcaaggtgagaagagacctgtgctggcaagtccaggtgcggcaggtgaggtcgcccattcccaagctcccaccttgacggtgcactcggagcacttacaaatgggtctgccagtggattttaacctattttgcctggccccaggtggcacgggaatctggggacattgttggttatatcctggctggcagtgcgcatccaactcagagccaacctggcatagggcccagggcccaaccaaggaacctggcctggtctcatcctcaccatggcccccatggagtagagcagccccagaaccagctcccctgtgcccaaagcagctggtgccctgtggactcgagccagcaagggacacgctgtccccctcccagtgggcacactggctgagaagtgtccttccaggtggccactcgccctgagtccacacaagttcctggtgtcagggcccttctctctcaggcatgcagtggtccgttcatgggcaagtgcccagacaccctctctctctcggggaccccccatggcctcaggctcccacattcgtgggcacagacatggctcgtgggtcaactagggaagctattctctggacactcactcccagatgccaggggagcctccatcggctcacgcatcccagctgaacctggcccggacctgggcgcgagctggcgcctgcgttttccggcctctctgcccgccttctccaaccccgcccccggccgacgaggagcgcggcgaccctacggcgcgaagccgggccgcggagacctcacctgctgttcctgagagcgaccggtgaccgatgaccgcggggtggcgcccggatcgccttcgcgcccgcgcccgcgccaggcgcctcggggattctgtcggcgtccgctgcgcgcgacgcgcctccacgcgaatgggccgccgccgcccgccttcttgttggccgcacccccgccccgcgcccgccccgcgcccggcccggcccggcgagaaagccttaattggtaaaattgcccaggagcccgggacgggtgcgtggggggcgggggtgcgggggcacgccgtgagctccagcgacccgccgccgggcgacgccgccccccgagatgagctcaccgccggcgagggccgccaggccctgggggagggagggcttcgtgggggagtcgcctccagcgcccacagggactgcagggc

SEQ ID NO: 839 - DNA, 2689 bp, Homo sapiens
tgagcacgttttgttatgattgtttttcatagaatcctattgttaccttatttttaagtttctttttattgatgtaaaatatacatatgtaatttgccatcattaccatttttaagtgtacagttcagtggtatatatacataatggaatactatttggccataaaaaagaatattttcatttgcatcaacataggtgacactgcagggcaataccacatgttctcactcacatgtgggagctaaaagagtggatcttgtgaaaatagagagtagaatcgtggttaccatagtctggggtggggagggtggaggtgatgaaggtgccagttgggacaaatgtaaacaaacgtaaagatccagtattaaatcgtaactgcataaaattaacggtagtagccatctcctattgttattgtgctgagctcaagtgctgggattacaggtgttccagtaagtggtcagagccctgcctgtcccaagtgggtgaggtcccaaagggattatcatagcagtgttggaaggccagctagtgattcatgccaaggtgacctgtaggataaacctgctacagcatggtgctgctgcacggccattctgaatttgcatgtctttggccaaattatagagcagaatttccagggctggggatggtagtccttcctccctcatttgtctctgcctgtactctgggatatttctgccttcagacagtcatgatgttttctgtgggttaaggcaaggacaaatctccccccagggaacccaagaaggtggagaagctggttgaacacctcaatgtcactttttccagtgtagaaaccatgagttgaggggagattttccatacacttggtgctgggcagaataggaggaaggagagtcatggatgtggaagtctgattctcaaagttttttcacttctctgtggctccgggaactgtctcatcctcacatgtgagctctgggttgttgttggtgtagatattggtgctgtatgtttggttttggttttctgtgagagggagtaaagccagcctgcctctatgcccctattttaaaactggaaggcatcttattgttactttattgatgcagtatcttcttgaatctttatgaaaatagaagtaagagcttccgatgagttctgttctgagccatagctttttttattctgggattattattttctttgttcatctttgcatatcccttccatattttaggttctttttaaatgtctgttcatccttggttgcccactcacatttaagaaaaggaaagaaaaatctgactgtgggctgtatgtacatgggtaagccttcattttcaggtgaccaaaagaggaattgcctactatacattaagatccccagaggccagagatcttcaagtattcagtgggctatatcctctgagatgccgagctgtttgtgaactgaagtacagaactctggtgctgaatttggaagaccctgaggattgttgagcaggtgtgtacatacctggcagagacctgtttacataaccattgactgtgtgcattttaggccaggcccgagcagatgcagcatccctatcctgcatcaaggagttctttgtttctgagtgccaacttttccctgatgagagagaaggcaaagatagagtcagctaagcatgtgtctcatgaatgaccgcctcccctttctccttccctgctcccagtgtgctcacaccttaagcatttttgtcagcaaagtaggcacacagcacttatcctctcaaagtcagtgtgagggagggagaagataattatgtaaaggcagacatctcttgctcaaactgattttctctccctccatttgtccatgacaataagtgggaatggataataatagaagacagaatattggttagcttgaggcatcaggattcaattctttttattagctgaattatttaaaagaaagcttatgaaaatcatcctaggggccgggcgcggtggctcacacctgtaatcgtagcactctgggaggctgaggcaggtggatcacttcaggtcaggcgtttgagagtagcctggccaacatggtgaaaccctatccccactaaaaatacacaaattaggcgggcatggtggcatgtgcctgtaatctcagctactcaggaggctgaggcaggagaatcacttgaacctgggaggtggacgttgcagtgagccaagattgtgccactgcactccaacctgggcaacagagtgagactcgatctcaaaaaaaaaagaaaagaaaaaagaaaattgtcctaggaaaaaggctgtctgtcagtccctgtctccgttataattgcttcatcccagcttatatttatgaaaccccaggaacctgaaagctccctaacactgtctctgaaattgataagggctgaagcactggaaatactattgaacagtgactccctggagttacccctttgtgtgaaggactggtagctagtgctaaaactttatgaggcagccattcatttgttcattcattcaaacacatatttattgagcactactaattgtagacactgatgatagagaggaagatacagcctctgctttcaagatgcttacactctagctggaatcgtcagagaagctgataattataataaagagtaaagagtgatataataaagatgagagtagggtgttacaggga

SEQ ID NO: 840 - DNA, 34068 bp, Homo sapiens
atgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactctt

SEQ ID NO: 841 - DNA, 21054 bp, Homo sapiens
tccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaa

SEQ ID NO: 842 - DNA, 40639 bp, Homo sapiens
agacctatcagcaaaattattacctttggaaatgtccttttgcctttaaggaactctacaatgaattactaatatttaagcaggcagttataaagttttatatctcaaaaatcagctatcaattttgcataaggtagtttagtttttgttgaaggacaaagatttctatttaaaatattatgtattttttgaagttaggaagaagctatgactagtttaacttatttaaaaattaattcagattttagggaccaaaccagaagatctagataattattatgcaattgttccatcagagaatttgttttctttgcaaaagctgaaatctgctatctacaatattgtagtagtccccaaaattgtctatgttctttattttttacttttttgtaataggtcattttattataaaattagttgactcctggatcatagcactgaaatattagagcttagttgtgcaatactgcaatttgcttggtgaacccttatgttcctgttaagccaagaactgtaacaaagctaaagtatcaatttgcaatgctctgtagtttctgaggataccagcaaatcatctatagtttgaataattataaatccctctggttggaaacatttctctaagttctataaatgactagaaaatattgtaggaaaatcccaaaacccttgaggaaacaattgtgataaatattgggttcttccataagtgaaagcaaataagaatctagttccattctctagaggaatataaagtatcaaaaattaaaacatagacaaattatagataaatacttccagaaaatgataccaagttcaaaagtcaggatacataattaggaaatacaggaattaatgttaagcttttgtacaaatctatatagtggtcaaccatctttatcaaatttatattcctcagatgtaaaaaagggcagcatatttataaataaatgttcaacatcactaattatcaagaaaatgcaaataaaactcacaatgaagtattacctcacacttagtggttattaaaaagacaagagataacaaatattgctgagggtatggacaaaagggaactcttgtgcactattcatgggaatgtaaattagaacaacaattatgacaatcaggtttagagtttcctcaaaaacttaaaaacagaattaccatatgatttagtaatttcactattgagtatccaaaggaaattaaatcagtgtcttaaagcgagatatatgagatatgcgatatatgaatcctcatatttgttgtgatgttatttagaataggcaagatatggaaattaagtgttgctgaatgaataaatggattaaaaatatcatatttattatacacaatggaatatattcagtagtgaaaaataagaaaatcctgtcatttgcaatgacatggataaacctagaggacattatgctaagtgaactaagctaaacacagaaagacaaatactgtgtgatcccacttatatgtggaatataaaacatatgaatttatataagcagacagaataatagttgacaggggctgaggatattgaccaaataatacaaattttcagttacaggatgagtaagttctgaggatctaatgtaagtatagcgaccacagttttactgtattgtttacttgaaatttgctaaaagagtagatcttaagtatcttcatcacacacacactcagacaaacctgcacacacacacaatggtaactgtgtgagggaatcaatgtgttaatttgattggagtaatcatttcacaatgtaaaggtatagcaaataaacagattgcacaccttgcacacatacaatttttattggtcaattatacctcagtaagtctggaaaaaatacctttttaatttactagaagaacaatgtaatattataggtgggtggcttatttacattatttatcttttcttaccattatataacaggctttgtttcttctgattgagctcttgaaatcagatatcattttgcatatggcatgcactttgcttttggtgaaatatttttattggctctatatctcaaagtacaccagtatcaagagtccctagctctgaaagtgttagatagatttgtccagataggagtgtttttccaacatggtgtgaaattaccactctctgccattccccaaaacaatgtagcttggggtgattttctagtacagtatgagcctgcaactctctgctataaccctttacattcacaaggtgcatggtaaccaaaggagatgcattttccccaaggaattctacagacactcactggtgtacagaatatggtaacctttaaattgcacagcaatttaaagcgggtctctcccaaacagctttataagagaaacaggagaaagtaagaatgtatgttcctcagcaagataacctatctgtatgggaatagtagagaaaaaggaaaaagtagaaggcttactcaaaatatcaataatttgtagtgctctttcaccaaatgaaaagccaaaattatctgagaaattgcagactaagtagcagcagtagcttcaattcccgcctctgagacttcctaaatgtgtccattttttttcagtgattcagctgcatttttttattatactttaagttctaggatacatgtgcagaacgtgcaggttttttacataggtatacatgtgccatggtggtttgctgcacccatcaccacgtcatctacattaggtatttctcctaatgctatccctcctctaatcccctaccccatgacaggccccagtgtgtaatgttcccctccccatgtccatgtgttctctttgtctttttttttttatactttaagttttagggtatatgtgcacaacgtgcagatttgttacatacgtatacatgtgccatgttggtgtgctgcacccattaactcgtcatttagcattaggtatatctcctaatgctatccctcccccctccccatacctcacaacaggccccggtgtgtgatgttccctttcctgtgtccatgtgttctcattgttcaattcccacatatgagtgagaacatgcagtgtttggttttttgtccttaggatagtttgctgagaatgatgatttccagctccatccatgtctctacaaaggacatgaactcatcattttttatggctgcatagtattccatggtgtatatgtgccacactaaatgtgtccattttaagacacctgtcagttattccttaggcttttgggctttcctgattctcgtgtttctacaatttctttacccttcagaatgtctttttacaatccctctcccaacatactggctttttgcaacaatgactggtcttttgcaacagttattatttctttattttctttatagaaagggtggctgaagtcgggataattccctttagtgaagagttttaactgagcagccaatacagcagtctttaattccttttttgtcttcgtctttctttaaattatctcaaactgaccagctggtgctaagattgaataataatctttctttgccatttaccaccttttttctaacttgagtttatacagttggcaagaaagccaagacaagttttctaagatgagagcatgagcttgatctgtctggtgaattttgaaaaagcttcagcaatttgctgatggaaattgacagagtcctccaatcttttgagtacacaactgcaacttcttccagctcatctttaatgaagaggctttaagtaatgccattaacatcccctcctgaggatctctaacacctttagttttttcatagctgagggaggtggtggataattgggtccccttaaccaaaatacttcacgacgttgcggtgttttgggccgtgatgtgcttggtccaccaaatgagcaaattcttctagttgcagaatttcatacagtagccagtgcataccccatacatgggctataagctaaaaacatactgcagaatatttccacaaatttctgtgacacagggattaaaagcctttaaatgaataatatcagctggccagaaagacatgtagattactcaggaggcctaggtagcttaacagtattagcttcactcttgatccatacaggaaaagtttgttttccttgcactgagacaagaaaaatatgaattagatagcactttggtttctctttctgtgttgatcttttccaaattaattttttttttgtcttttcctgagggactaatgcagcttctctccatcctgttgccttcatatggggcacagtcttttatcaacattttcagtgattcccagatcaagtttctttgtcatgtctaccttcctagcttcatgctgtatggattagaagggactcttggaagtggaatctaggctggccagaaagcacagaaatctgtgtcattaaataaagcaggcaattcatactggctgaaaaagttatgacctcatcccccttttcaggaaaacctaataatggaggaaactgtctatgtaaaaaaccatcacctccctctttcctagtgttagttatggacagaaaggcttaaagacaggcagggagggtagaaggagaagtgatagcagataaattttccacagactcatgcctccaaatactgagattatcatgtaaaaattgaaaatataagcttcaggaagagaagtaagaattgtatttctagaaaattaaagtagcacttgaatcatttgaaaaaataaatactaaaatatacttaaagtgagtattgataccatacctttgcaaatggaactaaaatttgggagttggtcagacatctttgtccaagaagagattagttgagcttttgtgtttgcctgattattatttcccatagaattgtaagaaaaagcatgaactctacattgtaaagcaaaacaagagaaagacaaattaaaaagcacttccattccttctcctttgagaaaaaaattggtctcatttgcttctaaatagattcacatagaattctgatttgtgttggaaaaaattgttttgaaatacaacttaggttttattggaaattaaaagaatgatgttttggtgtagaacataaagtgaaattaaataatgattttttccataattatcttggtttgggaatactttataagataaaattttataattagagataaataggaaatatatgtctattataaagcttttctgaaggaaagaaaaatatgtataaactatgaaatgaaattgattttaattgaggttgttacaaatgataccctgttagattcattgacaatatgaagctagggaaaaatggtctaaattttcaaatcacagttcaagattctttatttcaacagcttcaaggagtaaaaatgtaaaagtacttcataaaacaacattacatttatttacttctccacaaatcataagaattcttgaaaggaattcagaacacttggccctaataccaggtacccaaacgtccttcatgaagtggagaaccttccctaagctatacattgcatgttgcctctaaattagtttgagtgtgaatagagctcttatgttcaaaaccagagatcttctgtcagaggaggaataattgaacatttgtcactttcaaaaccagtattgagcaaattttcataaataatctgtatatttggccacttgaagtgtgctcctgagctaaaatcaaaaacaaaaccacccattattgtgtcaaatgacttacttttaccaatagataaataattaaaaataaattcattataaaactttttaatgaaaactcgaattataaaactaaatatagtttctatgtttatgcagatgactaagacataaatcaaatgagtcagtggaaatgagtacgcacaaggtactaagataaaaacaccttattttacaaaaaaataccttcctgaatcaatgcaaaagagtcaactcattgtggatctacttactacatatcaggctgtgttctaaagactcttaaaaatactagaaagtctttagggaaacatgtgattatcttctaacataacagtggatcgtgttagtctaaatcgcattcgaggagaatcatgctttagtaatgtataatttttactcttgtacttgtttgtcataggacaagttctaccttttggtaagtataccaaaaaataattctcctaaagattatttactatatacatataaaactctatctcaagggattgattgctctaccagttttcagcatatcataatgaattgtataaattatctaatcataaatcgtctcttgttaataaaatacctaaattatttaacaagttgggtaagatggaaggcaagaagtggtaaactgattgacttttttaattattgaagataggtatccctatacaaaattcagatttctttgctctcaatttttccattagtaatgcataatactaaggaaaccacacacaattattttcctctcaatgaggagtttgtttcaataaatgagaattgtggttttatgctaggaattattgttgggttattatgttgctgtttgattgtttctgctcattatttaaatatttaatgagaggctttatccagcttgtattctgaggctttgaagcaaagggcataatttaaaatagctaagaagtaaataaatgtcatgatattaaaaaaaatgagatatgcaaaatatattaaaagcactattttaataatggaataataaattttacttttcacttgagatgatgaagtataaaaaatgagatttgatcagctgtaaaattttagaaacatggctatgcaatgctaatttttgtctgacagtctgttgcaatgcctgtgcctagttgctgctctagaatgatgagggtgatgtaaaatgggttctgctaaagattccttcaataaacttccaaatttctctttaacatcttccaaaatgacacacaatattgtacacactgcatccggaggatttttgttttctttttttcttttttttttgagacagagtctggctctatcgcccaggctggagggcagtggcgccatcttggctcactgcaacctccgcctcccgggttcacgccattctcctgcctcagcatcccgagtagctgggactgcaggcgcccgccaccacgctgggctaaatttttgtatttttagtagagacgcggtttcaccatgttagctaggatggtctcgatctcctgacctcgtgatccaccagcttcggcctcccaaagtgctgggattacaagagtgagccactgcacccggccaggaggaatttttaatggtgggtaggttgctcaaaactgtttttattcaaagagattagtaacactcatatgtacatatttacaactaagtaaatattatgatgaccattctacaaaatataataatatattatgatagaaaaatgtggatttaactactcgctgtcttcaaaaatatttcaggaatagttaatagaggatatatatatatatatatatatatatatatatatatatatatatataaaggttatgcttaaaaggaaacatgttttactttaaaacagaactcttaagtgagaggggtttgaaggttgcagcaaactaacatgagtataaatctttggcctaggtgtaagcaggaggaaaaataaaatggagattaagtacagaaaagcacataatgatatgagagtctcacacatactttgagaattttaaaatgtgttcaccaaagagaaaatgtagttgggctgtcactatctccttgactatgaattttatatttgataaaaacttggggaaactcaagatagagataaatctttttgcatggcaaagttcctctgtactcagtggtaatattctcagtctacaacactctggctgagtgatggcagaatgaaatgttcagttataataatgttcaattaattaacataagattgattaatgtttcaatatttaaatactactcactgaagccactgaatgttaaaatactagagaaaatgctaaagttaaaattttggttattggcatattttctttaattttacctattcctttaggaaatacccagataactactaaaacaatgagtgctaactgtaaattttccagttcattctcaaacccagagagctattttgagcagttagctgtttaacaagttacattctcactgtatgttactatttaattgtgcagcagaagcaataaattggtacccagatgccactgccaaacaaaagtactctgtaataggggttgccaatttttgtttactcacagattatgtatttatttattttgaggttacactaaaactatagacactcctttcacaaaattaacaagaatatatatagataatttttaatataatatcagaaatccataaaggcatttatcccattcataaatctcttctaagaatccatggatgcagattaaaaattttatttaaagaagaaaaaataaaatattcttatttacatttatgtacataatttctagatcagtgatgtctcttgacacgactaaataaattggtaacaaactctcaacaactatatttataaatgcatgtatataattctgttctgaaatattatatacataaaatgtacagaaaatcaaaatttaaagtgattagataaactaccttttcaagtattttaattctgtaaatgaatgttttttgtgatgctcactctacatcagatactcctgttataggttagaaacaaacatttcaattttgcctacttttaaatatttctgttatttgaaaaactgttttgccatgtttaaaacctttttatgtgcaaatgatatctgtgtatttttaccttataaaccacatggtatttggcttaaatattaaattttgttctttgtttagttaatcaaagtcaaagtgttatttagaaagatattcatttgagaccttacatttgaaaaagtaatggtttcaaaactattgaggaacagctggctgaatttctgaatttgggtggattaaagctttctagcagtaacttcttttacaaatataatataagctaccagtttgcactgaagtgcaattgactttatcaaatattttaaagtatttacttgatttatttgcagtgctaaagatacagagataaatacaattcggtccctacaattaaagatctttcagtctggtggcataaaaacatctataccagtttttattacttttacacacaagtggatcaatagataaaacattattgtttatttatctctttcagtgatctcagtaagttatatttattttaattccaccaaatatctagcaattggtcaatagttctttatttaaataatataagtcctaattttcttgccagggcaatacatattaaaggttagaatttaaatttaaattagtatttaaattcaatcttatattgtgtggaaataacagccatgaacatttcccctttacttggtcatgtcctctcttacaaaatttagtttagctcagtcatacatgtggctgctctttaaatagttgaggactcattatgtttccatttattgctttggtttctttatgtagcttcaatatattaataccataatctacacacataccttccaattatataacgtatattgaggtctgaggactccccaaaaatattttccttaatccttcactccaattctaaaaattcgagcgtgaaaaaagtaaatagcatagcaaaaatgacatcttcattactaatacagataaatcagatgatatagcttatctcaagaatcaaattcatctattggttgaacactggagaaattaccacagcagacttatgcatagcaaaactggggaagaattctgaatatggaagtcaacacaactcctaatgagacaaaagttataaagtgtttggaatttagttgagactttactacacacattcagcagatggtatattttcagcattcatgtgaatgaattttgtttacttttttcactacctccctacagcctttcttctctctccaaactgaatcttgggaaaactttgagagacattaaagtttgaggaactgattgctaagaatgtattgaaaaagtgtgcaattctgaacagtgagtaaagctttttacagaaataaccctactggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaa

SEQ ID NO: 843 - DNA, 30465 bp, Homo sapiens
tggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaa

SEQ ID NO: 844 - DNA, 48206 bp, Homo sapiens
agacctatcagcaaaattattacctttggaaatgtccttttgcctttaaggaactctacaatgaattactaatatttaagcaggcagttataaagttttatatctcaaaaatcagctatcaattttgcataaggtagtttagtttttgttgaaggacaaagatttctatttaaaatattatgtattttttgaagttaggaagaagctatgactagtttaacttatttaaaaattaattcagattttagggaccaaaccagaagatctagataattattatgcaattgttccatcagagaatttgttttctttgcaaaagctgaaatctgctatctacaatattgtagtagtccccaaaattgtctatgttctttattttttacttttttgtaataggtcattttattataaaattagttgactcctggatcatagcactgaaatattagagcttagttgtgcaatactgcaatttgcttggtgaacccttatgttcctgttaagccaagaactgtaacaaagctaaagtatcaatttgcaatgctctgtagtttctgaggataccagcaaatcatctatagtttgaataattataaatccctctggttggaaacatttctctaagttctataaatgactagaaaatattgtaggaaaatcccaaaacccttgaggaaacaattgtgataaatattgggttcttccataagtgaaagcaaataagaatctagttccattctctagaggaatataaagtatcaaaaattaaaacatagacaaattatagataaatacttccagaaaatgataccaagttcaaaagtcaggatacataattaggaaatacaggaattaatgttaagcttttgtacaaatctatatagtggtcaaccatctttatcaaatttatattcctcagatgtaaaaaagggcagcatatttataaataaatgttcaacatcactaattatcaagaaaatgcaaataaaactcacaatgaagtattacctcacacttagtggttattaaaaagacaagagataacaaatattgctgagggtatggacaaaagggaactcttgtgcactattcatgggaatgtaaattagaacaacaattatgacaatcaggtttagagtttcctcaaaaacttaaaaacagaattaccatatgatttagtaatttcactattgagtatccaaaggaaattaaatcagtgtcttaaagcgagatatatgagatatgcgatatatgaatcctcatatttgttgtgatgttatttagaataggcaagatatggaaattaagtgttgctgaatgaataaatggattaaaaatatcatatttattatacacaatggaatatattcagtagtgaaaaataagaaaatcctgtcatttgcaatgacatggataaacctagaggacattatgctaagtgaactaagctaaacacagaaagacaaatactgtgtgatcccacttatatgtggaatataaaacatatgaatttatataagcagacagaataatagttgacaggggctgaggatattgaccaaataatacaaattttcagttacaggatgagtaagttctgaggatctaatgtaagtatagcgaccacagttttactgtattgtttacttgaaatttgctaaaagagtagatcttaagtatcttcatcacacacacactcagacaaacctgcacacacacacaatggtaactgtgtgagggaatcaatgtgttaatttgattggagtaatcatttcacaatgtaaaggtatagcaaataaacagattgcacaccttgcacacatacaatttttattggtcaattatacctcagtaagtctggaaaaaatacctttttaatttactagaagaacaatgtaatattataggtgggtggcttatttacattatttatcttttcttaccattatataacaggctttgtttcttctgattgagctcttgaaatcagatatcattttgcatatggcatgcactttgcttttggtgaaatatttttattggctctatatctcaaagtacaccagtatcaagagtccctagctctgaaagtgttagatagatttgtccagataggagtgtttttccaacatggtgtgaaattaccactctctgccattccccaaaacaatgtagcttggggtgattttctagtacagtatgagcctgcaactctctgctataaccctttacattcacaaggtgcatggtaaccaaaggagatgcattttccccaaggaattctacagacactcactggtgtacagaatatggtaacctttaaattgcacagcaatttaaagcgggtctctcccaaacagctttataagagaaacaggagaaagtaagaatgtatgttcctcagcaagataacctatctgtatgggaatagtagagaaaaaggaaaaagtagaaggcttactcaaaatatcaataatttgtagtgctctttcaccaaatgaaaagccaaaattatctgagaaattgcagactaagtagcagcagtagcttcaattcccgcctctgagacttcctaaatgtgtccattttttttcagtgattcagctgcatttttttattatactttaagttctaggatacatgtgcagaacgtgcaggttttttacataggtatacatgtgccatggtggtttgctgcacccatcaccacgtcatctacattaggtatttctcctaatgctatccctcctctaatcccctaccccatgacaggccccagtgtgtaatgttcccctccccatgtccatgtgttctctttgtctttttttttttatactttaagttttagggtatatgtgcacaacgtgcagatttgttacatacgtatacatgtgccatgttggtgtgctgcacccattaactcgtcatttagcattaggtatatctcctaatgctatccctcccccctccccatacctcacaacaggccccggtgtgtgatgttccctttcctgtgtccatgtgttctcattgttcaattcccacatatgagtgagaacatgcagtgtttggttttttgtccttaggatagtttgctgagaatgatgatttccagctccatccatgtctctacaaaggacatgaactcatcattttttatggctgcatagtattccatggtgtatatgtgccacactaaatgtgtccattttaagacacctgtcagttattccttaggcttttgggctttcctgattctcgtgtttctacaatttctttacccttcagaatgtctttttacaatccctctcccaacatactggctttttgcaacaatgactggtcttttgcaacagttattatttctttattttctttatagaaagggtggctgaagtcgggataattccctttagtgaagagttttaactgagcagccaatacagcagtctttaattccttttttgtcttcgtctttctttaaattatctcaaactgaccagctggtgctaagattgaataataatctttctttgccatttaccaccttttttctaacttgagtttatacagttggcaagaaagccaagacaagttttctaagatgagagcatgagcttgatctgtctggtgaattttgaaaaagcttcagcaatttgctgatggaaattgacagagtcctccaatcttttgagtacacaactgcaacttcttccagctcatctttaatgaagaggctttaagtaatgccattaacatcccctcctgaggatctctaacacctttagttttttcatagctgagggaggtggtggataattgggtccccttaaccaaaatacttcacgacgttgcggtgttttgggccgtgatgtgcttggtccaccaaatgagcaaattcttctagttgcagaatttcatacagtagccagtgcataccccatacatgggctataagctaaaaacatactgcagaatatttccacaaatttctgtgacacagggattaaaagcctttaaatgaataatatcagctggccagaaagacatgtagattactcaggaggcctaggtagcttaacagtattagcttcactcttgatccatacaggaaaagtttgttttccttgcactgagacaagaaaaatatgaattagatagcactttggtttctctttctgtgttgatcttttccaaattaattttttttttgtcttttcctgagggactaatgcagcttctctccatcctgttgccttcatatggggcacagtcttttatcaacattttcagtgattcccagatcaagtttctttgtcatgtctaccttcctagcttcatgctgtatggattagaagggactcttggaagtggaatctaggctggccagaaagcacagaaatctgtgtcattaaataaagcaggcaattcatactggctgaaaaagttatgacctcatcccccttttcaggaaaacctaataatggaggaaactgtctatgtaaaaaaccatcacctccctctttcctagtgttagttatggacagaaaggcttaaagacaggcagggagggtagaaggagaagtgatagcagataaattttccacagactcatgcctccaaatactgagattatcatgtaaaaattgaaaatataagcttcaggaagagaagtaagaattgtatttctagaaaattaaagtagcacttgaatcatttgaaaaaataaatactaaaatatacttaaagtgagtattgataccatacctttgcaaatggaactaaaatttgggagttggtcagacatctttgtccaagaagagattagttgagcttttgtgtttgcctgattattatttcccatagaattgtaagaaaaagcatgaactctacattgtaaagcaaaacaagagaaagacaaattaaaaagcacttccattccttctcctttgagaaaaaaattggtctcatttgcttctaaatagattcacatagaattctgatttgtgttggaaaaaattgttttgaaatacaacttaggttttattggaaattaaaagaatgatgttttggtgtagaacataaagtgaaattaaataatgattttttccataattatcttggtttgggaatactttataagataaaattttataattagagataaataggaaatatatgtctattataaagcttttctgaaggaaagaaaaatatgtataaactatgaaatgaaattgattttaattgaggttgttacaaatgataccctgttagattcattgacaatatgaagctagggaaaaatggtctaaattttcaaatcacagttcaagattctttatttcaacagcttcaaggagtaaaaatgtaaaagtacttcataaaacaacattacatttatttacttctccacaaatcataagaattcttgaaaggaattcagaacacttggccctaataccaggtacccaaacgtccttcatgaagtggagaaccttccctaagctatacattgcatgttgcctctaaattagtttgagtgtgaatagagctcttatgttcaaaaccagagatcttctgtcagaggaggaataattgaacatttgtcactttcaaaaccagtattgagcaaattttcataaataatctgtatatttggccacttgaagtgtgctcctgagctaaaatcaaaaacaaaaccacccattattgtgtcaaatgacttacttttaccaatagataaataattaaaaataaattcattataaaactttttaatgaaaactcgaattataaaactaaatatagtttctatgtttatgcagatgactaagacataaatcaaatgagtcagtggaaatgagtacgcacaaggtactaagataaaaacaccttattttacaaaaaaataccttcctgaatcaatgcaaaagagtcaactcattgtggatctacttactacatatcaggctgtgttctaaagactcttaaaaatactagaaagtctttagggaaacatgtgattatcttctaacataacagtggatcgtgttagtctaaatcgcattcgaggagaatcatgctttagtaatgtataatttttactcttgtacttgtttgtcataggacaagttctaccttttggtaagtataccaaaaaataattctcctaaagattatttactatatacatataaaactctatctcaagggattgattgctctaccagttttcagcatatcataatgaattgtataaattatctaatcataaatcgtctcttgttaataaaatacctaaattatttaacaagttgggtaagatggaaggcaagaagtggtaaactgattgacttttttaattattgaagataggtatccctatacaaaattcagatttctttgctctcaatttttccattagtaatgcataatactaaggaaaccacacacaattattttcctctcaatgaggagtttgtttcaataaatgagaattgtggttttatgctaggaattattgttgggttattatgttgctgtttgattgtttctgctcattatttaaatatttaatgagaggctttatccagcttgtattctgaggctttgaagcaaagggcataatttaaaatagctaagaagtaaataaatgtcatgatattaaaaaaaatgagatatgcaaaatatattaaaagcactattttaataatggaataataaattttacttttcacttgagatgatgaagtataaaaaatgagatttgatcagctgtaaaattttagaaacatggctatgcaatgctaatttttgtctgacagtctgttgcaatgcctgtgcctagttgctgctctagaatgatgagggtgatgtaaaatgggttctgctaaagattccttcaataaacttccaaatttctctttaacatcttccaaaatgacacacaatattgtacacactgcatccggaggatttttgttttctttttttcttttttttttgagacagagtctggctctatcgcccaggctggagggcagtggcgccatcttggctcactgcaacctccgcctcccgggttcacgccattctcctgcctcagcatcccgagtagctgggactgcaggcgcccgccaccacgctgggctaaatttttgtatttttagtagagacgcggtttcaccatgttagctaggatggtctcgatctcctgacctcgtgatccaccagcttcggcctcccaaagtgctgggattacaagagtgagccactgcacccggccaggaggaatttttaatggtgggtaggttgctcaaaactgtttttattcaaagagattagtaacactcatatgtacatatttacaactaagtaaatattatgatgaccattctacaaaatataataatatattatgatagaaaaatgtggatttaactactcgctgtcttcaaaaatatttcaggaatagttaatagaggatatatatatatatatatatatatatatatatatatatatatatataaaggttatgcttaaaaggaaacatgttttactttaaaacagaactcttaagtgagaggggtttgaaggttgcagcaaactaacatgagtataaatctttggcctaggtgtaagcaggaggaaaaataaaatggagattaagtacagaaaagcacataatgatatgagagtctcacacatactttgagaattttaaaatgtgttcaccaaagagaaaatgtagttgggctgtcactatctccttgactatgaattttatatttgataaaaacttggggaaactcaagatagagataaatctttttgcatggcaaagttcctctgtactcagtggtaatattctcagtctacaacactctggctgagtgatggcagaatgaaatgttcagttataataatgttcaattaattaacataagattgattaatgtttcaatatttaaatactactcactgaagccactgaatgttaaaatactagagaaaatgctaaagttaaaattttggttattggcatattttctttaattttacctattcctttaggaaatacccagataactactaaaacaatgagtgctaactgtaaattttccagttcattctcaaacccagagagctattttgagcagttagctgtttaacaagttacattctcactgtatgttactatttaattgtgcagcagaagcaataaattggtacccagatgccactgccaaacaaaagtactctgtaataggggttgccaatttttgtttactcacagattatgtatttatttattttgaggttacactaaaactatagacactcctttcacaaaattaacaagaatatatatagataatttttaatataatatcagaaatccataaaggcatttatcccattcataaatctcttctaagaatccatggatgcagattaaaaattttatttaaagaagaaaaaataaaatattcttatttacatttatgtacataatttctagatcagtgatgtctcttgacacgactaaataaattggtaacaaactctcaacaactatatttataaatgcatgtatataattctgttctgaaatattatatacataaaatgtacagaaaatcaaaatttaaagtgattagataaactaccttttcaagtattttaattctgtaaatgaatgttttttgtgatgctcactctacatcagatactcctgttataggttagaaacaaacatttcaattttgcctacttttaaatatttctgttatttgaaaaactgttttgccatgtttaaaacctttttatgtgcaaatgatatctgtgtatttttaccttataaaccacatggtatttggcttaaatattaaattttgttctttgtttagttaatcaaagtcaaagtgttatttagaaagatattcatttgagaccttacatttgaaaaagtaatggtttcaaaactattgaggaacagctggctgaatttctgaatttgggtggattaaagctttctagcagtaacttcttttacaaatataatataagctaccagtttgcactgaagtgcaattgactttatcaaatattttaaagtatttacttgatttatttgcagtgctaaagatacagagataaatacaattcggtccctacaattaaagatctttcagtctggtggcataaaaacatctataccagtttttattacttttacacacaagtggatcaatagataaaacattattgtttatttatctctttcagtgatctcagtaagttatatttattttaattccaccaaatatctagcaattggtcaatagttctttatttaaataatataagtcctaattttcttgccagggcaatacatattaaaggttagaatttaaatttaaattagtatttaaattcaatcttatattgtgtggaaataacagccatgaacatttcccctttacttggtcatgtcctctcttacaaaatttagtttagctcagtcatacatgtggctgctctttaaatagttgaggactcattatgtttccatttattgctttggtttctttatgtagcttcaatatattaataccataatctacacacataccttccaattatataacgtatattgaggtctgaggactccccaaaaatattttccttaatccttcactccaattctaaaaattcgagcgtgaaaaaagtaaatagcatagcaaaaatgacatcttcattactaatacagataaatcagatgatatagcttatctcaagaatcaaattcatctattggttgaacactggagaaattaccacagcagacttatgcatagcaaaactggggaagaattctgaatatggaagtcaacacaactcctaatgagacaaaagttataaagtgtttggaatttagttgagactttactacacacattcagcagatggtatattttcagcattcatgtgaatgaattttgtttacttttttcactacctccctacagcctttcttctctctccaaactgaatcttgggaaaactttgagagacattaaagtttgaggaactgattgctaagaatgtattgaaaaagtgtgcaattctgaacagtgagtaaagctttttacagaaataaccctactggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaacaagttaccagaaaagtaaggccaatgacatagagttcttaagaagtatgaaaaagccctgtactatcctattcatttgctaaatgttgcaaaaaaacaatagcctaagaaaacataatacgtctacacatcttgagctcattttaacgtttacataaagtttagaattaactgaagtcttaatagttattaagaagttccttttatgtgttaaatatgtatttttttgtattacattttgtataagaaattgttacggaaatactaacataatctgtgtttcagaatagctagaaacaaacaaatgaataaatgtgataggtttaaataaaatatttgggaggttgcagataattgatttatctttgaaaaaggttgaaaaaaatcttagtgagatttgagaagacaaataaaagttactgcaacaataacattatctgactgtggaggaaaaaaataatgcctctaatctctctcctaccagtaggggaagggtggtaaatgaagaaaggcctggaaaagaaagaatcaactatgaaagactataatgcatctggacagtccctaaggaggtttaagaatcttcctttttttcaatgacgtgtctgtattgcctttgatagtaaatcacagttgctgtttaataaaagtttatattaaattctctactgagcacttcttaaatgacaaaagcaaatggcagcatatactctctagaaaagtgatgtctttatttgtggaaaaatgtaatttttgtaataatggctgtgtaaccactcttcaccaagctaaaagcagaagttttacacatgtgcctcatcttattgcctagtagctgcctagtttattttatggtagcagctcttgggtgttaatcaaatctgaagttctcaatgcccctagtaccaacagtagcccatattaagtgcttaaatgtatttgttgcaagattggataactgaagtgtcctttggcttagacctgagaaatgaaagataaatatgtaaaataaaaacattactattttcaattcttcaaagataaatcagtaaataaattataagaccactaaaatgtattcctattatatgaaacctaatagttatttaaaattgctcctccattttacatttactatttcttaagcataagaaaagtcaataatatcctttgagaattagtcacaaatgcttaatattaagtgtatagaaaactttctttctgtgtaaacataatcttataatacttaaaaaataaagtcaaacagtgtgttatatatgaaaaacactatatgcgtttgcttttttgggtccacactttaaaagatactggaaaaacacttagaaggtcactgcattaaatgttttcttttttttttttttttaaggcagagtctcgctctgtcacccaggctggagtgcagtggtgcgatctcagctcactgcaagctccgcctcccaggttcacaccattttcctgcctcagcctcccaagtagctgggactacaggtacctgccaccacgcccggctaattttttgtgtttttagtagagacggggtttcaccatgttagccaagatggtctctatctcctgacctcgtgatctgcccacctcggcctcccagagggctgggattacaggtgtgagtcacagcgcccagcctaatgttttcttacttattagaaatgtggacttggaaataatccaaaatgttaattaaatttattttaatttctaggcaaaaaatgtttaaatttttgtgtatctcctcattttcaattgtcactggagattgacttaaaacaagcttagtaacaactttgtaataaatgatcccaaatttagaaaatatctacccatgtgtgtctaatgtgaatggcccctttatgccataatttaaacaattttttatctctaagaactgttacactcataactgtagcatataaagaaaaggccaatttgtgtcatttgatgaaagcaaaacaaatatttaaattatggatataatatttttcacataagaattttaacataccatagttcaattgttactacttctcactcaacattctacatgcttgaaatttgtttaatcttcacatatggcactataaaatgtgcatagctgcacatgtaccttatcttactgcttagtagctgctttagtagtaattatcagtatttgccttattttaccgcctagtagttgccttaaaagttattactatttttcacatgaagaatctcagcgcccataagcactgtgtagacataatcagaataatgtgaatttgaggtgcctttcacatgtttaacacaaagggacaatattgcttaatacgtcgatattgaacaacaccttttttcaggataagttgatataatatgttcgctatatgttccatgagaagcaatttatagtcccaactattctcttaaaaccaaactagagataccataattagtagctgcattcaatgtcatctacgaaggtggagtttcttctccagttctagaatacgtgtttggatatccaatgacctgttacataaactttataactaaatataagtcaaatttgtcggctgtggctcaacccttgggattcaagtcaattgtctcttatgacacatggaggcaaaaagcagtgtaattgtttttcagtttttaaaatgtgctataaatgtagtgaacaaacacttcagtttccccggaaaagtctcaatttatgcctgctgcaatgaagtaccataagtgtcccagtttggatgataaacaaggtggttaacgctacccataaactcacttctgatagtgtagttgttatcatactgacttttatttggaggagaaaagtactgcaagatcaatgcatatttcctcagatgtaggaggtgtcctgaaatggcaatctgcagaaaatggaagggtaaaaacacagaagtttgaaaatggtgaccaaaattaataaagggatgtatgatctcctaaataccccataaaatgttcttgaagtaaaatttcacagaaccaactaactatataggcaggcactattgtttacaaattgattcacaaactgtaaatgtcaatgggtgaatgagctctcagagcatttcacagtgctaagattaaaatacatgctacttctctgattgctgtaaacagtagttttttattttattgcagatctttaactctactattccagaaatgacagttttaaaagtgtcataaaaatgaaatttcaatacactgtcaatcatcctgattccatattgactgaagaagaataaaatccacttctcaagaattggcttattgtatgctcgtgtcttataattattgtctcattgattctgccaaaagagagttaattgaattttaagcatattgaaatgatgtttttattctgacaatatctttattccttacaaataaatttagagcataaacaagaatatataaaacaatagttattattcatacttcccatgaaatatgaatatttgattacctctgtgacttagatgatttatacaacatatgtattgattgagattaaaaattagactgcttaaatctattacctgttttcttattccttatcaacattcctgatcataatttctggtgttgaaatactacttagaaaatttttaaaatgcagtcattttaaaatcctgtgcttgaggataggaatatgttctaagaaattcattgttaagagatttttgtcactgtatgaacatcataggatgtacttacacaaacctaggtggtgtagcctactgcactcctaaggtatatgaatagcctacttctcctagtttgtaaccctgtacattacattactgtactgactactgtgggcagttgtagtaagacagtggtacttaccattgtgtatataagcatagaaaacgtccaataaaaacataatattataactttatgaaaccacagtcatatatgcagtccatcattgactgaaacattcttatatagtgcacggttgtaccatatttataataaaaatattgtgattaatattaacttaattttttaaatgtttttggctttaattactacaatgtcacttgacttatttttctatatactcttgtgtcaaggctagcctgttaattaaactgttttaagttccaaaaaaactgcaaatgcaaattctatcattttattcactaaattatcaaataatttattccaataacacatttacttgatcttctctttagatgacattatagttattaaggttaaggtgtgcattatgtttctattttataattacaaatatatttaatctaccaatgtattttaaacaatataaattatactaacattagttgcttctgaaagactctaataacatattctcatcactaaatttacaagatactttgctaaatttatttttttataatacatatacatacacacacactgtgaaattttgtaaatgtaaaagtataaagagagaaattaaactgtcctataatgccatttatttataaataactaacataaatatttgcatgttttctgtcattgttttttcgtaactgttgatgtattttatactgtagaccttttatgtgatagcttttctgtgatcatatcttcctttttttaagtagatgtcaatgtctctagtgtcttataattagaagcctatgtcatagacaataagggtggtatttctacacagtttttcctctgctatcagtaagcctgccacttattgaacttgaacctgagctcattttccattttgatatgccaattacgagcctaaaacaagtaactgtaaataataccatttaacatttagaacagtacagagtacagctctccaaatgagtttagcaatacttagagccagatttgtttgtgacaatgtaagttgatactattgacatttaggatgtgaactcaaaggagctacacatcctgcaatgttctggttatttcctaccaaaaagacatactgctaacattgagacacagatgggcatttaagaacaaatgtttttacttaaaaacaaaaaaaaaaaatttgccttgctcaagatacaagaatgtattcccaggaaaatatatgttggctctaagtatctttcctcttttgcatggtgtttcaaattatttctcagctatgcttcattgatcatgattggagttatgacatttttcctaactgcaaagaaggagaaacatttctcctccattttctttttggctttgatgttgtcagtggattcaaggaacagacgtaaaacaactgattttttttttttttaaccagaagctttaatctctaccagagaaatccttttaatacatgagaaaaagtaagtggaaaaaatggcgcaataattattctgaagattggggatagaatgctgggtatattctggggaaagaatgtaatttcacatatgtcaatagagatgtatgtgtgggaatacttaccatataattatattaaaatgcataagattatttttaaaaagcatccagaataattgtggagcatgttcagtaataagaagtgaagttcttcaacattttaaactcaagaaacataggtggatcacctgaggtcgggagttcgaggctaccctgaccaatatggagaaactccatctctactaaaaatacaaaaattagccgggcgtggttgcttatgcctgcaatcccagctacttggtaggctgaggcaggagaatcgctcgaacccaggaggtagaggaaatgctggggaaagaataggctatattcagggaagggtcatgccattcattacagaagaaaagaaaaggatggatgttactgccagtaaatgatgacaacatggaattatattattcctgcttattcatgctattttctaaaactcaaatctctctaccaaaatctagactgttatattcaactacattattaactttgctatttgaatggctgttttattacctaaatattaataaatcaaaagctgactttttgaccatcacccccaaacctgctccatccacagcccccacttcagtttactaaaactgcctttacagttgtatagattaagaacaatggagtcattcttgactccctttgcaatccatgttcagtccatcaggaaattgtattgagtctgtttttaagaatataaacaaaatatgacccttctttatctcttccactgctataatcctggaacaacccaccatgagttattacttggattactgtaataagctgccaattaattaatgctctttgttttaattcttaccccagaaaaattgattctattgcagatagtctttgaaaaataaatgtgatactgtcattccgctcaaaatgttgcaatgttttttcgtgtcatgcagagtaaataccagatcttgtaattgtcttctctgagacctatcttggtaatttcccctttcactctgttctgagcacattggtatccttactcctcctgcaatactctaggcacactttcactttatgatgcatgcactagaaatattcctggaacacacttagattttatattgtcatgaataacttcttcatctctttcaagtctttactcacatgttactctttcattgaaggttataactaatcacactagggatattactctttacttatacttctgatttatattactctttctttcttttattcatgtagttgtacttctttcttttacttatatagttatcttttataacaagatactttattcagtgatatagcctaagtgcctagaacagggttctacacaggacaggagctcaggaaataatcgttgaataggtgaatgaatatgaacctgagagggaaggttatccgcagagagtgatttaatggctgcttttcaatcttcgacatgtttttcaccacagagcttttgacacagttagccttgccttctacttggaaatatttctccatataatcaaggtttctttcctaccactttggaaactccacttaaatatgtttcttgcctttaaaatgttgaagaacttcacttcttattactgaacatgctccacaattattctggatgctttttaaaaataatcttatgcattttaatataattatatggtaagtattcccacatatacatctctattgacatatgtgaaattacagagtcttgcaagttgtagctgtaactgtagctggatatcttcacttaaattttgttgtctttttaatctccatactgctaaccagttctcttattttatcctatacagagaagccataatcatatatttaacatgtaaattaacttttgttactttcatcatacatataaaacaaagaatggcttttatactcagctaagtcctccatgattggcctacacctacctctctaaacatattttctacaaatctgattcttactaaatctgcttaagccacaatggctttttcaatatcctcatctcagagttgtttcagttattgttcttacgtcctactgtccccataatttatcctagtac

SEQ ID NO: 845 - DNA, 48894 bp, Homo sapiens
gcactcaggttatctgaatatccagcattcaagttcttaaatatcatgttgtgcttcctgtcagatatgttaaataactatttgttacatgaactaatttttgaattccttaggacaagactttttattacaaaattttaattaatttattcatatattattaaaatgagaaatatgcattaataatttttctttgcaggaggaaatcattgaaaattggagtagcctgaaacagaagatatacaagggtttcacattgttgttttgagtgttacatctatatttaataatatcacataataaatcctgctcattaaatataatgacattaaaagtagaattcagaaaagaaaagaaagcggaatgaatctctaaaatttgttttgatgacaacttatcagaaaccaattgcttagaaatagtttgcatttcatgtattttatttgagcattcatattattttaaaaaatcatcaaagtttttacatttatttaacataattatttaataattgagtaaatgtcaacaaataatactctattcagtttgacatgaaaaatgagtacttaaattatcggtattaatacaagaatttaatagaatggtaaatttgattaaaaacaaagaactgcaaaagttcccttactttatagtgtcattgtacaaataataaagaccttccatgtgatttgcattttgagagataatatggggtgctcaatttttatgactggctgtggagaacaagttaatcaggctctggttgggatgctgggtatttaaataagtgaatgtgaaatgaagacagtttgaaatgggactctattgcatatgataacatgggcaataagggaaaaatgcaaaagttttacataaaaagtattctggttgaagaaaggaagtatcagcttggtaacgtatctttcctaagcaaagtagaagactcagttaccagtgtctctatttatttcaatggacattagtattgaccatgttcaatcctggaagggttggaggtaaggtatggttcaggtatttttcaggtatttttgtccagatattctatccagaaatgccaaccaaatttcaaattatgtgtggtgattatattttgtgaaaatatcttgctagactttcttttccgtcacaagtagattatctaataatctcaatattgatcctgttttatttttaaaaagttttcattaaaaacactgtagaagaggcttattgaagtcagatcatctctgccttggtagaggacacagcacaacaaaaggctgagtgtcagtcacttaaatgtttatgcgcaattgaaagtatgatataaaaatcaagtggggccaggcatggtggctcacgtctgtaattccagcactttgggaggctgaggcgggcagatcacaaggtcaggagtttgaaagcagcttggcctacatgatgaaaccctgtctctactgaaaaaacaaaaattagctgggtgtgttagtgagcgcctgtaatctcagctactctggaggctgaggcagaagaattgcttgaacccaggaggtggaagtttcagtgagccgagatcacgccactgcactccagcatgggtgacagaggaagactcaaaaaaaaaaaaaaaaaaatcaagtggactcaggccagaggcagtagtatatgaggataaacaaaaaggcaaaatcaaatcacaaattaaaaattgaatgctaactttgatactccacatctttctttaaaatgttttttagttggctgcatacttaataaaatagatgtttatattgtaatgtttcctcgagagagttgaagactaaattttttgcaggctttgttattgtaaatagtgaaagagtacatatccatgtatatattttaccactcatgtttaaccatttattgaagaattttgtggacatgtctataagttagattggtctgttctttgcttttctggaataattctgttaagttttgctataatgtgttaggaaaataaaatataaaaaagtcttctcccaacccagaaaatctcttctcaaagatagaaaagagaaaaacgttttatttttgaatgagcataaaacccgaatgtgatgtgcatgaaaggcaatctgttaaaggtttgcaaagacagaaaaaatttcaccctttcatatagccaagcaggtacaattcattaaatacaggttctcaaaaaagaatagaaaaaagataacttgataacaccatttgtcacacatagttcatcttaaactcacttggtaattgggataaccatctgttttagctatttgtcattatttaaacgaaaaatacacttcaggtttctttatgataaaaggcagttttgaaatttaaagggaggctcttctgcccaagttaggtttctattttctcaaaaaaactggaaggtagaaagctctcttctgtggtatgtatatttcaaagagatgtttctcaagtccttgagaaaaacattctcaggtcacaaagctggcaagagtcttatttagcttttaaaaagatgtatatacatttcaaagaaaaaataattaacaagttaatcttcttacaaaagggtgagttatctttatgttgatcatggagaattaagccttttattttaaatttgaatttgctattacaatctcttatctgtgttactaaacaatagtaatattactattttctaattatttttattgttgcctctacctttctcagcaaattgcagtcatccaaatatctagcaagtccatagtaaaataggaaaaaaaatcaacatcaaaattatgataatataattactgattttgtaaaaaatcagtactttatttgcattggggaatgtattagtccattctcacactgctaataaagacatacccgagactgagtaatttataaaggaaagaggtttaattgactcatagttccacatggctggagaggcctaaggaaacttatattcatggcggatggaacctcttcacagggtggcagaagatggaatgaatgctgagtagaaggggggaaagccccttataaaaccatcagatctcatgagaagtcactcactatcactagaacagcatgagagtaaccgccctcatgattcaattaccttccgccaggtccctcccatgacacgtgggtattatggcaactacaattcaagatgagatttgggtggggacacagccaaaccatcccattctaccccggcctctcccaaatctcatgtcctcacatttcaaaacagaattatgccttttcaacagtcccccaaagtgttaactcatttcagcattcactcaaaagtctacagttcaaagtcacatctgagacgaagcatgtcccttccacctttgagcctgtaaaatcaaaaacaagttaattactttctagatacaataagggtacaggcatttggcaaatacacctgtcctgaatgggagaaattggccaaaacaaagcagccacaggccccaggcaagtccaaaatccaatagggcagtcatcaaaccttaaagttccaaaatgatctcctttgattccatgtctcacctccagggcaggctgatgcaagaggtgggctcccacagccttgggcagctcctcccctgtggctttgcagggtacagcctccctcctggctgctttcaagggctggcattgagtgtcagtggcttttccaggcacagggtgcaagctgttggtggatccacgattctgggatctggaggacagtggccttcttctcacagctccactaggcagtgctccagtggcgactccgtgtgggggcttcagtcccacatttcccttccacactgccctagcagagtttctccagtggactccacctctgcagcaaacttctgcatgaacatccaggaatttccatacatcttctgaaatctaggtggatgtccccaaacctcaattcttgacttctgcacatctgcaggcccaacaacatgtggaagctgccaagacttggggcttgcagtctctgaagcaatgatctgagctgtacactggttccttttagccatggctggagaggctgggatgcatggaaccaagtcccaaggctgcacagagcaggagggccctggggctggcccaggaaatcatttttcccttctaggcctctgggcctgtgatgagagggactgccatgaaggtctttgaaatgtcctggagacatttttcacattgtcttggtggttaacatttggcacctcattacttatgcaaatttctgcagtcctctcaaatttctccccagagaatgggcttttttgttgttgttgcatcatcaggcagcaaattttccaaactcttatactctgcttccatttgaacattttgctacttagaaatttctttcaccagataacctaaattatctctctcaagttcaatgttccacagatctctagggcaggagtgaaatgccaccactccctttgctaaaacatagcaagggtgacctctactgcagtttccaacaagttcctcatctccatctgataccatctcaacctgaatttaattgtccatatcactatcagcattttggtcaaaaccatttaataagtctttaggaagttccaaactttcccacgtcttcctgttttcttctgagccctccaaactgtttcaacctttgcctgttacccagtaccaaagttgcttccacatttttggtgttcttatagcagcaccccattctacttgtaccaatttaatgtaatcatcgtttctcatgctgttaataagggtaatttataaaggaaagaagtttaattgactcagaattctgcatggctggggtggcctaaggaaccttaccatcatggctaaaggcacctcttcacagggaggcaggagagggaatgagtgccaagcaaaagaggaaaaagcttcttatacaaccatcaggtctcatgcaaactcgctagctatcacgaaaacagcataagagtaacggcttccatgattcaattacctcccatcaagtccctctcacggcaggtggggattatacaaacaacagttcaagatgagattcatgcggagacacagcaaacgatatcggagataacctttgaatataccatactaatgatgaatggttaaatcagattattgattagcaagccacaaaaatgcttctttgccatatattaattatacaaattgttattgtctttagtgtttttcaaatgattaaccaaataaccatttagtagttctttataaagtcctgtctcatccaaacccaaggaatagcttgattctggagccaggtaatgtaactttttaatgagaagttttccttgcaagtgataacaaataacatttgagttttagttcatcacataaatatcataacaatcatatgacaattaggccttttaacaatttttccattttctccaattttttttgtcgatgtgaaatgcaaagatattcatggccatcttttagtatcaaaattttattatgagacactattgaaaggtacagattaagtttctattgttaatgtatacagctgtaactattttaaatcttatggacaaactctaagagcctttttggtctgttggtttgctttcatttggcatgagaaaagaatcaatagttatcctgttataataattaaataaatctttgtgaataataggtattcacttttgtttatctgtatatattaagattggagagacccttaatcccaatttatcctagtgacactagacatgtcttttgcagtctctatctgtaaatgccagatatatgtttgtctacttattacatgttatttgtttctacattatctttctaacatattttttagtatcaaattagagcttgagtgtctggatgcatattaattaattttactttgttgttttcaaacattactaatgaaaatgatgtcatttttgttctatcagtaatcagactgttgtatttatgagtctagaccttgtttttattggaagtaaaatttagaactggtagaaatgagatggtgagaattgttacttggtgtattagtttgctagagctgctgtaatagagtaccccagactgagtggcttaaacaacaggaatttattgtcttacagttctagaggatagaaacccaagatcaaggtgtcagcagggctggtttcttctgaggacagttagagtagttctgttcaatccctctcacctaacttctggtggtttcctgacaatctttggtgttccctggcttggaaaaacatcagcccaacttcttccttcatctcctcatggctttaaccttgtttccttgtgtgatatgagtacaaatttctccttttttgtaacaacacctttcataatgaattggggtctaccctattccagtattatcttaagtaattaaattgatattagctgtttttccaaataaagttatattctggagtactaggggttaagacttcaacatataaatactgggggactcaatttaacccataacacttggattgcagaaaaaaagaagtacaatagacaacatgttggctttccagtaaaatatgatttttttcctttttctttttttcttttttttgacaggcgtttgctttgtcatccaggctgcaatgcaatgacataaccttgactcatggcaacctctgcttcctgagttcaagtgatccacccacctcagcctcccaagtatctgggactacaggcacatgctaccatgcccagttaatttttgtgttttttttagagatagagttttgctatattgccagggtgttctcaaactcctggactgaagtgatcagtctacctcagactcccaaagtgctgggatcacaggcatgagccaccgtgcccagttcaaaatgtgattcttaaagaagaaattgaaataaccctactgtgactaagatgggaggcaatctgtaagaatagtaataaatttgctagaatatctcctttcagctgtgttcagtacaacaattggctactttagaaaacgtaaagtttctagtctttgtaggacccccagtccagttttcctaagatgtttgcttcacatggaaagtatgaatcttgttttttacttttgttttatttttacttagtttgtttttactttgatagctctataggtaactgggagcatttaaaaatgtctttctcaaggagataaaagcctttcgtcccatcggaacaccttaatttgtgaaatcttttggtcaataggcttggcaggcttctggtgggtcctaccaggttcttatgactttttagctcagacttaccagggaagagagaagccatttgaggtgataaacatcattatgagaggattcagttaaatcaggcacacaaaaaaagttgtaccaaaattcataagtctgccaaacagaaattcaaagaaaagagttcatatttgcttgtaaaggttgctctaactttaaggtggtagcaaagctctaggtcatcttaatataggaagtggcagaattttagacaattgagttttttgtttgatttgtttgctctattttccagaggactcagccttacaggaatctgtaatatttgcataattcctagataaccatagaaataaaatattttttttctgtctgacttaaatactatggcatcccaagagcagaaattacatttatcaagagagcgtttaccactgcccaaacattagtttcatgaattggggaaaacatcagaccacccagatattatacacaccacaactagacaaaaaatctcaccttaccttctataagctttcgttctatgaaatccaactgccataatatttctagtaaaattgttaaatgaaaacttcctatagttagtttgggtgtggcatgaaaataattctgctcacaaatagcatatctcttttatgttttgaacaattttatcttattattaggtgtcattaagattctagtgcccttaaaatccctctctcattcaaattgttttattggtggcataacaaccctaagccaataggaggctgtgatattggaattattttgttaggtaattcccacaatcaaccacatttattttagcccatttttaaatccatatgtccatttatttatctctacatagttttaaaatgaacaactttttattgttttaaaagtggagcgtacaaggttgaactatatcatgtttttaacaacagcttttacagacctatcagcaaaattattacctttggaaatgtccttttgcctttaaggaactctacaatgaattactaatatttaagcaggcagttataaagttttatatctcaaaaatcagctatcaattttgcataaggtagtttagtttttgttgaaggacaaagatttctatttaaaatattatgtattttttgaagttaggaagaagctatgactagtttaacttatttaaaaattaattcagattttagggaccaaaccagaagatctagataattattatgcaattgttccatcagagaatttgttttctttgcaaaagctgaaatctgctatctacaatattgtagtagtccccaaaattgtctatgttctttattttttacttttttgtaataggtcattttattataaaattagttgactcctggatcatagcactgaaatattagagcttagttgtgcaatactgcaatttgcttggtgaacccttatgttcctgttaagccaagaactgtaacaaagctaaagtatcaatttgcaatgctctgtagtttctgaggataccagcaaatcatctatagtttgaataattataaatccctctggttggaaacatttctctaagttctataaatgactagaaaatattgtaggaaaatcccaaaacccttgaggaaacaattgtgataaatattgggttcttccataagtgaaagcaaataagaatctagttccattctctagaggaatataaagtatcaaaaattaaaacatagacaaattatagataaatacttccagaaaatgataccaagttcaaaagtcaggatacataattaggaaatacaggaattaatgttaagcttttgtacaaatctatatagtggtcaaccatctttatcaaatttatattcctcagatgtaaaaaagggcagcatatttataaataaatgttcaacatcactaattatcaagaaaatgcaaataaaactcacaatgaagtattacctcacacttagtggttattaaaaagacaagagataacaaatattgctgagggtatggacaaaagggaactcttgtgcactattcatgggaatgtaaattagaacaacaattatgacaatcaggtttagagtttcctcaaaaacttaaaaacagaattaccatatgatttagtaatttcactattgagtatccaaaggaaattaaatcagtgtcttaaagcgagatatatgagatatgcgatatatgaatcctcatatttgttgtgatgttatttagaataggcaagatatggaaattaagtgttgctgaatgaataaatggattaaaaatatcatatttattatacacaatggaatatattcagtagtgaaaaataagaaaatcctgtcatttgcaatgacatggataaacctagaggacattatgctaagtgaactaagctaaacacagaaagacaaatactgtgtgatcccacttatatgtggaatataaaacatatgaatttatataagcagacagaataatagttgacaggggctgaggatattgaccaaataatacaaattttcagttacaggatgagtaagttctgaggatctaatgtaagtatagcgaccacagttttactgtattgtttacttgaaatttgctaaaagagtagatcttaagtatcttcatcacacacacactcagacaaacctgcacacacacacaatggtaactgtgtgagggaatcaatgtgttaatttgattggagtaatcatttcacaatgtaaaggtatagcaaataaacagattgcacaccttgcacacatacaatttttattggtcaattatacctcagtaagtctggaaaaaatacctttttaatttactagaagaacaatgtaatattataggtgggtggcttatttacattatttatcttttcttaccattatataacaggctttgtttcttctgattgagctcttgaaatcagatatcattttgcatatggcatgcactttgcttttggtgaaatatttttattggctctatatctcaaagtacaccagtatcaagagtccctagctctgaaagtgttagatagatttgtccagataggagtgtttttccaacatggtgtgaaattaccactctctgccattccccaaaacaatgtagcttggggtgattttctagtacagtatgagcctgcaactctctgctataaccctttacattcacaaggtgcatggtaaccaaaggagatgcattttccccaaggaattctacagacactcactggtgtacagaatatggtaacctttaaattgcacagcaatttaaagcgggtctctcccaaacagctttataagagaaacaggagaaagtaagaatgtatgttcctcagcaagataacctatctgtatgggaatagtagagaaaaaggaaaaagtagaaggcttactcaaaatatcaataatttgtagtgctctttcaccaaatgaaaagccaaaattatctgagaaattgcagactaagtagcagcagtagcttcaattcccgcctctgagacttcctaaatgtgtccattttttttcagtgattcagctgcatttttttattatactttaagttctaggatacatgtgcagaacgtgcaggttttttacataggtatacatgtgccatggtggtttgctgcacccatcaccacgtcatctacattaggtatttctcctaatgctatccctcctctaatcccctaccccatgacaggccccagtgtgtaatgttcccctccccatgtccatgtgttctctttgtctttttttttttatactttaagttttagggtatatgtgcacaacgtgcagatttgttacatacgtatacatgtgccatgttggtgtgctgcacccattaactcgtcatttagcattaggtatatctcctaatgctatccctcccccctccccatacctcacaacaggccccggtgtgtgatgttccctttcctgtgtccatgtgttctcattgttcaattcccacatatgagtgagaacatgcagtgtttggttttttgtccttaggatagtttgctgagaatgatgatttccagctccatccatgtctctacaaaggacatgaactcatcattttttatggctgcatagtattccatggtgtatatgtgccacactaaatgtgtccattttaagacacctgtcagttattccttaggcttttgggctttcctgattctcgtgtttctacaatttctttacccttcagaatgtctttttacaatccctctcccaacatactggctttttgcaacaatgactggtcttttgcaacagttattatttctttattttctttatagaaagggtggctgaagtcgggataattccctttagtgaagagttttaactgagcagccaatacagcagtctttaattccttttttgtcttcgtctttctttaaattatctcaaactgaccagctggtgctaagattgaataataatctttctttgccatttaccaccttttttctaacttgagtttatacagttggcaagaaagccaagacaagttttctaagatgagagcatgagcttgatctgtctggtgaattttgaaaaagcttcagcaatttgctgatggaaattgacagagtcctccaatcttttgagtacacaactgcaacttcttccagctcatctttaatgaagaggctttaagtaatgccattaacatcccctcctgaggatctctaacacctttagttttttcatagctgagggaggtggtggataattgggtccccttaaccaaaatacttcacgacgttgcggtgttttgggccgtgatgtgcttggtccaccaaatgagcaaattcttctagttgcagaatttcatacagtagccagtgcataccccatacatgggctataagctaaaaacatactgcagaatatttccacaaatttctgtgacacagggattaaaagcctttaaatgaataatatcagctggccagaaagacatgtagattactcaggaggcctaggtagcttaacagtattagcttcactcttgatccatacaggaaaagtttgttttccttgcactgagacaagaaaaatatgaattagatagcactttggtttctctttctgtgttgatcttttccaaattaattttttttttgtcttttcctgagggactaatgcagcttctctccatcctgttgccttcatatggggcacagtcttttatcaacattttcagtgattcccagatcaagtttctttgtcatgtctaccttcctagcttcatgctgtatggattagaagggactcttggaagtggaatctaggctggccagaaagcacagaaatctgtgtcattaaataaagcaggcaattcatactggctgaaaaagttatgacctcatcccccttttcaggaaaacctaataatggaggaaactgtctatgtaaaaaaccatcacctccctctttcctagtgttagttatggacagaaaggcttaaagacaggcagggagggtagaaggagaagtgatagcagataaattttccacagactcatgcctccaaatactgagattatcatgtaaaaattgaaaatataagcttcaggaagagaagtaagaattgtatttctagaaaattaaagtagcacttgaatcatttgaaaaaataaatactaaaatatacttaaagtgagtattgataccatacctttgcaaatggaactaaaatttgggagttggtcagacatctttgtccaagaagagattagttgagcttttgtgtttgcctgattattatttcccatagaattgtaagaaaaagcatgaactctacattgtaaagcaaaacaagagaaagacaaattaaaaagcacttccattccttctcctttgagaaaaaaattggtctcatttgcttctaaatagattcacatagaattctgatttgtgttggaaaaaattgttttgaaatacaacttaggttttattggaaattaaaagaatgatgttttggtgtagaacataaagtgaaattaaataatgattttttccataattatcttggtttgggaatactttataagataaaattttataattagagataaataggaaatatatgtctattataaagcttttctgaaggaaagaaaaatatgtataaactatgaaatgaaattgattttaattgaggttgttacaaatgataccctgttagattcattgacaatatgaagctagggaaaaatggtctaaattttcaaatcacagttcaagattctttatttcaacagcttcaaggagtaaaaatgtaaaagtacttcataaaacaacattacatttatttacttctccacaaatcataagaattcttgaaaggaattcagaacacttggccctaataccaggtacccaaacgtccttcatgaagtggagaaccttccctaagctatacattgcatgttgcctctaaattagtttgagtgtgaatagagctcttatgttcaaaaccagagatcttctgtcagaggaggaataattgaacatttgtcactttcaaaaccagtattgagcaaattttcataaataatctgtatatttggccacttgaagtgtgctcctgagctaaaatcaaaaacaaaaccacccattattgtgtcaaatgacttacttttaccaatagataaataattaaaaataaattcattataaaactttttaatgaaaactcgaattataaaactaaatatagtttctatgtttatgcagatgactaagacataaatcaaatgagtcagtggaaatgagtacgcacaaggtactaagataaaaacaccttattttacaaaaaaataccttcctgaatcaatgcaaaagagtcaactcattgtggatctacttactacatatcaggctgtgttctaaagactcttaaaaatactagaaagtctttagggaaacatgtgattatcttctaacataacagtggatcgtgttagtctaaatcgcattcgaggagaatcatgctttagtaatgtataatttttactcttgtacttgtttgtcataggacaagttctaccttttggtaagtataccaaaaaataattctcctaaagattatttactatatacatataaaactctatctcaagggattgattgctctaccagttttcagcatatcataatgaattgtataaattatctaatcataaatcgtctcttgttaataaaatacctaaattatttaacaagttgggtaagatggaaggcaagaagtggtaaactgattgacttttttaattattgaagataggtatccctatacaaaattcagatttctttgctctcaatttttccattagtaatgcataatactaaggaaaccacacacaattattttcctctcaatgaggagtttgtttcaataaatgagaattgtggttttatgctaggaattattgttgggttattatgttgctgtttgattgtttctgctcattatttaaatatttaatgagaggctttatccagcttgtattctgaggctttgaagcaaagggcataatttaaaatagctaagaagtaaataaatgtcatgatattaaaaaaaatgagatatgcaaaatatattaaaagcactattttaataatggaataataaattttacttttcacttgagatgatgaagtataaaaaatgagatttgatcagctgtaaaattttagaaacatggctatgcaatgctaatttttgtctgacagtctgttgcaatgcctgtgcctagttgctgctctagaatgatgagggtgatgtaaaatgggttctgctaaagattccttcaataaacttccaaatttctctttaacatcttccaaaatgacacacaatattgtacacactgcatccggaggatttttgttttctttttttcttttttttttgagacagagtctggctctatcgcccaggctggagggcagtggcgccatcttggctcactgcaacctccgcctcccgggttcacgccattctcctgcctcagcatcccgagtagctgggactgcaggcgcccgccaccacgctgggctaaatttttgtatttttagtagagacgcggtttcaccatgttagctaggatggtctcgatctcctgacctcgtgatccaccagcttcggcctcccaaagtgctgggattacaagagtgagccactgcacccggccaggaggaatttttaatggtgggtaggttgctcaaaactgtttttattcaaagagattagtaacactcatatgtacatatttacaactaagtaaatattatgatgaccattctacaaaatataataatatattatgatagaaaaatgtggatttaactactcgctgtcttcaaaaatatttcaggaatagttaatagaggatatatatatatatatatatatatatatatatatatatatatatataaaggttatgcttaaaaggaaacatgttttactttaaaacagaactcttaagtgagaggggtttgaaggttgcagcaaactaacatgagtataaatctttggcctaggtgtaagcaggaggaaaaataaaatggagattaagtacagaaaagcacataatgatatgagagtctcacacatactttgagaattttaaaatgtgttcaccaaagagaaaatgtagttgggctgtcactatctccttgactatgaattttatatttgataaaaacttggggaaactcaagatagagataaatctttttgcatggcaaagttcctctgtactcagtggtaatattctcagtctacaacactctggctgagtgatggcagaatgaaatgttcagttataataatgttcaattaattaacataagattgattaatgtttcaatatttaaatactactcactgaagccactgaatgttaaaatactagagaaaatgctaaagttaaaattttggttattggcatattttctttaattttacctattcctttaggaaatacccagataactactaaaacaatgagtgctaactgtaaattttccagttcattctcaaacccagagagctattttgagcagttagctgtttaacaagttacattctcactgtatgttactatttaattgtgcagcagaagcaataaattggtacccagatgccactgccaaacaaaagtactctgtaataggggttgccaatttttgtttactcacagattatgtatttatttattttgaggttacactaaaactatagacactcctttcacaaaattaacaagaatatatatagataatttttaatataatatcagaaatccataaaggcatttatcccattcataaatctcttctaagaatccatggatgcagattaaaaattttatttaaagaagaaaaaataaaatattcttatttacatttatgtacataatttctagatcagtgatgtctcttgacacgactaaataaattggtaacaaactctcaacaactatatttataaatgcatgtatataattctgttctgaaatattatatacataaaatgtacagaaaatcaaaatttaaagtgattagataaactaccttttcaagtattttaattctgtaaatgaatgttttttgtgatgctcactctacatcagatactcctgttataggttagaaacaaacatttcaattttgcctacttttaaatatttctgttatttgaaaaactgttttgccatgtttaaaacctttttatgtgcaaatgatatctgtgtatttttaccttataaaccacatggtatttggcttaaatattaaattttgttctttgtttagttaatcaaagtcaaagtgttatttagaaagatattcatttgagaccttacatttgaaaaagtaatggtttcaaaactattgaggaacagctggctgaatttctgaatttgggtggattaaagctttctagcagtaacttcttttacaaatataatataagctaccagtttgcactgaagtgcaattgactttatcaaatattttaaagtatttacttgatttatttgcagtgctaaagatacagagataaatacaattcggtccctacaattaaagatctttcagtctggtggcataaaaacatctataccagtttttattacttttacacacaagtggatcaatagataaaacattattgtttatttatctctttcagtgatctcagtaagttatatttattttaattccaccaaatatctagcaattggtcaatagttctttatttaaataatataagtcctaattttcttgccagggcaatacatattaaaggttagaatttaaatttaaattagtatttaaattcaatcttatattgtgtggaaataacagccatgaacatttcccctttacttggtcatgtcctctcttacaaaatttagtttagctcagtcatacatgtggctgctctttaaatagttgaggactcattatgtttccatttattgctttggtttctttatgtagcttcaatatattaataccataatctacacacataccttccaattatataacgtatattgaggtctgaggactccccaaaaatattttccttaatccttcactccaattctaaaaattcgagcgtgaaaaaagtaaatagcatagcaaaaatgacatcttcattactaatacagataaatcagatgatatagcttatctcaagaatcaaattcatctattggttgaacactggagaaattaccacagcagacttatgcatagcaaaactggggaagaattctgaatatggaagtcaacacaactcctaatgagacaaaagttataaagtgtttggaatttagttgagactttactacacacattcagcagatggtatattttcagcattcatgtgaatgaattttgtttacttttttcactacctccctacagcctttcttctctctccaaactgaatcttgggaaaactttgagagacattaaagtttgaggaactgattgctaagaatgtattgaaaaagtgtgcaattctgaacagtgagtaaagctttttacagaaataaccctactggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaa

SEQ ID NO: 846 - DNA, 13444 bp, Homo sapiens
agtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaa

SEQ ID NO: 847 - DNA, 38032 bp, Homo sapiens
tggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaacaagttaccagaaaagtaaggccaatgacatagagttcttaagaagtatgaaaaagccctgtactatcctattcatttgctaaatgttgcaaaaaaacaatagcctaagaaaacataatacgtctacacatcttgagctcattttaacgtttacataaagtttagaattaactgaagtcttaatagttattaagaagttccttttatgtgttaaatatgtatttttttgtattacattttgtataagaaattgttacggaaatactaacataatctgtgtttcagaatagctagaaacaaacaaatgaataaatgtgataggtttaaataaaatatttgggaggttgcagataattgatttatctttgaaaaaggttgaaaaaaatcttagtgagatttgagaagacaaataaaagttactgcaacaataacattatctgactgtggaggaaaaaaataatgcctctaatctctctcctaccagtaggggaagggtggtaaatgaagaaaggcctggaaaagaaagaatcaactatgaaagactataatgcatctggacagtccctaaggaggtttaagaatcttcctttttttcaatgacgtgtctgtattgcctttgatagtaaatcacagttgctgtttaataaaagtttatattaaattctctactgagcacttcttaaatgacaaaagcaaatggcagcatatactctctagaaaagtgatgtctttatttgtggaaaaatgtaatttttgtaataatggctgtgtaaccactcttcaccaagctaaaagcagaagttttacacatgtgcctcatcttattgcctagtagctgcctagtttattttatggtagcagctcttgggtgttaatcaaatctgaagttctcaatgcccctagtaccaacagtagcccatattaagtgcttaaatgtatttgttgcaagattggataactgaagtgtcctttggcttagacctgagaaatgaaagataaatatgtaaaataaaaacattactattttcaattcttcaaagataaatcagtaaataaattataagaccactaaaatgtattcctattatatgaaacctaatagttatttaaaattgctcctccattttacatttactatttcttaagcataagaaaagtcaataatatcctttgagaattagtcacaaatgcttaatattaagtgtatagaaaactttctttctgtgtaaacataatcttataatacttaaaaaataaagtcaaacagtgtgttatatatgaaaaacactatatgcgtttgcttttttgggtccacactttaaaagatactggaaaaacacttagaaggtcactgcattaaatgttttcttttttttttttttttaaggcagagtctcgctctgtcacccaggctggagtgcagtggtgcgatctcagctcactgcaagctccgcctcccaggttcacaccattttcctgcctcagcctcccaagtagctgggactacaggtacctgccaccacgcccggctaattttttgtgtttttagtagagacggggtttcaccatgttagccaagatggtctctatctcctgacctcgtgatctgcccacctcggcctcccagagggctgggattacaggtgtgagtcacagcgcccagcctaatgttttcttacttattagaaatgtggacttggaaataatccaaaatgttaattaaatttattttaatttctaggcaaaaaatgtttaaatttttgtgtatctcctcattttcaattgtcactggagattgacttaaaacaagcttagtaacaactttgtaataaatgatcccaaatttagaaaatatctacccatgtgtgtctaatgtgaatggcccctttatgccataatttaaacaattttttatctctaagaactgttacactcataactgtagcatataaagaaaaggccaatttgtgtcatttgatgaaagcaaaacaaatatttaaattatggatataatatttttcacataagaattttaacataccatagttcaattgttactacttctcactcaacattctacatgcttgaaatttgtttaatcttcacatatggcactataaaatgtgcatagctgcacatgtaccttatcttactgcttagtagctgctttagtagtaattatcagtatttgccttattttaccgcctagtagttgccttaaaagttattactatttttcacatgaagaatctcagcgcccataagcactgtgtagacataatcagaataatgtgaatttgaggtgcctttcacatgtttaacacaaagggacaatattgcttaatacgtcgatattgaacaacaccttttttcaggataagttgatataatatgttcgctatatgttccatgagaagcaatttatagtcccaactattctcttaaaaccaaactagagataccataattagtagctgcattcaatgtcatctacgaaggtggagtttcttctccagttctagaatacgtgtttggatatccaatgacctgttacataaactttataactaaatataagtcaaatttgtcggctgtggctcaacccttgggattcaagtcaattgtctcttatgacacatggaggcaaaaagcagtgtaattgtttttcagtttttaaaatgtgctataaatgtagtgaacaaacacttcagtttccccggaaaagtctcaatttatgcctgctgcaatgaagtaccataagtgtcccagtttggatgataaacaaggtggttaacgctacccataaactcacttctgatagtgtagttgttatcatactgacttttatttggaggagaaaagtactgcaagatcaatgcatatttcctcagatgtaggaggtgtcctgaaatggcaatctgcagaaaatggaagggtaaaaacacagaagtttgaaaatggtgaccaaaattaataaagggatgtatgatctcctaaataccccataaaatgttcttgaagtaaaatttcacagaaccaactaactatataggcaggcactattgtttacaaattgattcacaaactgtaaatgtcaatgggtgaatgagctctcagagcatttcacagtgctaagattaaaatacatgctacttctctgattgctgtaaacagtagttttttattttattgcagatctttaactctactattccagaaatgacagttttaaaagtgtcataaaaatgaaatttcaatacactgtcaatcatcctgattccatattgactgaagaagaataaaatccacttctcaagaattggcttattgtatgctcgtgtcttataattattgtctcattgattctgccaaaagagagttaattgaattttaagcatattgaaatgatgtttttattctgacaatatctttattccttacaaataaatttagagcataaacaagaatatataaaacaatagttattattcatacttcccatgaaatatgaatatttgattacctctgtgacttagatgatttatacaacatatgtattgattgagattaaaaattagactgcttaaatctattacctgttttcttattccttatcaacattcctgatcataatttctggtgttgaaatactacttagaaaatttttaaaatgcagtcattttaaaatcctgtgcttgaggataggaatatgttctaagaaattcattgttaagagatttttgtcactgtatgaacatcataggatgtacttacacaaacctaggtggtgtagcctactgcactcctaaggtatatgaatagcctacttctcctagtttgtaaccctgtacattacattactgtactgactactgtgggcagttgtagtaagacagtggtacttaccattgtgtatataagcatagaaaacgtccaataaaaacataatattataactttatgaaaccacagtcatatatgcagtccatcattgactgaaacattcttatatagtgcacggttgtaccatatttataataaaaatattgtgattaatattaacttaattttttaaatgtttttggctttaattactacaatgtcacttgacttatttttctatatactcttgtgtcaaggctagcctgttaattaaactgttttaagttccaaaaaaactgcaaatgcaaattctatcattttattcactaaattatcaaataatttattccaataacacatttacttgatcttctctttagatgacattatagttattaaggttaaggtgtgcattatgtttctattttataattacaaatatatttaatctaccaatgtattttaaacaatataaattatactaacattagttgcttctgaaagactctaataacatattctcatcactaaatttacaagatactttgctaaatttatttttttataatacatatacatacacacacactgtgaaattttgtaaatgtaaaagtataaagagagaaattaaactgtcctataatgccatttatttataaataactaacataaatatttgcatgttttctgtcattgttttttcgtaactgttgatgtattttatactgtagaccttttatgtgatagcttttctgtgatcatatcttcctttttttaagtagatgtcaatgtctctagtgtcttataattagaagcctatgtcatagacaataagggtggtatttctacacagtttttcctctgctatcagtaagcctgccacttattgaacttgaacctgagctcattttccattttgatatgccaattacgagcctaaaacaagtaactgtaaataataccatttaacatttagaacagtacagagtacagctctccaaatgagtttagcaatacttagagccagatttgtttgtgacaatgtaagttgatactattgacatttaggatgtgaactcaaaggagctacacatcctgcaatgttctggttatttcctaccaaaaagacatactgctaacattgagacacagatgggcatttaagaacaaatgtttttacttaaaaacaaaaaaaaaaaatttgccttgctcaagatacaagaatgtattcccaggaaaatatatgttggctctaagtatctttcctcttttgcatggtgtttcaaattatttctcagctatgcttcattgatcatgattggagttatgacatttttcctaactgcaaagaaggagaaacatttctcctccattttctttttggctttgatgttgtcagtggattcaaggaacagacgtaaaacaactgattttttttttttttaaccagaagctttaatctctaccagagaaatccttttaatacatgagaaaaagtaagtggaaaaaatggcgcaataattattctgaagattggggatagaatgctgggtatattctggggaaagaatgtaatttcacatatgtcaatagagatgtatgtgtgggaatacttaccatataattatattaaaatgcataagattatttttaaaaagcatccagaataattgtggagcatgttcagtaataagaagtgaagttcttcaacattttaaactcaagaaacataggtggatcacctgaggtcgggagttcgaggctaccctgaccaatatggagaaactccatctctactaaaaatacaaaaattagccgggcgtggttgcttatgcctgcaatcccagctacttggtaggctgaggcaggagaatcgctcgaacccaggaggtagaggaaatgctggggaaagaataggctatattcagggaagggtcatgccattcattacagaagaaaagaaaaggatggatgttactgccagtaaatgatgacaacatggaattatattattcctgcttattcatgctattttctaaaactcaaatctctctaccaaaatctagactgttatattcaactacattattaactttgctatttgaatggctgttttattacctaaatattaataaatcaaaagctgactttttgaccatcacccccaaacctgctccatccacagcccccacttcagtttactaaaactgcctttacagttgtatagattaagaacaatggagtcattcttgactccctttgcaatccatgttcagtccatcaggaaattgtattgagtctgtttttaagaatataaacaaaatatgacccttctttatctcttccactgctataatcctggaacaacccaccatgagttattacttggattactgtaataagctgccaattaattaatgctctttgttttaattcttaccccagaaaaattgattctattgcagatagtctttgaaaaataaatgtgatactgtcattccgctcaaaatgttgcaatgttttttcgtgtcatgcagagtaaataccagatcttgtaattgtcttctctgagacctatcttggtaatttcccctttcactctgttctgagcacattggtatccttactcctcctgcaatactctaggcacactttcactttatgatgcatgcactagaaatattcctggaacacacttagattttatattgtcatgaataacttcttcatctctttcaagtctttactcacatgttactctttcattgaaggttataactaatcacactagggatattactctttacttatacttctgatttatattactctttctttcttttattcatgtagttgtacttctttcttttacttatatagttatcttttataacaagatactttattcagtgatatagcctaagtgcctagaacagggttctacacaggacaggagctcaggaaataatcgttgaataggtgaatgaatatgaacctgagagggaaggttatccgcagagagtgatttaatggctgcttttcaatcttcgacatgtttttcaccacagagcttttgacacagttagccttgccttctacttggaaatatttctccatataatcaaggtttctttcctaccactttggaaactccacttaaatatgtttcttgcctttaaaatgttgaagaacttcacttcttattactgaacatgctccacaattattctggatgctttttaaaaataatcttatgcattttaatataattatatggtaagtattcccacatatacatctctattgacatatgtgaaattacagagtcttgcaagttgtagctgtaactgtagctggatatcttcacttaaattttgttgtctttttaatctccatactgctaaccagttctcttattttatcctatacagagaagccataatcatatatttaacatgtaaattaacttttgttactttcatcatacatataaaacaaagaatggcttttatactcagctaagtcctccatgattggcctacacctacctctctaaacatattttctacaaatctgattcttactaaatctgcttaagccacaatggctttttcaatatcctcatctcagagttgtttcagttattgttcttacgtcctactgtccccataatttatcctagtac

SEQ ID NO: 848 - DNA, 16130 bp, Homo sapiens
tccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataata

SEQ ID NO: 849 - DNA, 223447 bp, Homo sapiens
atttttccgggaagaaaagtcagtttgtattgtgtttagtcatatcctaaggcaaaggttaaaaaggagagaaacaaaatctgagttagaaacttggatctgtttagtcagagtgaaacaagttgggaatgttcaactctaatgtacccatatgatttgtccatcattattcctgagtagcatagttctgtcttccttcaagcaatgttatctgtaaaaggagaggtgtgatctgactgtaattaaaaaaaagcgggtttcagtatttaaaaatatatatattttaattttggactctcatatttaaattaaataataaagtctaatcaggtaaagagaacactgctagcctgggcaacatagtgagactctgtctctaataaacatttaaaaaaaattaatttggtgtagctgtgcacacctgtagtagggaggttgaagtaggagagtcacttgatctggaaagtcaaggctggtactccagctagggcaacaaaatgagaccctgcctcaaaaaaaacaaaagaaaacaaaacaaaacaaaacattttccactccaaacgcagttgtatttattagaaaatagccacaatgttgtctcatgatttgaaatccttgcttcttcagtgtccccagcttgggcaagaataatcaaaggtatgtgtaataatcaaaatggtaattaaattaattggtgagctagatctctatgtagtaaaatccagttttatcgcttctccagcaaggtctcaggtggttcacgccttctaaagctgtagaagttcaatatacctgtccatttggctacctactagttgtaactggtaattgcaatctttataagtgccatgtttactaaagccactgcctgtagtttgaacttggtaatcctaccagagtttccagtattgtaatagtcgagaaaacttctcttcagggttataaattatttttaatttgagccaataaaacgttgttttacatttttattcttttttcttataatgaatttttttttcttatagttatcctttaaaaactcaagtattgtgataagtactgctgagattgagacaaaaatatttaagggacggcattttagttttcattcaaaatatatgttttgctaatcaattcatatgtgtggaatgatttttctccaggtttattgaggtataattgacaaataaaaattgtatatacattcaaattgtataactgatggtttgatgtctatatttttcaatgatttattttatccacagtgaatctcaatatataatcaacattttaattgtaattaattaatattattctttacattagccttctgctaaagtgtaacttgttttcacttgtaatacagtaagtcttattaattattccctgagctctattttcagttttattcacagtttgataattttaaattatttatatatttttcagtatgtgaagaatcagtatggatctgaaagtcaggactttataggaaggtttattcagaagagcatcactcctccctaatgctttctctactattgacatttacttattctcacccacaccctgcagataggcaaatgcattagcttttgctaattccttcggatttgtttgtttgcttttttgttcatttcctaaatgagtaaatatatgcagttgctcctatatcctctttcttgcatgaaagggaatacacttttggtactcttctatttgctttttcttttctcactgaaacatatattgtgggctttacttcatgttagtttgtagggagctttttcactgtattttatagttgcaaataattctattgtatgtttctatcatacttgatttgactactcttccacgtatgagtatttgtgttgtttcaaatatttttgcaatagtacaacgctataatgaataactggggtagatatatgttcatattgctgaaaaacattccagataatacatagatatgggactgctcagtcaaaattaagtaaaaatgtaattttgtaagattatgtcaaatttacttccagaaggcttgtatcagtttgcatacttagcaacagtgtctcatattgtctgcttctctatagtcttggctagagaacatgttgtcatgaatatatatttaacttatatatttatgcatgtatattatatatttaattttcaccactatgttatgggagatactgacaatgccctggattttgttattgtcctgaggccatttttaactttgaaattatttggctagatgaacataatccatgtgtcttctatagttcctctaaaatctatttagaaacaaaaatatttgctttttagttcactctttctgtgtataccttactacaggtggctaaaataagtaaacaacttttcaactctcagtctgagaatctccttagcaacattaacaaatttattgggtacattttcagtcttccacaaggtaacagtagacttcacaatttcatatgatatggcatcttttctccagcctccattagcaatttatttggcagcctcctatacttcactcataatttcagcttctattcatagtatctttgctatgcttccagcctgcaaacactgcctggtccgaaagttaatggacatattttagatttgtgaaacaccagcacctcactcctgaaaggaataactgtatcaaccaaaattcaatcaaggaggcaaaaccaccatgatttatgaacaagtaatttactacaagaaactagaccttaaacaatcatggagaaaggtgaggagtggttaactaaaagaggaatttggaagattagagagcgagagatcaacaaacaatccaaatgagaagtcaaatacatccagccaccaaagggccatggagaggggactgcagaaaagtgtatacaaaagttttgctactgtgaggccacaacatgttgtttaatgatgagcttaggactcttactggtcctcttattggtcaacagataaagctgtcagaaagaggagctaggtgcaaaacagaggagagatgacaagctggaacatcagacatatttgtgtctttatgttaccacatttaactatgacaacatttcaaattaaatggctgctgcttcacttctactctcctaatctcaaataaattaatattttggccaactctagactgaaactatagagaaaaggagatagaaacatggttcaaagtttaatgtggctggacattgtataattcattactataaaatggagaggcacttaaaagtttccttctaaatttggcactgagaaaagtttgcctttcttttcaatattacacttggtttccatgcaggtacaacaagtcaagtgaaggaaataaaaggtataaaggatgtaaaaaataaataaaaacttacattatttgcagatttggtttttgtggaaataggaaaatttgaaatcttccagtaactattatttaattgtgaggcattgaaaaaaatcaataaaatttcaatataatacaaataaattaatataaaatttaaataattctacaatcttggaagccatcaaagacaaaacttactggggaaaatataacaaaacatttttaacactgaaaactataattaattactgaaacaaatttttaaaagctaagtaaatagagaatgtaaattatccatgaattaaaaaaaaactagaccatgtacatagtttctctaatttatctaagaattcaaggtaattccaacacaaattataagagagtttcaggtcaaaatttttaagcatattttaaaatttagagtaaaatgcaaagcagaaagaaaagctaagtaacccttaaaaaatgaactccagaagatttttgctaactatattaacacttaatttaaaggtacaattatttaactataggaaaatatagaattgaaaacaatgtccagaaatagtccaacaggtagagtaatttgatttgtgacaagggtgacaatcagtgcattaaaaaattaatagttttttaaataaatgattctgggaaagtggatatcctttggggaaaaaaagtacattttgacctttaatatgcatcatatagaaaaatatttcagatggcgacaaagactctctatagttgaccaaacttcagtaagattcttctgaagaaacagcctaaacatattctttgtccttccttttacatgcctggcccagtcttagcaaagaattctgctaagtcaacctcttcattcttgatatgtgagcactcttagtatcagaacaaattcctcctttgatatctgatcaccttgtcctgacttcaataagagtcctcctgttcagtcagtttagcaataatccccctaacattgatgtcacctctcagcaatttttcatccaacaatctcctcaccatgctccttgactataaattccagcttctccttattgtattcagaactgagctcagtttcatagtgccataaactcttacaatattttctgagtcaaatctattgttactgcttttaactattgcctggctctggtgttctttgacaatggattgaagatgtaaatgtgaaattaaaagtgtgatgatgctagaggaatgcataaacaaatttcatggggtaagctacagtctttaaatggaaaacataattaaccatataattttctgataagttggactatattacaacaagaaggattctttttattacaaaaggcagtaaagaaagtaaaaacacagagataattcaaaggttgattaacagtataacattgaaaaaaggttccgcattgtacaaatagaatactgcaaagccaaatagaactgaaagacagcacagaaataaagtatttgtaacctacatcactaataaattgttaatatctctaatttattaaaaaaaactatcacaaataaagtgagaaggatgattaaaactggataggaaaactgggcaaaaacatgagtagataactcataagaaaagatttaaaatgacccaaacacatatgctttcagcaactgtccgatgttgaggaaaaataggttgtattacaaggcgttacaagttgaattgtctctgaaatcattctagtttatattcagatcaaagggctacactctcaaattgagacatatgctctgggaataagaattataacctatgggtaaggacaaacagaattaaagaccaataaagcccaccccaccgtattcaatggatcaaaatgatttgccagtaaactatttagcatttaaatgatctagcagactgggcaccgtggctcatgcctgtaatcccagcactttaggaggccgatacaggcggatcatgaggtcagcagatcgagaccatcctggctaacatggtgaaaccccgtctctactaaaaatacaaaaaaattagccaggcatggtggcgagcgcctgtagtcccagctactcaagaggctgaggcaggagaaaggcgtgaatccgggaggcggagttgcagtgagctgagatcgcgccactgcactccagcctgagcgacggaacgagattccgtctcagaaaaaaaaaaaaaaaaatgtcaatacactcttcttggccttcaattaaaaaaaaattaagtatgaaaaggaaacaccattgatatatacagaaataaaaagtaaaaaaagcaagaatattgccagaaaacaaaaattgattttaaaatattcaaatagaaatgttggtatttaatttttcattgcatttcattttaataatgaaattaaatttccataaatggtttttagatcgtaaatacgtagaaggaagaaatgagtaaactggaaaacttgccagtagatatatcttcaaggaggcagagaaagaaagagaagataaacaatgtgagaaaaagaattatagacatagaggcacaatgagaatgagcaaaagtttttgtattttctaaaaagaaaggaattgaacatgagcaattccatttctaacagaaatgtgtacatatgtttattaaaatacaggtaaagtgattttaaagtagcactatttataaagatcaattacatgaaatgtgaattccattcacaataaaaagaaaagattaatagtatacatgaagtattatacaacagtgcaaatgaatgaactatcaatacaaaaaacaatataaatgaatctcacaaactatcgtgatattagattccaacaaacactactagctctattttttgcagatgtaaaggtgaaattattttgtgaaacttaaaagtagacaaaaatagtgatcccatcacaatcccttaaattctgtttatctcattgcttagaatgagcatagtctacatgcaatatggcaatggtctcagtagaggatggccatgggatgatattattctgtatatttatgggtcatgggttctaggaatatctacagccataatgtcataataaatatctctgattagggaaattaccctgttagaaaactgtattctctgaagcccaagatatcttagtcatctactataacatatcttagccacctactgtaacataataaaacaaatgttatattgagatatatttaatttacagaattggcaattacataaaaaagaatttgaaaaagatctctttgtagatgtaaactctataacaactacaataggtaaaattaatgtggaaaagaagggatttttaacagttttattgagctataattaatatacagtaaactgtacgtatttagagtttataatttaatatgtcttgatatacatatctacccatgaaacaaaccatcatgtcaattaagaaaatggtcatctacctgaacgatttcttgttcctctttttaattaacccttccttacccagctctttccaaccctcatctccaggaaactgtagatatgctttctattgctatatattaatttgtatttattagaatttttaacaaataaaaaagcacagtatatatgtgtcacacaggctggagtgcagtggcaccataatgactcgtgacaccataatggcttactgcaccctcaacctatcaggctcaatgttcctctcatgtcagcctctagagtgtctgggactacagccaaacaacaccatgccctgctattttttttttttttttttttgtagagaaggtgtttcgctgtgttgcccaggttggtcttgaacccatgacccctccccagtaatctgtccatgtgggcctctcatagtgctggaattataggtatgaggcactgtttccgacctgtgtgttttttctgattattgtcattcaaaaaaaacaattttgaaataaatctacattgtaacatgtataaatagttcattaatagttaatttttattggcgacttgaattcaattatttggatatgccacagtttgtccattcatctgtcaatggacgttggagtaatttgcagtttggaactaaacaaaactgctatgaacattcatgtacaagacttatgtgggcatatgcatttattgtttggataaataccactgggatgaatggttgtaccatattgtaggtatatgtttaatgttttaagaaacatgctaaactgttaaccaaagtgattatatcattttactgttcttggtggcatgtgagagttccagtttatccacatctttggcaacacttcacatggtcattctttttaacttaagtcattctaattggtatgtagtgttatctcattgcgattttaacttttaattagacaacgtaggtcttaagtattggatttagtgtttttaatttgacatataattgtgcccatctaatattatacaatcaattttaagtataatttttataatacaaatattttaaatatgatgaaagattaaattatacttacatattcattaaattcatgcagtcatagatttaatatgatgaaagaacaattaaatatacatgttaactttttaaatggtatataattgatataatcagcaaaattttatttattctaatctaataatgctaagaatttagaaatctgtcttattatatgtgctatgaacaggataatccattaataggcaaacttattagctattttgaatacttttaaactttaagttatttattttaaagagtttattgaaatagggctatttttatttatttgccaaaaacatcatttctgagattaaaaatttttggttggatgttacaaaacaatagcttacaaaacatcttagctatttgctctaatacagttgcctacctagtgaagacttaatatgtattataatggcctttactttttaaaaaatagcagaattatctatattttgtatcatcatttctctagaactaatgtagagagctgaaaactataaacgacaaggcatattatcctcaggcttttctttgctcttttattttgcagagcacagaaaaatattcatatttatttgctacagctatatcaccttctattttgtcacttctgcatataaattgtaggttttcattattgcatacttaacaaaagctactcaatataaaatgcctttgcagaagataatatgcaataacctcttttttaattattattgtttagctgaatatcttccataataatgacttacaaatttttatttttctttcctttcttagttatattttatgcctgtaatctgaactaagaattatttctataagattcctgccttgtcaaattgttattttctaatacttataagtaagaggatttctaagttcatgttataattattgaccacgcataaattgcaataacttaagaaaatagtagctgcttgtgttgctaggttttgtgtttacacatgctacataagacagaatcatatttgatgtcaggatattgttgacaagtagtacaatttggtattaattctgtatctaataagctaattttttctaggtgttttcttttactaaacagcaaaaaactgttcctaagaagtatatttccatactagaaatagactagaaaacaatagacaatagaaaagatgaatagaataattgttattttggacagataaacaaaatcaacaaacatttagctagactaagaaaaaagagaaaagattcaaataaaatcagaaacggaagaagacatattacaactgagaccacagaaataaaaagaattaaaaggaacaatgaacaactacacagcaacaaattagataatctagacaaaatttaaaaaaaagcattctagaaacaatctgccattatcacatcatgaagaaataaaagaatgaacacaccaataatgagtaaagaaattgaattaatattaaaaatattggccgggcatggtggctcacgcctgtaatcccagcactttgggaggccgaggtgggcggatcacaaggtcaggagatcgagaccatcctgactaacacagtgaaaccccatctctactaaaaacacaaaaaaattagccaggcatgctggcgggcgcctgtagtcccagcgacttgggaggctgaggctggagaatggcgtgaacccgggaggcggagcttgcagtgagctgagatcgtgccactgcactccagcctgggccacagagcgagactccgtctcaaaaaaataaaaataaaaaataataaataattaataataataataatttaaaaattccatcaaagaaaagcttttacagaatgaagtgaggaaataaagcatatgatcaccaccatggatgcagagaaagcattttacaaaacccaacatactttcataattaaaaactctcaacaaattaggaagagaaggaatatacctcaacagaacaaaagcccaccactaacattatactgaatggtgaaaagttgagagcttttcttctaagatgaagaacaaaataatcatacccactctcacgacttctattcgtcatagtactggaagtcctagtcagaatagttatgcaacagaaagaaatagaaggcatccacattgaaaaggaagaagtggaattgtctctgtttgcagatggcatgattgtacatatagaaaccctgaagaccccaccaaaaactgtagaacgaataaataaattcagtaaaatttcaggatacaatatcaacacacagaaaccagtagaatactccaacaatggactattcaaaaaataaatcaataatacaatcttattggcaataactacacaataaaataaaatacttcagaatacattttaaccaaagaggtgaaagatctatacactgagattgatgaaagaaattaaacacaaaaaaatggaaagatatcccatattcatgaattggaagaaccaatcttgttgaaatatctatactccctaaagcaatctgcagattcaacacaatccccatcaaaatttcaatgatattattaatagaaatagaaaaaaattctaaacattttttgaaaacacagaagaccctgagcagccaaaacattcttgaacaaaataaacaaaactggagacatcatattacctgatttaaaaatctacctcaaagctatagtaattcagacagtatgatgctggcataagaacagatacatagttcagtggaatagagaaaaaccaaaaaataaatctaagcatacgcatttaatttatttttgacaagtgcctcaataatgcacagtgggaaaaggatagtctcttcaataaatggtgtatggaaaacagaatatccacatgcaaaataatgaaattaggctgttacattacactatattcaaaaacaaactaatgtgttaaagacctaaatgtaaaatctgaaatcataaaactccaaaagaaaatatagaggaaaactccttgacattcaacttggcaatgattttttttgatagaacaccacaatgataaaccacaaacacaaaaataaacaagtgggaatacataaaattaaaatgctcagcacagcacaggaaccaaccagcaaaactagaaggcagactgtggattggaaaaaaaagtatttgtgaaccacatataagataagggattaatattcaaagtctataaggaactcccacaatttgatagtcaaattttttttaaatgacccttttttaaatgacccagtgaaaaaataggctgaggactcaaagagacataggacctcccaaatatgtaaatagcccacaggtatatgaacagatgctcaccatcactaatcatcaggaaaatgcaaatcaaaaccacaagaagatatcccctcacacctgttaggatggctattaccaaaaaggcaagagagtgttggcaaggatgtgagaaagtaggaactcttgtacctggtgtgtgaaaatggaaattggtgcagatactatggaaatttccagtaatttctctttgcttatatccaaaggaaataaaatcattacccggcaaagatatctgtacttctatgtttattgtagcattattcacaataggcaagatatggaagaaagctaagtgttcatcgtgagaagtataaggaatatttcctaataaagtatatttcagttatgttcatcaaataaaaaaagaaaagaaagagacagaaggacaactgtgaaatgatggatatgttaatttggttgtagtaatcacttactacacataggtattaatatatcaaaacatcatgttgtgcacattaaatttatacaatttaaaaattttaaggtttttattttatgtaactatcaaaggaagaaaattgtccaagtaatttgtatggtttatcacatgtgaagaaaacctcacacatttatataattattagtatttttaatcatagtgctttataggttaaaatcttgcattgataagtgaattctgcatagtgcgcctttgagaaaaaagaaaagctgcttcagtattttttaaaggcagacgtggtgaagattgtttaaaggaaatcaatctaaataaaatgttacgtactcaagattacacgagactgaaatcattattatcagaagataattaaagatttgcaattctcactctttattttaattactccctttaagcactgcaatagtcaattaaactgactttgaaaaagccattcaagatgatcagttaacatacaaatgttctttaattgtttcctatttgttttgcttgcagtattcccacagctaaagctagattgaaatatctattttgtgagattaatggtgtttttaacttgattcactgaataaccacactaagattactagaaaatgaggctattgtgttttcataggttgatgttattttctactggttacttcacaaactacacattctatgactaagcttcttctttttcatggcaaaaaaatcctaatattttagggttttcatgtaaatttctggttatataatccaaaatagagaagaaacaagaaaaagtaactttctttcaatgtctattacatgtcaagttttatactaatttctttatataaattatttatatgtgtaaatttatttaaacctcaacatgaaagggcattgtgaaatcaagagattcaaattttgataaaatcaatgctgaaaagctattttgaaagaccttattttattccatggccttaaatattttacgtttggattggaattttgaaatggtaactattttattttaaagaataaacacttattgataaccaccttagtaaataccaagaactacccatggcctggtaatgcaaaggtggatgaaatatttttgaagttttcaatgaagttgtgatctctcaataaagaatgtcttgttctaaacagatgtgtaaatcgtattttggtgtccatatgtgtttgtgtgtttgtgcatgatagagagagatttacaattctatatacccatctgtactccactcatacttctgaaaaagccaaaatttagtaaacatatgctatggaagacattctgtatttcactaccttttctctcgtataaaagcttcttgtccttatccttaattacattaggtcaagactttgacatataaagtgggtagagtgtttcctgtgtaattataggaataaaaagccaattttaggattgctcatcaaatggcagtcaagtagtttcctacagagaatagatcattgtttaggtcatagacaccagacaatttaaattctgagatgtggttaacatgagacagcaccataatttctatagttgctctcatagacccgtgtttgacgttctttaacaggtaattttacagtcttctcgaactgattatttcagatgagttgcaagggtttttagagcatataaggaacggcatgggtaaagggcaattgaaaaacttgctgggagagtggaataaatatctataactaatagaccaaactttctatatactgtagcacaagaaaataagaagactcccataacttcatgctgcttaccacaatcaattcagtctctgtagaagccagttacctcagggttcttatctcctgcccattaactcttaacgcttctcgtgaattactgcttttccaaaattgccatatttgattgagctgccgactaaaagtgcccttgaagaagttcttcattacctccaagcctacatataatcttgagatgaatgacttcagaactgcctagaatgaatatattttagctacatataaattttctatactagaatctctggactataactttaaatcattagcaatctttctttaagagataatccttctgtgaataaatgggtatttttataatactctgacttctgttatcacctactccaagactttgtttatgttagtacccattttattttctttatttctttcaccttctccttctatactggataattcccagtgctataatagcagattcaatttttcccataaaagaaacttcaatctcaatttttttaaagtttctattttatatcattactatatctcaaaataaaaacttgtagaaaaaaaattggctttactgaaaatctagcctttctccctcctttttcttctctatggagaggctccatctccattcttacctagtgagcaccaaatgaaaacctgtgtaaaggacctgatgagtaggcaaatcagtgaacagaaatagaggctatgaagtagtaaaagcagagtttcttacaagcccagaatgacatcaaaagcccaagctctgagaaattttggcctcattttcaaaggacctaataaaaataatagtattttcactctctttcacaatatcagtttttaactgggatttaagtaatgtggggctgaaatatatattaaaaaacagtccctaattggtaatacattttatattttggaaataaatattttcatgtctcaatttttttcctgtgctttacaattttgacacaatggaaaatttcctggcctttcaaagcctgctgcaaatattaaagttactttgccaaataacaactgagcaggaaaggcatgttactgcccaatgtaatcacccttcttttcagtagcatcaaaacatttggagtgccagttgaaaaaaatgatttagcaattatgaagtgagtgttggatccatgctgtaccattttgagtagtaccagctctctaaaattgcaccatgtcagaaaatagcattataatactgtgggtgagcaagaatattctgcattctctaacacctgggcataatggggagcagacttaatgacctcccactatgctcacttacctggtggaaggtattcctaaccacttctagtgttctttctgtgtattttctagtaaatgtctaaactgaagtaaagttttctgtctaatttgtcatgattttcttacttcattctaagtaagtcaccatgattttcaccactccatataattattatttcagagacattttcaaataggaaccattatgtacatctccttcaaaaggtcagcttaacttatagaattagtcaactgagggtcaggctctagaatagctgtaattaacaagcttttcttagcctttgtccagagggcagaaacaaggacttatctaccactattttgattccagaaaggctcttaggtcacatttattgctgtgtttatttgaaactagtatgccacttctgggtcttactgacctattatatacttgtcctatatttccagaagtaaatagaaaagcagaaggcaaaagcttattgtaagaaaattgtgtgaggagatagggatgtattgttgctgaattaataattatactaaacaatatatatttgtgtactgatgtatatttttagttatttaaaaatatcttatttctcatgaaaaccctttacagatagggtattattatcataacataatgaatataaacactgaggttcacagaggttcaaggaattgtcctgggccatctagttcataagccaggtcaaaggaaatagaatcaaacccctttattacagatccattattagtgttctacaatactatacaaatagaatctaggtgaaagacaaacaagtctcctcttcaatgttgtcaaatttacaatggagactaatctcaataattagaatataggtcaaaatatatttttccttatccaaggaattattatatattttgatcagactggtaaatacatggatatatacatttgtgaaaactcattaaactttacatttgaagtagatgttttattattgcatacaaattatacttcaataaagtcgattacatatgttacttctaaaaagtggtcatatatatgaaaactttaatagtctacattattagcttaggtaataaatagttgatatacatgcataattactggcaaataatttaagcaaccaattttacactgttatacatggttattgaatgaaataattatgcttttcaaattggtcaattattattatttttgatgtgatggttgggtttttattatttatgctcataagttctctgataatagtttttaaaacacaaattacatgaaaaattctgaaagcataatttgcctttagaactctatatgtaaaatgtagctgatatttatgagaagcaaagatttaaattatctgcagatgatttaacaaataatttagtgttttcagaacacgactaccattacatgcatatttgcttgtacgataatattgtttatccaagcaacttgacaattaagaaaaacaactttggcgtaactagaaaaaacatttttaaaataataattgttctgataataataaagtatgtatttctaaagctgccaaatatctgcctgtttagcaaggaatgactaaaagagaaattcaaattgacctgatggttataagaaatttgggttttgctagggagatgcctacatttttatctttaaaaaataactatttgtcttaaatttaccttatggtattattatatgttttatttactgtggctagcaaaataaacggtgattagaaaggatgttgtttatttaatgcaagtattaagaagaggctttctctataacttgtaggcacatttgggatttttgccccagttttaaagaatgacagcaaaagcatctttatctgacatttagactgattaaattttgaaaagtcacttggcatattcagcaggactccacagggtactccagctttataaggcaatggatcatgttagcttaacttatatttaagatttgctggcctgatattattgtgttaggcaatattgctgaaaaggaaacataaaattttgctgtcatgagatcaagtctctgcctgccctgcactataaattagttccataaagttttaaaatgcaacttttattctggctcaagtggtattgtgaagcagtaaacagcttaaatacataaaattaagcctactttgtgtgaaaacaaattttttaattcacttatccttggaatgcaggaataaaagttacttagccaccaaaaacatttatataaagctaaaagagagaagtcagttgtgtttgagagttcatttttaaaagcaccatgtccttttggccataatgcacaatttttatgagcccacatgtatattggctattattgcagcttaagaagaaatgtactgagacatgcaaaggaggatagtataataataaaatgttcataaacatgtgtaacatctatgacacccctattttgaaaacagttttgttctaaggaaaatattaaataaaatgaaatgcatctaactcaattttgaaaacataaaattgatctattataatttaattaaattatttgaagggaaaatctgcagaaataaaatataacaaaaatttgattatcattggaaaacatctttaaaaatatagatgagatgaagtatcattttgctaatgaagacaaaagtagattaaacaatatgtatttcatttggtttccccatccactcaagataaaagaaggtaaccaaactatttatcattagaaaaagcaatgcaaaaaactattaagtgttgatcatcaccttctaactagctagaaaatgatcttattaactacatatagaataatactgaactgacaaaatgtatccatacttacaactattcaataattttcttaacagttatgtataattctactgaagacttctttttgtttttattctatattttcaagcatatatttcattttcttgccaatataggacaaatgacaattattctataaaaaagtgactgtagccacttctaagctcttatgtcaggaataatttatgtgagtaaaatgatctttttaattgtatttgttgtaaaagactcatccactgtgtaatgcaaaatagaacaaggtatagataatttcaagatggcaatgcaacaaatgttatagaatatcgagtttaattgttcccaacatttatttgaaataattaatttagtataccagacagatgaaatttcctgtattttataataaatactttggcaaagaaatttggtattatttatttggcaattccataaatttatgaacaaaaagcattgtaaaggataagttaatagctattaatatttcttcatggatttcaaatatcataagtcaaatgcaagataattttctgcagataatcatatgtttatcctactttttctcccatggtttaaattttaatatgcaaatttgatatgtttttaagtataagttattcaaatgttttgtgatgttgacttgattttaaattttcaagaaaaattagaaaatattctaacatgggtcaaccaactaaaatggaaaaatattcaatccattaattaagggaaatacaaaaatattggctaattccatatttttattagaatatcaattaagcataattaactacttataccgcaaattttcttgcaattatatttattagccaatatttggattgagtacatttaaatatgggtaagaaattcaacccatactatttaacccataatctaatatacggtttgaaaattattcaaggttgtttattattctaaatatttacttctgaaatttatcactaatgtagaataatcacattcaatgttagtgttttgatgaaacagttcttccatgtacttttgcataaagtaaatgaatttcaacattaatctttctatatttaatttaaactttattagtgtattctatagttaggtacacagtgagtgtaaacaaggcaatttttatacttatgataaattacaatgatgttcatggcttcttaaagtgtttgcaattttatttagagtttcataataggatgctttaaatgtgtctacaaaaatggttttctgtcatccccatataacacctactatatgggcaattcagaagaatatgtgtgcttgtgattttgtgtgtctgtgtgtacaccatttgtaaataaagcaaaatgataattgtattctttttccagtgtcataaaacgacactgtttaacagactcactattattaattatgtaagaaaacatacttgtgttcatcttttctatgtactatgcgattagcactcagacactatggagtcacatgctaacttgtggatttctgtctagtagaaaacataatttcaatgttatggttttaatactctgtaagaaattaacttgttttattaacatatttaacttagaattccttttactgagtaattatatatatttacatttctcaaattattttttgagctagctgtagggtcttattggttcctcaattaaagaattttttgaacaaatatctttgacatatatttattatttatttgtatgagggtaatgctcttaaattttgaaaatagtatttgataaatgctgcatagagtgattcgctcattttgataaataggaaatctgtgtctggcaacttttattttaataccaatctttactagataatgacacaaggctgagtttgatggggttttttttagattccttctggaggttgattttattattaccacggtgctcacttaagttgaacaaaatcaaaattttcattgcccaaagatatttatgctgagtgatctacttagccaattttctttagcaaactaataccaaatagtagttgtaactacctcttgtatctgaaattcagaagtattaaaagtacatttcagatccagtctttagcttttgggagcagtggtttcataagtggttaaagctaactgtttcttaatgttacagttaatgcttcaaaaatatcaaccagaataatagatgttatacatttctaagtttcatgcatccatgccccttgttagaataagaatatctatagagattacactcgggatcagtgcctgcctattgtggactcttaaaccctcaggatagaaaaagtcaagcccactgtgaagaagtgatcactatagtgtggtctgtgaaataataatgtaataagtgtaagtttcattggaataatcatgaacttaatgtcagaatacatgaaattaaactttgtctagtaccccacaggttaaagtctcagtcctttgatttattttctatttgatgtaggcaatttataaactaggttttcatctatttactcaggtctgcttttattgggaggcagttgtagtgtaatggaataaaaaactctgcattatatttaagtgacatttttattttgaacacttccaatgtgtgtattatttaacttaaatgagatgcacttttgtttcttctactgtaaataaaggataacaataaaatcaacatcagatgaagaccctctaattagtaaaatgtttagaaaataacacgtgtgaaatattagcattagttttctttttaaaagaaataagatagtaagacatttgctttgtgaatgttattgaacacttcacagagtattaaattttattttatccctccaacaattctatgaagtgggggaagggtatgaggtcagtttatacttttctccctaactacaactgccattcctaattctaatgcatccttaaatgttcacaaatcctaacaaatttttataatcacaaagatccctttgtaaatcacaaatgatgtgaatttcctttagcactttaatgtgtttgatcccctataaagcccttcacttatgttttagaattctacttttgaaatatgtttagaaagccaagaattatactagatctttgcagcttcaaggcaggtatgtatataggctatcaaaagcttaaaagagcttatttatctttctggaaacaatcttttcaaaacctttaattttgttgttacatgtatgagagatggaatagaaaagaatttggcatattttagagaaaatgatattcccatagaagattggctacctaaatgtgataattcattaatctaaatgtgattatgttgtataggccagtactctcctcccgctgatgtattccctatcctagtagcttatttgcatattaaacctcaagatgtcagccatatctgcatatctcctgacaaagcattctcagacttctggagtgtgtgttttccatgattatattaaaacatgtatctccgtgggaatacaaaatattaaaaactttaatacataattatgattccatttcaaattctcaaatgtgctcctttgtttgataatttatatttatgtaccaataatcacgaatttttaaattttaaaaattcccatcatgtctttggtcaagcttcagagttattttgcattatatccatagataatattgtttacttgggtctctggtaattatatattgctgaatgttaatcaacaggatatattagaatctaagttattctataaagctgttgcatatgctttgctctgtcatttatgaactttgatagacaaaaattgcctctacttacgtataatttgcaccattatcaggattgattatgtcactcatactgttaaaattgataagtgaggtttctaccttcctcacatcatttacagtaaatatgattaaaaatatgaattattttaagcctttccttccagattttgaagttttaaaaagtatctattttttttaatttagattgactcaataatgtagatagtatttggggtttatagcactgattggttacatttgtgacagctctagaagtgatgttttattacacaagccctgtgatctctagcatatagaaatgagtcagaaataaaaatgctccgtttcaagtgatttttatcaaggtaacaattgctacgtatactatattgagaactatgaatgtcactaacattcttagaaatgttctaataatctaacatggataaataactaagaattatgaatacggattctaggtatataggcaataccaattttttcaggttattctgtctctaaatttacttggtaaagataaaaagcaaaaatgtaatatgtattttaggcatcttctttgtgatatatgcaatgaagaaatatacattgataaatatatcttaatcaataaatatattgaagaatgaagaaatatatattgcccgaatgaggaacttatatttggttgaaaaataactttcttctaccttaaaattattagggagtaattctattacttgtcagttatatgatcttggacaagtctcatgtttttcatctgtgaaaatggtataataattttactttcctcatagagttatatgtagaagataatattttataaaatatttaaagattgtgtttcacgctagaagtatttagttaattttatttataatgatagctatcattattatttttggataacaatatttctaaatgaagtataaccttgtattttcatgttttaaaaaccataattttcacatacattatttttcggtgtgcagtatcagtagagttttgattgacaggtaaaccttttccagattttacaaataaggaaatcaagactaaacttatgttaaaatattgtttaatgcccagtcatctgatagagttatacgtaaggaacaaggactcaaatctagatctgattccaaatccaaacttcttcctattgtaccaaaattagggaatgaaacacttttaagtcagaaaaggcaatatgtacctcaccatttctcctaaaatagtacctttattcaccatcaattctagaaagcatctgctaattttaaaacttcattaaatctgagtcaataggcatgtgagtggatacttcaaaaaaaatagaaatatttagacaaactgaaataattaaagcagtaaatctaagctataaactaattaatctacaaaatacattaaatgacatcagaggggcaagtggatatcagaactccaaggaagttagatctcttctagaaattatttgaatatctgatcttactagaaaaactttattctaggtggaaagcaatcttgttactgtcagcactactatcggtcagtcttcatcaagtttttagtgtgcactcataagaaattcatagagaaggggatggtcataagccttgataaatttgtttcttgagactgaggagttcagaaactaatttttcacaatagcaacttttggaaaaatattgcctaagctcattttaaaatccttagaattttattcagttgtcttgctttatctgtaagattctttttctgtatgaaacctcctttccaaattttccatatcctaggagttcctgattgtgaagctagaattgaaggttcgagatacaaattgcacaagaaacttttagagtgacttctgttcaacttttaagagtgttctcaatttagacagaactctgggccctctccaacccagactatttaagctaaaactgtcattcattgaattaagagtctaaatgacataatttcaccaaagataattgagaattacagtgtccactataagggatgttaagggtttgaacttttttttttttttttgagacggagtcttactctgttgcccaggctggagtggagtgcagtggcgtgatttcggctcactgcaacctccgcctcccaggttcctgccattctcctgcctcagcctcctgagcagctgggactgcaggcacccgccacaacgcccggctaattttttatatttttagtagagatggggtttcaccgtgttagccaggatgatctcgatctcctgacctcgtgatctgcctgcctcggcctcccaaagtgctgggattacaggcgtgagccaccgcgcccggccaagggtttgaactctaaaacaaataaacaagaacaaaaaaccacacaactccttagaatgtaagctaagtaaattctgaaacattgagaagattttttttatttataagagaaagctaaacttttttccaaaatgtttgtagcattttatactcccaccagcaatatacaaggtttcatcaccaagacttatgaatcactacattgttttaatttataaacaatctcataagcgtgaaatggtgtctcattgtggtttaatttgcactttgctaaagaatattttgattatttttaattgtgtctgtctaatacatagaaatattttactcatttattagtttgagtagcatctttatgtgcactgaaatgtcaataactcttgtatctgccggatcatatggcacaagtggtagagcagcttgcatgactgcctggttttgttgcagggccttcttctattctagaccccacataaaactagcagcttttgcatcactcaccgaatggactaaatggactacagtagcacatccaaatgaggaatacgtttcatctaaggaagcccattaggggttgtctactgggggttgtatctctattttggttgtagaaaacatcatatgtaacaacttatccttcatatgcatgagaagtcttgatatgtcccacacctctggccccaaagaagtttcgctgaggttgaagtctcctaatttttttgtcagatttgtgtttcgcactctgttatgcaaacgtgttagcaataaatcaaggatagttgctactggctgctcactatgtcctatcaacgtaatcctattaagataatgaactaacatgatgtcttatggaagagaaaggtaattgagatccccatgaactaaatcacgggaaagatctgaatagctgataaactcctgaagtagcaaaatacatgtatattgctggccttaccagctaaagaaaactgttcctggtggtcttttttaacaggtattgagaaaaaaaattatctgcaagatcaatagctgcacactaagtaccaaaggatgtgttaatttgctcaagcaataaaaccacatttgaagcagtagctggaattggagtcatcccctggtgaagcttaaaataattacttgtcattcgtcaaggcccatgttagattttttcccctcacaggccaaatagttgaatcgaatggggtcatgctgcgaatcctcaccccagtattttcaagttcttgatgatttactcatctctgtatttccttcaggaatgtgggattgactgtggcttactattttcttaggtagagacagttctaatggtttcagcttgacctttcttattgtagtagcctcaaatcctttaaactcagggacctattctggatcccagtttttgagtatgtccttaattaattatgctttccagaactggggaaatgactgcagaatgtatacaggaacctgatagacccatggtgagacagttctgaactaaaattcctttgatctctctgcatatataagcacatctggcacttcaacttcatttagtatatttcaacttttggtttaggttttagccaaacaatcaaacaattagagacctttctagtccctagatctacaacattaaatttataatctatgtttagtgtacccatacaaagaccatatctacaaaaagccttcatagcaatatgaagactagagttttgccaacaaactcagcacaaagactacccaggtcaccacataaagttaaacattaaagacattagtaaagtcattgaaaatcaacaaccataaaagcataaaacatatagaaaataaaaaagacactaacatattttaagaaatacatggtgctctcttagagtgtacattatatattgagtcatgttggagtccatcaaatagaggaagaagaaaattttaggtgaactttaagacttaaagttggaagtttaatactaaaaatattaaaaaacagtagcaatacttaagtagtttaacggcaagtaagaaagtaagagagaagagaattgagatatgaaagtgaacatacgttattatctgtttatcctgtattgttctttgacttttgttatcaatctatctccttaaaaatgggaatacgtttgttcaaaggctaatgtaaaacaatcctctacagaaagaagttgaagatttgttctaaagtccttagtcttctctatatatcatgtaaatcatatatgggagagattaaagctcaaattcctactgtggcaatttttttaaaagttatgaacttgtgaaaaccaaacaggttagatgcttccaaaattcaatgggggtacaggcatagcatagaaaaccccattacctcgtttcagaaaagagaaagaagtaaagagtggcaggtcccaagcaagactaaaatctggcaaaaaaaaaaaaattgtgaaatgagtaagataataatgctcaagaataatcctctttgactccattctttgcactcccaagcaagactaaaacctggcaaaaaaaaaaaaaaatttgtgaaatgagtaagataataatgctcaagaataatcctctttgactccattctttgcactccaggcccacagagatggtagtctcacctttagaccgactgaggttgcagttttctgcccaaatcttggtagggtactgcacagtctttagctctcttgggtgtcttcagccatgttctgtctctgtgccagggcactgtacatgccacatttttttttgtcaaggtagggcgggtcatgccccattgctttgcttgtttgccttacacccaaagctccactaggtattggttctgccttttgaaattaaaggggaagcagccatgccccaagagggggaactctgggcaggtgttgaaaatagtggttctgaattgtctttgaagttccttctttccttatcttgaagaatagcatatgttcacagacaaatagttttatggcctaattttatatggtctaagaggcccaaaatgcttttcattttctactattttctctatttcctttgtcccacctgggggtgtgtttgacagtatagcttcatttctaacttttgtttagatagttgattaagtctatattttaagtctatacatccatatgatctccttatcaaacaatttcttagcttcacacttagtgctctcctgcaaaaatgttttcttatgttttgcaatatggttaagatgataattttccaatcttaaattttgtgtcattttttgcataacaattacatctttaagtcacttctcacttcttgaatttagtataagcagtcaggaggaaccaaaccatacctccaacattttgtttgcaaatgtcttcaggtaaacatgcaatttcatgacttacaagttctacctttcacaaaaccctgtgaacataagcatttcaaccaagttatttgtccctgtattactcagggttccctagagggacagaactaatcgtatatctatatctatatattatattatattatattatatatacaaaatatatattatacatataatatatatattatatatatttggaaaatttattaagtagtattaactcacacaattataaggtcccacaatagaccatctgcatgctgaggagtaaggaagccagtctgaatcccaaagctgaagaacttggagtccaatgtttgagggcaggaagcatccagcatgagagaaagatgtagactgggaggctaagccagtctagccttttcatggttttttttttttttttttcctgcttaatattctagccacgctggcagctgaataagtggtgcccacccagattgagggtgagtctgcctttcccatgccattgactcagatgttaatctcctttggcaacaccctcacagactcacccaggatcaatattttgcatccttcaatccaatcaagttgagactcagtataaaccatcacaagtccatcccttgtcaacttgaacccatacacatctcctgagatcatacataatcttcaaataaagcaataatgaggtcacgattacatctaacataatagaactatccttcttccaactggaaacacaccaaccccaacctaaatgctatgtaaagttaataatacttaaatgctgatattgatatgaagtcaataaatgttatatcaaatgataaaggaaaaaggaaataaaatgcagatgttttcttagtacaagtgtatacatacacaaacatgtttttaacaaaaaaaggagaaaatactcatgacaattgcagtcctcgtttctgcaaccagtcacgtggttgtagctggtattgatgactactaccttcttctactacccattctgtattacctttgccttcagcaagcatctttccaggtcgtgttttgttcctggtagagtgacccagaccttcattcctgaagggtctgggccatttgtagtccatcctggattagactgttgtagtttcccatttaccttaatcacagggcatggtaatactaacagacaccctaatggatctcctgtattccatgcatactcttccttacattctttttgaagtagtagactaatttcgtcttgctagtccgggtcaatcaccctagccaacactgtaactcccttcttagcctgttggcttaaaggtgggaggagcccaaagtgtccaggtggcaatcttaacttccagtttaatggaattgttgttgtgtctcctggtggtagcattcctccctctagaattaagacctctaggccatcagaatgtaacgtcatgggaacaggaagcaaaaattttgctagtggaccactaggggttatggtgagtggtgccacttctacttccacccctcgattcctggactcatgaattctggctatgggaaaaaaaaataccatatattggatgctaactcagaccatacatggcattctgaagagctttgccccagccctgtaaagtattgttacctaggtggcattgtaattgctacttcaaaaggccattctaccattctatcaatctagctgcttcaggataataggaaaaatggtaagaccagtgaattccatgaacataagcccattgccacacttcttcagttgtaaaatgagttccttgatcagaggtaatgccatgtggaataccatgacggtggataaggcattctgtgagtccacagatggtaggcttggcagaagcattacgtacaggatagatactcatatctgaagtaagtgtctattccagtgaggacaaatctctggcctttccatggtgaaagaggtccaatggaccaatataatcaatctaccaccaggtagctggctaatcaccccaaggaatggtgccgtattgagtgcttagtgttggtctctgctactggaaaattggacactcagatgtggtcgtagcaaggtcagccttggtgagtgggaatttgtgttgctaactccatgcataacctccatccctgccactatgaccactttgttcttgggcccattgaacggtgacaagggtggttggaaaaagaggctgagtggtgtccacacaatgggtcataatattcaattgattattaaaatcctcctctgctgaggtcacctgttggtgagtcctcacttgggatacaaatatcttcacagtttttgaccactcagagaagtccatctgcattcctcttcccaagatttctgtgtcaccaattttccaatcatgcttctttcaagtccctgaccatccagccaaagcattggctacagcccataaatcagtatataatcacacatctggccatttctccttccatgcaaaatgcacaaaaaaggtgcacttctcgaagttctgcccactggaaagattttctttcactgctgtctttcagggatgttctagaaaggggctgtagtgctgcagctgtctactattgggtagtgtctgcatatcgtacagaactatctgtgatccaggccctagtcttctcttcctctgtccactgaccatagagaactcccagtgaggactttggtgtaggctggggggaaaaaaggcagggtggcagaagtgtagactacataagccactttctcatgtaacttacttgtgccttcagcacctgcttgcgaccaatcatgtatatactactttcatttgatgatggaatgctgctgcgcacaacccactttatggctagatgggttagaaagcacccaagtcatgataggcagttcaggactcatgatgacttaattacccatagtcacacgttcagtttcctccaaagccagtaataggccaagagttatctttcaaaaagaaagtagttatctgcagatgatggcagagccttgccccaaaccctagaggcctccactgtgattcatctataggggcctgccaaaggctccaaacagcattcctatctcccactgacacctcaagcaccattggatctgctgggtcatatggcccaatggaagagcaggttacacagcagcctgaacctgttgtagagccttctcctgttctggactccacacaaaactggcagtcttttgggtcacttgataagtgggccaaagtagcacaccaaaatgagaaatgcattgtctccaaattccaaataggcccactaggcattgtgcttcttggttgtaggaggggccaaatgcagcaacttatccttcaccctagaaggaatatctcgacaggtcccacaccactacatccctggaaattttactgagatagaatgtccctaaattttaatcagatttatttccaattttcttgcatgaaaatgtctcaccaataagttcagtgtgttttctacttcttgctcactggatgccatcagcataatatcattaatgtaatggaccagtgtggtatcttgtggaagcaaaatgtgattaaggtctctctgaataagattatgacacaaaactggagagttgatatacccctgaggtaggacagtaaaggcatattgctggccttgtcagctgaaggtaaattgtttctggtgggccttatggaaacgaatggagaaaaagtcatttgccaagtcaatggctgcataccaggtaccaggagatgtgttaatttgctcaagcaatgaaaccacatctggtacagcagctgcaattggagtcaccacttggttaagcttatgataatacactatcattctccaagatccatctgtcttctgcatggggcaaataggaaagttgaatgaggatgtggagggaatcactgcccctgcctctttcaagtccttcatggtggaactaatctattcagtccctctagggatgtaatattgtatttggtttactatttttctagttagaggcagctctgatggctcccatttggcctttaacaaaataatagctctcaccttaccagtcaaggagccaatgcagggtttctgccagctgctaagtatgtctatgccaattatggatcctaacactggggaaatgaccacaggatgagtccagggactcactagacccagtgtaagttgggcctgagctaaaactccattagttgcctgacattcgtaagcccctactttatctggaggacaacaatgacgttttgggtcccctggaatcaacatcagctcatcaccagtgtccagtagtccctgaaatgtctgatcatttccctttccccagtgcacagttaccctggtaaaaggccagaggtctccttggataggatgggagaaatattcactgaataaactgtcaataatgtagtgggttccctcctcaaggggacctggcatccccttcgttcaaggggttctgggtgtgtaaactggctcaagtcaggatattgattgagtggccatgattctctatttctatgattcaaattcgaattttgtccattcgacctggaagttttctgattatacaaattaagtaggaatgcagtaggcttcctatcaatttcacttctaggaacaccataattaattagcaaatgccagatctctccatgtgtcagactattctgattgctgctttgccttttctgtccattatggtagctatgcccaccttgtctttaatgtttgagtgctgctacttgcccctggcaccttgggatccaattatttccattatatttaaattttgtagttgaatgactgagctttccatggtcagatctgacatacagagaagggcaattatagggctcttcaaaggtacaggtgctgccctcacgaatctatttcacaaggcattggtcaagggtatattctggatgctcccagctgagatgagttcgtctaaagtaactaatctactccaccattccaaaattcctaagcctttggatcccctcctctacattaaaccaagaaagatcaggcatttccagcttattcacagcagaccatcttttaatccatattccagctaaccaagcagatgagtggttagaaccttttttaactccttgagctgcagcattaaatgcagaatccttacttagtgggcccaagtcaacaaattcggctggaccaactctatgttcctcccaccattatcccacacactgaatatccatccccatgcctgttctccagatttctgctcatataaattagaaagctcaagcagttcttttcaagtgtagcacacctcctcatgggtcacactctgaattttacctctaggagcctgccatgactttagcctagttataggtctagaaacaaacaggggtgttggggatggctcctgggaagaaccaacattatcttgcctctggcaactgcctcaggggaggccatcactcttgcctcaggctgggtaggtttatatcttcagaggaaggtggaaaggctgatggcagcatgggtctgggagaggatgttgccattactggggatgaaaagctgtttcttttggcgaaaaaggttcatcagaacttacaagctcagtgtccccagcttcaacaaggtcatcccacacatccccattccaagtttcaggctcccattctttttcaaccaattctctcactttgtaacagtagacaccttgtgaggctgtgcatgcacctttcattgcaggtcagccactctcatggtaagcgcttgtgttcattttcccagaatttcagctctttttctacaggagataagactctgactcagggcactcttatgtttcttggttttccacctagagtcaaaggtattatgtatagagtcattaaactcatcgcctctcacgagcggtggatcaggagtgtcttatgcctttattttgcataactctctaaacagttcatgccaaggactatcagtgttctccatactattacaggtacagtccttagtatttttgggtctaatcatgttgagcagacaactccagaaaccccagaaccaatgagagaactccattcttaatggagttccattaataataatctgttcctctagaaacactcctggtaccaaatctgtattaatcagggttctctagagagacagaactaataggatatatatatatatcctattacatatatatatatacacacacacacacacacaatacacacatatatatgtttatatgtgtttttgtgtatatatatatatatgtatacacatatatgaggagtttattaggtagtattaactcacatgatcacaaggtctcacaataggctgtctgcaagccgatgagcaaggaagccagtttgagtcccaaagctgaagaacttggagtctgatactagagagaaggaaacatccagcatgggagattgatgtagattgggaggctaagttttctagtcttttcacgcttttctgcctgctttatactctagctgtgctggcagcttattagatagtgcccacccagattaagggtgggtctgccttactggcccactgactcaaatgttaatttcccatggcaacactctcacagacacacccaggatcactacattgcatctttcaatccaatcaagttgacactcattattaaccatcccagctcccccccctttttttttttagaagaatcaccttttatccattgctaaataccatctttctcatttccacctgagacctcctcagaatagcctttactctgtctgtgtttatgccaacattctgttcatgattacttagatttctataagaagacaaagctttctttatatctatattcttttatttctgaaccttcaacagaattatcttacaatttttttcactacaatctattatttttatagcatgcacctcaaatgttttgcaccttttttccattatcttcatttaaaaatgcttgcgcaattttgggtatgtattataccagaactcacacttctcattaccaatttctatattagttttttcagggtgctataacaaatttttatatactaaatagattaaaaaacatttatttctaacagttgtggagactgggaattctaatataaagccactagcagataaaatgtctggtgagggtgtgcttcctagtttacaaacattggtcttcttgctgtcctcaaatactagaaaggaggctagagagctctctggggtcttgtttataatgacactaatttcattcatgaaggtttcacttgcatgactgactttcctttcaaaggccccatgtgcaaataccatcacactgggggttaggatttcaacatatgaatttttggaggacacaaatattcagttcacacaatttccaatgtatactatgatagatttggggacttatctctattctaagaacaaaacaaaaacccttagaatcattcacaccccttaagaaatgtaaaaatcacatggtacaggagaatattgggatccatttatactgtcaaggaaagtggaaaacgttttggtaaataatattaccaagtaatactattaaattattttctctatgtaattatcttaaagttttattgaaataatacatttttgaaaaatgaaaatgcctatattaggaatcattttaataattatactccttatttctttcaatttcagaaaaacattggttaaatatatatatatatatatatatataaagcataatatttacaatcttaactattttgttagtgttaagtacattcatattgtgaaacagccatcacaaccatcaatcttcagaactcttcttttgcactattgcaactctacatacattcaataataattccccagttcccctcccctagttcctgaaaaacactcttctttctgtctctataattttgactactataagtacctcatataggtggaatcacttatctttttgtgaccaacttgtacttaggataatgtgctcaagcttcatctatgttgtagtgtatgtcagaatttcctttctttttaaggttgaataatatttcattgcatatttcacttattcattcatctagtgatgggcatttgggttactttcatattttggctattaataaggctgctataaacatgagtatacaaatatatctttgaaaatctgctttcagttgttttgggtgtatacactgaagtagaattcttgatcatatgttaattctgttttatactcagaagtagaattcttgatcatatgttaattcagccatgttggccaggctggtctcgaactcctggccccaactgatttacccacttcggccttccaaattgctaggattataggcttcagcaactgttcccagccttttacatgctctttggagtcatgtctattcaattactttgactattttttatttgggctaagtgcttttgattgttgggtttcaggttttctctatatatactaaatattaatcccttggcaaaaatcatatcaaaatccatgatatacaagtattttctcccattccacatgttgcctttttatccaatcacacaaaaatttttagtttttaagtcccattagtttgtttttttttcttttattgcctgtgacttaggtttcatatcttagatatcattgctaaatccaatgtcaaggagctttgcattattttttctataacttatatacttttagctcttaagtggacatatttaatttattttgagtttgtttctggacgtaacatttggttaggttctaacttttgtatgccgataattagttttcccaacatcatctgttgaaaagactatttgctctccatgaaaaggccttggctttcttgttgatatttatttgaccatgtatgtaagggtttatttctgagctgtttctttattctattgagctgtacgtctgtcctcgtgttactactgcattgtattgattactgtagctttgtagtaaattttgaaatcagaaagtgtgagtcttccgactttgttatttttcaagattgtttgaattatttggggtttattcagatgccatataaattttaagaaaagttttattatttctgcaaaaaaatggaattttgataaggtttacattaaatctgtaggttaggtatattgacattttagtaatattaagtcttttaatctctaaaaatgagatgtctttccatttatttaggtctttttaaatttttttcaacaatgtttcattgtacaagttttttgactgcttggttaagttaatccctaagtattgaattcactttgatgctatagtaaatgaagttgtattggtaaattcatttcctcattaataatgtataaaaatagaactgatttttgtgtcaactttgtatccactttgctgaatttgtttattggttctaaaagttgtgtgtgtgtgtgtgtgtgtgtgtgtgtatgtgtatgtgtgtgctctttagagtttctacgtatgagaacaaatcatttaaaagcagagaaaattttcctttctttccaattttgatgccttctatttctatgtttttgcttaactgttctggcgaggacttcccatactatgtcaaatagaagtggagaaggctggatttgttgcattgtttttcgtctcggagaaaaatctttcaatctctcaccatcacatatggcctatgctgtggatttctaatatggattttattatgtagagatagtttccttcctttcctagtttattgtgtactttttattgtaaaagattatgcaattttgtcaaatgttattttgcatcaactcagataatcgtgtgtttttttaatttgttatgttaatgcagtgtattatatagattaatttttgtatgttgaaccatctgtggatttcggaaataaatcccattttgtcatggagtataattctttttatatgctgctgaatttggttttcaagtattttgttaaaattttttcatcaatgttcatacaaaatattagtctttttttatttaattgtgtattttttaatatttcttttttaaattttttatttcatttcaatacttttgggagaacaggtggtttaggttacaagaacaatttctttagtggtaatctctgaaattttgtgcacccatcacctaagcagtgtgcactgtacccaatgtgtagtcttttatcactcatccttctctcgacctaccccctgagtccccaaagttcattatatcattcttatgtttttgtgtcctcatagcttagctcacacttataagtgagaacatgtgatatttgtttttccatttctgagttacatcatttgaaataatggtgtccatcccttactaaaacatcaagagtttggtctaggtcctgctgctgcctgcacagaaagccaatcactgagacaacaagtattgtcaaggaagaaaactttaattgggtgctgcagctgaggacatgagagctcagtctcaaaaccatctccctgattaaaccaaaggtttatataaaaggcaagaaatgtaacaatgtgtaagaaaacagaaacttaggggggcaaggaagcaatcatgatgaataagggttccagcatctggtgaagtgatctgctttcaattctttgatactttttgtaagagacctaaacatttcccgaggaagaaactcagaaaaaataaatacaagtttaaagcttttcaagaccagaagggtcaatgtctatgtttatcaaaaagagcagtctatgggtcagttgcgttagttttacaatgccatccaggttgctttgaatgtcattatttcattcctttttatgactgaatagtattccatggtatatgtgtatatatatatatatgtgtgtatgtgtgtgtattccacattttgtttatccattcattggttgatgggtttttagtctggttcaatatatcttcaattgttaattgtgttgctataaacatgtttgtgcaagtgtctttttcacgtaatgacttcttctcctttgatacccagtaatgggattgttggatcaaatggttgttctacatttagtcctttaaggaatactgttttctacagtggttttactagtttacattcccaccagcagtgaaaaattgctcccttttcacctcatccatgccaacatattactttttgatttccttattatgatcattcatacaggagtaaggcagtaatttcctgataattactgatgttgagcattttttaatatgtttgtttgtcacttgtatatttttgagaactgtctattcatattgtttgcccactttttgatgagattatttgttttttgtttgtttgctgattagtttaagttacttgtagattctggatattagtcctttgtcaaatgcatggtttgcaagtattttcttccactctgtggtttgtctgtttactctgcttattttttttatgaggtctggaagcttttaagtttaatgaggtcccatctgttattttatgttattttattttattttgttttatttttgtgtttgcttttgagttcttggtcatgaactttttgtgtaagccaatgtctggaaaagtttttctgaagttaccttctagaattttcatggattcatgtcttacatttaagtctttgattcgccttgagttgttttttgtacaaggtgagagatgaggacccagttttattctcctatatgtggcttgccaattatctcaggaccatttattgaataggatgtccttccccactatatgtttttgtttgatttgtgaaagatcagttggctgtaagtatttggctttttctctgggtcctctagtctgtttcattggtctatatgcctatttataccagtactatgttgttttgttgactatagacttgtagtatcgtttgaagtcaggtaatgcgatgcctccagattggatctttttgcttagtcttgccttggccattcaggctcttttttggttctatataaattttacaactgtcttttttttgctagttcggtgaagaatgatgatggtatttcaacggaaattgcattaaatctgtagattgcttttggcagtgtggttatttttacaaatttgctatgcagattttaaatttgtcaatgcatttgcctttactgagatattaattggtttatatggctttgatttactgtcttgttttcatttcgacatatatgacttcctttagcatttctttcaaggatggtctggtggaaacaaacttcctgagctttcattaattttggcatgttttagtttttccctccttttgaagataaatgttttgccagatataagattcttgtttgacaagtttttttttataattactttaagctatatcagcctccttttagactccaaagtttctgatgacaattctgctgataatattactggtggacccttgtacttggtcttactgttttcacaattatttttgtctttgacttttgacagtttgagtacaatatcttggtgtggatcattctgaattcatcctgtttggagttgattgagcttcttggctgtttatattcctgtcttttatcaaacttagacaattttcagccaaagatcttcaaataattcttctcctttcttctctcttctcctagcggaaccatcgctgtgtatattttgatctgcttgatgtgttccatatgttccttagcctccattcactttcttcaatcattattctttctgtttctcagactcggtatattccattgttctatctttaaattcatggattcttccaccttctgttcaaatctgccttttaaactttgcacatagtttttcattttagttattttacttttcagctctagaatttttgtattatttcagcttttctgtctatttattgatatttttattttcctcatacttgtttttttcactttcttcatgtttctttagtttttaagcatttttcagatggttgttttaggactttgtctagtatgtatgtctatcatccaatcattctcagagagaatttctgttttgtttatgttttgttttgttttgcttctttgagtcatactttctcctttctttgtacgttttatcaatttttgttcaaagctgaacatttatttctggtaatcagaattctttccttccctagaattttctgttatttttcttttattgttaaagactgtttctgtgcccaagagaagtgtgaagtgtaaaacaaaaattttgtcttatcttttctgagcccatgccattccctgtgcatttgtggtaaatttctaattctcctgtatatgcagttacttttgaatgccttagtgtttaaagtattgctctcaaaaagaaaataaaaggagagaaaaatgtaagggaggataaaggtgctggctgtttaggatcccctggaatttgtttcagaacaagagacaggggcttgcaagaactgaggagggagtgcaaaaatggctgcttgccactgtgcttgcacctctgtggtcagaaagagcaatcaacaatcagaacacaggtcaacaatattttgaagacaggctctttattgcccactctggttcctgcaagctgtgtgatagctgctccaggaacaaataccttgctgtctgctacagggctggagagtgagaatggtaattgtctctgagctaagagatggtattgacagaaattaactgtaatttactgcccaaattttttccataactatgttatgtctgaatattcttcctctagatttttgcataaataaacttatcttgttaagtttcagatcaatggtcaactttcagcagaacttttccaaagttacgccatgtctcagttcattttctatcagtttaccttgttttgtttactttgtaaaatttttgactagaatcattgtatttattcatttatcttctgtctcctttatttatttatttatttatttatttacttacttacttatttattttttgagatggagtcttgctctgtcacccaggctgtagtgcagtggcgcgatctcagctcactgcaagctccgcttcccgggttcacaccattctcctgcttcagcctcccaagtagctgggaccacaggtgcccgccaccacacccagctaattttttgtatttttcagtagagacggggtttcgccgtgttagccaggatggtctcgatctcctgacttcgtgatctgcccgcctcggcctcccaaagtgctgggattacaggtgtgagccaccacacccggccctgtctccattattaaaatacagacttcatgagacccagggcctcttctcccttgatcaccactgtagactcagcagataaaactattcctacaatagaggagcaagtagagcttctatctatgggtagttgactttctgactatatttataggcagaacttttctgtgtctttcattcttttatgtgtggttgccttaaacttttaatacattttgcttatcacacttaaatgttataatacggtaccataaggtttagcaaaatttattcataacaatttctccacatatatattttaactggatcaggcaggtcttttccattcccagagacagattgtctttgtattctttgctacataaaatacacttaactaactttctggatttaggcaaattccactaacttggagagatattaaattgcatcacctccatgaatgactctttagttatcattgtaattcacttctatttttgaaacctcttatagttttataatttattatgaacaatttggcaattatatatattttatacatcactggttgccctgtgaatatccagttatcccccaaagcctgcactctaatttccatttcattcaatacttacagttacatacctcaatgcttttattcatgctattttatttgtctaaaatagtttatctatttctctccgtgcgaatcactactcagctttcaaagttaacctcaaattttaactgctccatagttagagttaaggtctcccttttctctctccccatgtgtgtgtgtatatatatatatgcatatatttaaatatttaaaaaacaatgtataaatatatatatatagcataaataatttatgttacatataaatttattatatatgaaatttatagcactaaccttatagctatttttagcttcctttccaatgacaatgacagttcttgatgacaggcaattggcgcatactctgcttagcatagagactagtttgtaatggttctgcaagcagaacaaccatctctgagctggattctacgttccagagaagtttctaaaagatacatatattcataattcctctaatctctgtaactattctatgtaataaaaatttatatcatgacaattttatatatgaagttacgtgagacaaatctatgcagtagagattactactatgccaattatatagtaaaaataagtgatttacttgagatgccacagctaggaagttatagatttaggttattataattaagagtctgacaacatttggatgcttgaccagtgacagtgttcaatccccagctgtctttcattccttcttgtgtcgcatctggacaaccaataagaaaacccaggtactctctctcttgtcaatggaaggatattcaaagcacaattctcttcctgcctgttgaaaccctcacccaggcccacaccctgagtccagtataaaccaaagccactggcctcttcagctcaaggcattagacaggcttggatgcctacttttcttacctaagaaaacctcatgatttcagttacaaaatgccatattcttttgatgtgtgtgcggctgtgacataaacagtcttgacatcatacccagttagggtgcagagatgatcccatttatcatggggagaccacatggctgttttgcactcaggttatctgaatatccagcattcaagttcttaaatatcatgttgtgcttcctgtcagatatgttaaataactatttgttacatgaactaatttttgaattccttaggacaagactttttattacaaaattttaattaatttattcatatattattaaaatgagaaatatgcattaataatttttctttgcaggaggaaatcattgaaaattggagtagcctgaaacagaagatatacaagggtttcacattgttgttttgagtgttacatctatatttaataatatcacataataaatcctgctcattaaatataatgacattaaaagtagaattcagaaaagaaaagaaagcggaatgaatctctaaaatttgttttgatgacaacttatcagaaaccaattgcttagaaatagtttgcatttcatgtattttatttgagcattcatattattttaaaaaatcatcaaagtttttacatttatttaacataattatttaataattgagtaaatgtcaacaaataatactctattcagtttgacatgaaaaatgagtacttaaattatcggtattaatacaagaatttaatagaatggtaaatttgattaaaaacaaagaactgcaaaagttcccttactttatagtgtcattgtacaaataataaagaccttccatgtgatttgcattttgagagataatatggggtgctcaatttttatgactggctgtggagaacaagttaatcaggctctggttgggatgctgggtatttaaataagtgaatgtgaaatgaagacagtttgaaatgggactctattgcatatgataacatgggcaataagggaaaaatgcaaaagttttacataaaaagtattctggttgaagaaaggaagtatcagcttggtaacgtatctttcctaagcaaagtagaagactcagttaccagtgtctctatttatttcaatggacattagtattgaccatgttcaatcctggaagggttggaggtaaggtatggttcaggtatttttcaggtatttttgtccagatattctatccagaaatgccaaccaaatttcaaattatgtgtggtgattatattttgtgaaaatatcttgctagactttcttttccgtcacaagtagattatctaataatctcaatattgatcctgttttatttttaaaaagttttcattaaaaacactgtagaagaggcttattgaagtcagatcatctctgccttggtagaggacacagcacaacaaaaggctgagtgtcagtcacttaaatgtttatgcgcaattgaaagtatgatataaaaatcaagtggggccaggcatggtggctcacgtctgtaattccagcactttgggaggctgaggcgggcagatcacaaggtcaggagtttgaaagcagcttggcctacatgatgaaaccctgtctctactgaaaaaacaaaaattagctgggtgtgttagtgagcgcctgtaatctcagctactctggaggctgaggcagaagaattgcttgaacccaggaggtggaagtttcagtgagccgagatcacgccactgcactccagcatgggtgacagaggaagactcaaaaaaaaaaaaaaaaaaatcaagtggactcaggccagaggcagtagtatatgaggataaacaaaaaggcaaaatcaaatcacaaattaaaaattgaatgctaactttgatactccacatctttctttaaaatgttttttagttggctgcatacttaataaaatagatgtttatattgtaatgtttcctcgagagagttgaagactaaattttttgcaggctttgttattgtaaatagtgaaagagtacatatccatgtatatattttaccactcatgtttaaccatttattgaagaattttgtggacatgtctataagttagattggtctgttctttgcttttctggaataattctgttaagttttgctataatgtgttaggaaaataaaatataaaaaagtcttctcccaacccagaaaatctcttctcaaagatagaaaagagaaaaacgttttatttttgaatgagcataaaacccgaatgtgatgtgcatgaaaggcaatctgttaaaggtttgcaaagacagaaaaaatttcaccctttcatatagccaagcaggtacaattcattaaatacaggttctcaaaaaagaatagaaaaaagataacttgataacaccatttgtcacacatagttcatcttaaactcacttggtaattgggataaccatctgttttagctatttgtcattatttaaacgaaaaatacacttcaggtttctttatgataaaaggcagttttgaaatttaaagggaggctcttctgcccaagttaggtttctattttctcaaaaaaactggaaggtagaaagctctcttctgtggtatgtatatttcaaagagatgtttctcaagtccttgagaaaaacattctcaggtcacaaagctggcaagagtcttatttagcttttaaaaagatgtatatacatttcaaagaaaaaataattaacaagttaatcttcttacaaaagggtgagttatctttatgttgatcatggagaattaagccttttattttaaatttgaatttgctattacaatctcttatctgtgttactaaacaatagtaatattactattttctaattatttttattgttgcctctacctttctcagcaaattgcagtcatccaaatatctagcaagtccatagtaaaataggaaaaaaaatcaacatcaaaattatgataatataattactgattttgtaaaaaatcagtactttatttgcattggggaatgtattagtccattctcacactgctaataaagacatacccgagactgagtaatttataaaggaaagaggtttaattgactcatagttccacatggctggagaggcctaaggaaacttatattcatggcggatggaacctcttcacagggtggcagaagatggaatgaatgctgagtagaaggggggaaagccccttataaaaccatcagatctcatgagaagtcactcactatcactagaacagcatgagagtaaccgccctcatgattcaattaccttccgccaggtccctcccatgacacgtgggtattatggcaactacaattcaagatgagatttgggtggggacacagccaaaccatcccattctaccccggcctctcccaaatctcatgtcctcacatttcaaaacagaattatgccttttcaacagtcccccaaagtgttaactcatttcagcattcactcaaaagtctacagttcaaagtcacatctgagacgaagcatgtcccttccacctttgagcctgtaaaatcaaaaacaagttaattactttctagatacaataagggtacaggcatttggcaaatacacctgtcctgaatgggagaaattggccaaaacaaagcagccacaggccccaggcaagtccaaaatccaatagggcagtcatcaaaccttaaagttccaaaatgatctcctttgattccatgtctcacctccagggcaggctgatgcaagaggtgggctcccacagccttgggcagctcctcccctgtggctttgcagggtacagcctccctcctggctgctttcaagggctggcattgagtgtcagtggcttttccaggcacagggtgcaagctgttggtggatccacgattctgggatctggaggacagtggccttcttctcacagctccactaggcagtgctccagtggcgactccgtgtgggggcttcagtcccacatttcccttccacactgccctagcagagtttctccagtggactccacctctgcagcaaacttctgcatgaacatccaggaatttccatacatcttctgaaatctaggtggatgtccccaaacctcaattcttgacttctgcacatctgcaggcccaacaacatgtggaagctgccaagacttggggcttgcagtctctgaagcaatgatctgagctgtacactggttccttttagccatggctggagaggctgggatgcatggaaccaagtcccaaggctgcacagagcaggagggccctggggctggcccaggaaatcatttttcccttctaggcctctgggcctgtgatgagagggactgccatgaaggtctttgaaatgtcctggagacatttttcacattgtcttggtggttaacatttggcacctcattacttatgcaaatttctgcagtcctctcaaatttctccccagagaatgggcttttttgttgttgttgcatcatcaggcagcaaattttccaaactcttatactctgcttccatttgaacattttgctacttagaaatttctttcaccagataacctaaattatctctctcaagttcaatgttccacagatctctagggcaggagtgaaatgccaccactccctttgctaaaacatagcaagggtgacctctactgcagtttccaacaagttcctcatctccatctgataccatctcaacctgaatttaattgtccatatcactatcagcattttggtcaaaaccatttaataagtctttaggaagttccaaactttcccacgtcttcctgttttcttctgagccctccaaactgtttcaacctttgcctgttacccagtaccaaagttgcttccacatttttggtgttcttatagcagcaccccattctacttgtaccaatttaatgtaatcatcgtttctcatgctgttaataagggtaatttataaaggaaagaagtttaattgactcagaattctgcatggctggggtggcctaaggaaccttaccatcatggctaaaggcacctcttcacagggaggcaggagagggaatgagtgccaagcaaaagaggaaaaagcttcttatacaaccatcaggtctcatgcaaactcgctagctatcacgaaaacagcataagagtaacggcttccatgattcaattacctcccatcaagtccctctcacggcaggtggggattatacaaacaacagttcaagatgagattcatgcggagacacagcaaacgatatcggagataacctttgaatataccatactaatgatgaatggttaaatcagattattgattagcaagccacaaaaatgcttctttgccatatattaattatacaaattgttattgtctttagtgtttttcaaatgattaaccaaataaccatttagtagttctttataaagtcctgtctcatccaaacccaaggaatagcttgattctggagccaggtaatgtaactttttaatgagaagttttccttgcaagtgataacaaataacatttgagttttagttcatcacataaatatcataacaatcatatgacaattaggccttttaacaatttttccattttctccaattttttttgtcgatgtgaaatgcaaagatattcatggccatcttttagtatcaaaattttattatgagacactattgaaaggtacagattaagtttctattgttaatgtatacagctgtaactattttaaatcttatggacaaactctaagagcctttttggtctgttggtttgctttcatttggcatgagaaaagaatcaatagttatcctgttataataattaaataaatctttgtgaataataggtattcacttttgtttatctgtatatattaagattggagagacccttaatcccaatttatcctagtgacactagacatgtcttttgcagtctctatctgtaaatgccagatatatgtttgtctacttattacatgttatttgtttctacattatctttctaacatattttttagtatcaaattagagcttgagtgtctggatgcatattaattaattttactttgttgttttcaaacattactaatgaaaatgatgtcatttttgttctatcagtaatcagactgttgtatttatgagtctagaccttgtttttattggaagtaaaatttagaactggtagaaatgagatggtgagaattgttacttggtgtattagtttgctagagctgctgtaatagagtaccccagactgagtggcttaaacaacaggaatttattgtcttacagttctagaggatagaaacccaagatcaaggtgtcagcagggctggtttcttctgaggacagttagagtagttctgttcaatccctctcacctaacttctggtggtttcctgacaatctttggtgttccctggcttggaaaaacatcagcccaacttcttccttcatctcctcatggctttaaccttgtttccttgtgtgatatgagtacaaatttctccttttttgtaacaacacctttcataatgaattggggtctaccctattccagtattatcttaagtaattaaattgatattagctgtttttccaaataaagttatattctggagtactaggggttaagacttcaacatataaatactgggggactcaatttaacccataacacttggattgcagaaaaaaagaagtacaatagacaacatgttggctttccagtaaaatatgatttttttcctttttctttttttcttttttttgacaggcgtttgctttgtcatccaggctgcaatgcaatgacataaccttgactcatggcaacctctgcttcctgagttcaagtgatccacccacctcagcctcccaagtatctgggactacaggcacatgctaccatgcccagttaatttttgtgttttttttagagatagagttttgctatattgccagggtgttctcaaactcctggactgaagtgatcagtctacctcagactcccaaagtgctgggatcacaggcatgagccaccgtgcccagttcaaaatgtgattcttaaagaagaaattgaaataaccctactgtgactaagatgggaggcaatctgtaagaatagtaataaatttgctagaatatctcctttcagctgtgttcagtacaacaattggctactttagaaaacgtaaagtttctagtctttgtaggacccccagtccagttttcctaagatgtttgcttcacatggaaagtatgaatcttgttttttacttttgttttatttttacttagtttgtttttactttgatagctctataggtaactgggagcatttaaaaatgtctttctcaaggagataaaagcctttcgtcccatcggaacaccttaatttgtgaaatcttttggtcaataggcttggcaggcttctggtgggtcctaccaggttcttatgactttttagctcagacttaccagggaagagagaagccatttgaggtgataaacatcattatgagaggattcagttaaatcaggcacacaaaaaaagttgtaccaaaattcataagtctgccaaacagaaattcaaagaaaagagttcatatttgcttgtaaaggttgctctaactttaaggtggtagcaaagctctaggtcatcttaatataggaagtggcagaattttagacaattgagttttttgtttgatttgtttgctctattttccagaggactcagccttacaggaatctgtaatatttgcataattcctagataaccatagaaataaaatattttttttctgtctgacttaaatactatggcatcccaagagcagaaattacatttatcaagagagcgtttaccactgcccaaacattagtttcatgaattggggaaaacatcagaccacccagatattatacacaccacaactagacaaaaaatctcaccttaccttctataagctttcgttctatgaaatccaactgccataatatttctagtaaaattgttaaatgaaaacttcctatagttagtttgggtgtggcatgaaaataattctgctcacaaatagcatatctcttttatgttttgaacaattttatcttattattaggtgtcattaagattctagtgcccttaaaatccctctctcattcaaattgttttattggtggcataacaaccctaagccaataggaggctgtgatattggaattattttgttaggtaattcccacaatcaaccacatttattttagcccatttttaaatccatatgtccatttatttatctctacatagttttaaaatgaacaactttttattgttttaaaagtggagcgtacaaggttgaactatatcatgtttttaacaacagcttttacagacctatcagcaaaattattacctttggaaatgtccttttgcctttaaggaactctacaatgaattactaatatttaagcaggcagttataaagttttatatctcaaaaatcagctatcaattttgcataaggtagtttagtttttgttgaaggacaaagatttctatttaaaatattatgtattttttgaagttaggaagaagctatgactagtttaacttatttaaaaattaattcagattttagggaccaaaccagaagatctagataattattatgcaattgttccatcagagaatttgttttctttgcaaaagctgaaatctgctatctacaatattgtagtagtccccaaaattgtctatgttctttattttttacttttttgtaataggtcattttattataaaattagttgactcctggatcatagcactgaaatattagagcttagttgtgcaatactgcaatttgcttggtgaacccttatgttcctgttaagccaagaactgtaacaaagctaaagtatcaatttgcaatgctctgtagtttctgaggataccagcaaatcatctatagtttgaataattataaatccctctggttggaaacatttctctaagttctataaatgactagaaaatattgtaggaaaatcccaaaacccttgaggaaacaattgtgataaatattgggttcttccataagtgaaagcaaataagaatctagttccattctctagaggaatataaagtatcaaaaattaaaacatagacaaattatagataaatacttccagaaaatgataccaagttcaaaagtcaggatacataattaggaaatacaggaattaatgttaagcttttgtacaaatctatatagtggtcaaccatctttatcaaatttatattcctcagatgtaaaaaagggcagcatatttataaataaatgttcaacatcactaattatcaagaaaatgcaaataaaactcacaatgaagtattacctcacacttagtggttattaaaaagacaagagataacaaatattgctgagggtatggacaaaagggaactcttgtgcactattcatgggaatgtaaattagaacaacaattatgacaatcaggtttagagtttcctcaaaaacttaaaaacagaattaccatatgatttagtaatttcactattgagtatccaaaggaaattaaatcagtgtcttaaagcgagatatatgagatatgcgatatatgaatcctcatatttgttgtgatgttatttagaataggcaagatatggaaattaagtgttgctgaatgaataaatggattaaaaatatcatatttattatacacaatggaatatattcagtagtgaaaaataagaaaatcctgtcatttgcaatgacatggataaacctagaggacattatgctaagtgaactaagctaaacacagaaagacaaatactgtgtgatcccacttatatgtggaatataaaacatatgaatttatataagcagacagaataatagttgacaggggctgaggatattgaccaaataatacaaattttcagttacaggatgagtaagttctgaggatctaatgtaagtatagcgaccacagttttactgtattgtttacttgaaatttgctaaaagagtagatcttaagtatcttcatcacacacacactcagacaaacctgcacacacacacaatggtaactgtgtgagggaatcaatgtgttaatttgattggagtaatcatttcacaatgtaaaggtatagcaaataaacagattgcacaccttgcacacatacaatttttattggtcaattatacctcagtaagtctggaaaaaatacctttttaatttactagaagaacaatgtaatattataggtgggtggcttatttacattatttatcttttcttaccattatataacaggctttgtttcttctgattgagctcttgaaatcagatatcattttgcatatggcatgcactttgcttttggtgaaatatttttattggctctatatctcaaagtacaccagtatcaagagtccctagctctgaaagtgttagatagatttgtccagataggagtgtttttccaacatggtgtgaaattaccactctctgccattccccaaaacaatgtagcttggggtgattttctagtacagtatgagcctgcaactctctgctataaccctttacattcacaaggtgcatggtaaccaaaggagatgcattttccccaaggaattctacagacactcactggtgtacagaatatggtaacctttaaattgcacagcaatttaaagcgggtctctcccaaacagctttataagagaaacaggagaaagtaagaatgtatgttcctcagcaagataacctatctgtatgggaatagtagagaaaaaggaaaaagtagaaggcttactcaaaatatcaataatttgtagtgctctttcaccaaatgaaaagccaaaattatctgagaaattgcagactaagtagcagcagtagcttcaattcccgcctctgagacttcctaaatgtgtccattttttttcagtgattcagctgcatttttttattatactttaagttctaggatacatgtgcagaacgtgcaggttttttacataggtatacatgtgccatggtggtttgctgcacccatcaccacgtcatctacattaggtatttctcctaatgctatccctcctctaatcccctaccccatgacaggccccagtgtgtaatgttcccctccccatgtccatgtgttctctttgtctttttttttttatactttaagttttagggtatatgtgcacaacgtgcagatttgttacatacgtatacatgtgccatgttggtgtgctgcacccattaactcgtcatttagcattaggtatatctcctaatgctatccctcccccctccccatacctcacaacaggccccggtgtgtgatgttccctttcctgtgtccatgtgttctcattgttcaattcccacatatgagtgagaacatgcagtgtttggttttttgtccttaggatagtttgctgagaatgatgatttccagctccatccatgtctctacaaaggacatgaactcatcattttttatggctgcatagtattccatggtgtatatgtgccacactaaatgtgtccattttaagacacctgtcagttattccttaggcttttgggctttcctgattctcgtgtttctacaatttctttacccttcagaatgtctttttacaatccctctcccaacatactggctttttgcaacaatgactggtcttttgcaacagttattatttctttattttctttatagaaagggtggctgaagtcgggataattccctttagtgaagagttttaactgagcagccaatacagcagtctttaattccttttttgtcttcgtctttctttaaattatctcaaactgaccagctggtgctaagattgaataataatctttctttgccatttaccaccttttttctaacttgagtttatacagttggcaagaaagccaagacaagttttctaagatgagagcatgagcttgatctgtctggtgaattttgaaaaagcttcagcaatttgctgatggaaattgacagagtcctccaatcttttgagtacacaactgcaacttcttccagctcatctttaatgaagaggctttaagtaatgccattaacatcccctcctgaggatctctaacacctttagttttttcatagctgagggaggtggtggataattgggtccccttaaccaaaatacttcacgacgttgcggtgttttgggccgtgatgtgcttggtccaccaaatgagcaaattcttctagttgcagaatttcatacagtagccagtgcataccccatacatgggctataagctaaaaacatactgcagaatatttccacaaatttctgtgacacagggattaaaagcctttaaatgaataatatcagctggccagaaagacatgtagattactcaggaggcctaggtagcttaacagtattagcttcactcttgatccatacaggaaaagtttgttttccttgcactgagacaagaaaaatatgaattagatagcactttggtttctctttctgtgttgatcttttccaaattaattttttttttgtcttttcctgagggactaatgcagcttctctccatcctgttgccttcatatggggcacagtcttttatcaacattttcagtgattcccagatcaagtttctttgtcatgtctaccttcctagcttcatgctgtatggattagaagggactcttggaagtggaatctaggctggccagaaagcacagaaatctgtgtcattaaataaagcaggcaattcatactggctgaaaaagttatgacctcatcccccttttcaggaaaacctaataatggaggaaactgtctatgtaaaaaaccatcacctccctctttcctagtgttagttatggacagaaaggcttaaagacaggcagggagggtagaaggagaagtgatagcagataaattttccacagactcatgcctccaaatactgagattatcatgtaaaaattgaaaatataagcttcaggaagagaagtaagaattgtatttctagaaaattaaagtagcacttgaatcatttgaaaaaataaatactaaaatatacttaaagtgagtattgataccatacctttgcaaatggaactaaaatttgggagttggtcagacatctttgtccaagaagagattagttgagcttttgtgtttgcctgattattatttcccatagaattgtaagaaaaagcatgaactctacattgtaaagcaaaacaagagaaagacaaattaaaaagcacttccattccttctcctttgagaaaaaaattggtctcatttgcttctaaatagattcacatagaattctgatttgtgttggaaaaaattgttttgaaatacaacttaggttttattggaaattaaaagaatgatgttttggtgtagaacataaagtgaaattaaataatgattttttccataattatcttggtttgggaatactttataagataaaattttataattagagataaataggaaatatatgtctattataaagcttttctgaaggaaagaaaaatatgtataaactatgaaatgaaattgattttaattgaggttgttacaaatgataccctgttagattcattgacaatatgaagctagggaaaaatggtctaaattttcaaatcacagttcaagattctttatttcaacagcttcaaggagtaaaaatgtaaaagtacttcataaaacaacattacatttatttacttctccacaaatcataagaattcttgaaaggaattcagaacacttggccctaataccaggtacccaaacgtccttcatgaagtggagaaccttccctaagctatacattgcatgttgcctctaaattagtttgagtgtgaatagagctcttatgttcaaaaccagagatcttctgtcagaggaggaataattgaacatttgtcactttcaaaaccagtattgagcaaattttcataaataatctgtatatttggccacttgaagtgtgctcctgagctaaaatcaaaaacaaaaccacccattattgtgtcaaatgacttacttttaccaatagataaataattaaaaataaattcattataaaactttttaatgaaaactcgaattataaaactaaatatagtttctatgtttatgcagatgactaagacataaatcaaatgagtcagtggaaatgagtacgcacaaggtactaagataaaaacaccttattttacaaaaaaataccttcctgaatcaatgcaaaagagtcaactcattgtggatctacttactacatatcaggctgtgttctaaagactcttaaaaatactagaaagtctttagggaaacatgtgattatcttctaacataacagtggatcgtgttagtctaaatcgcattcgaggagaatcatgctttagtaatgtataatttttactcttgtacttgtttgtcataggacaagttctaccttttggtaagtataccaaaaaataattctcctaaagattatttactatatacatataaaactctatctcaagggattgattgctctaccagttttcagcatatcataatgaattgtataaattatctaatcataaatcgtctcttgttaataaaatacctaaattatttaacaagttgggtaagatggaaggcaagaagtggtaaactgattgacttttttaattattgaagataggtatccctatacaaaattcagatttctttgctctcaatttttccattagtaatgcataatactaaggaaaccacacacaattattttcctctcaatgaggagtttgtttcaataaatgagaattgtggttttatgctaggaattattgttgggttattatgttgctgtttgattgtttctgctcattatttaaatatttaatgagaggctttatccagcttgtattctgaggctttgaagcaaagggcataatttaaaatagctaagaagtaaataaatgtcatgatattaaaaaaaatgagatatgcaaaatatattaaaagcactattttaataatggaataataaattttacttttcacttgagatgatgaagtataaaaaatgagatttgatcagctgtaaaattttagaaacatggctatgcaatgctaatttttgtctgacagtctgttgcaatgcctgtgcctagttgctgctctagaatgatgagggtgatgtaaaatgggttctgctaaagattccttcaataaacttccaaatttctctttaacatcttccaaaatgacacacaatattgtacacactgcatccggaggatttttgttttctttttttcttttttttttgagacagagtctggctctatcgcccaggctggagggcagtggcgccatcttggctcactgcaacctccgcctcccgggttcacgccattctcctgcctcagcatcccgagtagctgggactgcaggcgcccgccaccacgctgggctaaatttttgtatttttagtagagacgcggtttcaccatgttagctaggatggtctcgatctcctgacctcgtgatccaccagcttcggcctcccaaagtgctgggattacaagagtgagccactgcacccggccaggaggaatttttaatggtgggtaggttgctcaaaactgtttttattcaaagagattagtaacactcatatgtacatatttacaactaagtaaatattatgatgaccattctacaaaatataataatatattatgatagaaaaatgtggatttaactactcgctgtcttcaaaaatatttcaggaatagttaatagaggatatatatatatatatatatatatatatatatatatatatatatataaaggttatgcttaaaaggaaacatgttttactttaaaacagaactcttaagtgagaggggtttgaaggttgcagcaaactaacatgagtataaatctttggcctaggtgtaagcaggaggaaaaataaaatggagattaagtacagaaaagcacataatgatatgagagtctcacacatactttgagaattttaaaatgtgttcaccaaagagaaaatgtagttgggctgtcactatctccttgactatgaattttatatttgataaaaacttggggaaactcaagatagagataaatctttttgcatggcaaagttcctctgtactcagtggtaatattctcagtctacaacactctggctgagtgatggcagaatgaaatgttcagttataataatgttcaattaattaacataagattgattaatgtttcaatatttaaatactactcactgaagccactgaatgttaaaatactagagaaaatgctaaagttaaaattttggttattggcatattttctttaattttacctattcctttaggaaatacccagataactactaaaacaatgagtgctaactgtaaattttccagttcattctcaaacccagagagctattttgagcagttagctgtttaacaagttacattctcactgtatgttactatttaattgtgcagcagaagcaataaattggtacccagatgccactgccaaacaaaagtactctgtaataggggttgccaatttttgtttactcacagattatgtatttatttattttgaggttacactaaaactatagacactcctttcacaaaattaacaagaatatatatagataatttttaatataatatcagaaatccataaaggcatttatcccattcataaatctcttctaagaatccatggatgcagattaaaaattttatttaaagaagaaaaaataaaatattcttatttacatttatgtacataatttctagatcagtgatgtctcttgacacgactaaataaattggtaacaaactctcaacaactatatttataaatgcatgtatataattctgttctgaaatattatatacataaaatgtacagaaaatcaaaatttaaagtgattagataaactaccttttcaagtattttaattctgtaaatgaatgttttttgtgatgctcactctacatcagatactcctgttataggttagaaacaaacatttcaattttgcctacttttaaatatttctgttatttgaaaaactgttttgccatgtttaaaacctttttatgtgcaaatgatatctgtgtatttttaccttataaaccacatggtatttggcttaaatattaaattttgttctttgtttagttaatcaaagtcaaagtgttatttagaaagatattcatttgagaccttacatttgaaaaagtaatggtttcaaaactattgaggaacagctggctgaatttctgaatttgggtggattaaagctttctagcagtaacttcttttacaaatataatataagctaccagtttgcactgaagtgcaattgactttatcaaatattttaaagtatttacttgatttatttgcagtgctaaagatacagagataaatacaattcggtccctacaattaaagatctttcagtctggtggcataaaaacatctataccagtttttattacttttacacacaagtggatcaatagataaaacattattgtttatttatctctttcagtgatctcagtaagttatatttattttaattccaccaaatatctagcaattggtcaatagttctttatttaaataatataagtcctaattttcttgccagggcaatacatattaaaggttagaatttaaatttaaattagtatttaaattcaatcttatattgtgtggaaataacagccatgaacatttcccctttacttggtcatgtcctctcttacaaaatttagtttagctcagtcatacatgtggctgctctttaaatagttgaggactcattatgtttccatttattgctttggtttctttatgtagcttcaatatattaataccataatctacacacataccttccaattatataacgtatattgaggtctgaggactccccaaaaatattttccttaatccttcactccaattctaaaaattcgagcgtgaaaaaagtaaatagcatagcaaaaatgacatcttcattactaatacagataaatcagatgatatagcttatctcaagaatcaaattcatctattggttgaacactggagaaattaccacagcagacttatgcatagcaaaactggggaagaattctgaatatggaagtcaacacaactcctaatgagacaaaagttataaagtgtttggaatttagttgagactttactacacacattcagcagatggtatattttcagcattcatgtgaatgaattttgtttacttttttcactacctccctacagcctttcttctctctccaaactgaatcttgggaaaactttgagagacattaaagtttgaggaactgattgctaagaatgtattgaaaaagtgtgcaattctgaacagtgagtaaagctttttacagaaataaccctactggtgatgcatactgagaattttaactattccataatgcaagatttctgcttaatggggcagaaagcagtaaagattggaaaacaatgccagttaaatagactcgagctgtgttagctgaaaacccttgagaacaggggattagaagtaagaattgtgcatgctgacgtttccaactgtgtatctaaacacatgtattcctcttaaaactaatatagtagcccattaagtctactagctagtgaatagtaaaaccaaagttcaggaatagctatgtcttcataacaagtgtacttatacacaatcactatattatattggcatgttatataaatagacaataaccttaaaatattattatattaagaaaaagttggtatacatagacactactcataaccaatgccagtaaaattacaaataacatttactttagttaataattctcttaacatgtaatgacaatccatgttattggcaagaaagctggcctttgggaatgaatcagccgagagttattattctgtaatctattattctgtaatcttgctcaagaatgctgagtcctctcagattcaaatctcccatttcatagctgtgttgtgagagtcgactattataatgtataaaaaaagatgtttaacccagtgtctagtaagcatacagtatgtgaaaaatattgttgggaaagctttaggtgattactataatagaatcaaggtgactacacaataggaatgtgactataaattgctaggattttattttattgacctttgtgtcactgataatatattgtacaagcaaaataaccatattttgactcattgattataaaacaattatgacaattgtattatatgattgtaataaaacaaataaaatagaaaaactcagtttttttttgtctgaatatattcaagtatttttcgaagtacactaaataaaatggagcctaacaaaatagtcatattttattattcttaatactataacagctatttcaatacaaataaaaaacactacaatataacctaaatagatatagttatcattgtttttatatcctaagagaaataagtatatgattatcagacagaataaaaaagaaaagccattgaagttgacagaaaatgtttgcatatagtttttaaatcttttattgtcagcactttggaatccagtggttattatattccatgaaaaatcaactttgctttctcatgtaaactaatttccaaaagagatagccatatatcatgctcctatccctccaaagaaattagattataaacctaccagcagctcaacgaaagcttatgagattcttttctctttatcttatgctaaggatgtggaaactacataaaacctatatattcagagtctatccaaattgaaaagaaagaagtttgaaatccatgttacctactaatatagttttattatatatattattatatataaaatatttacattgaaaattatatatcttttaaggatagtatatatatatgtgtgtgtgtgtgtgtgtgtgtgtgtgtgtgcgcgcgcgcacatatatgtgccagtttccagttctgtatttggagtgagaaaagattaataacaatgcattgctgcattgctgccccatttaagatttctcccacaattaactaaaataactcagttattttctgcacacagacctctgtgtcaatcagtcatttttccagtttcttgacttcctgctgtgaaaagaatacatgaacaaaatgtctagcattcatatctgacaaaacagtgtcaagcagtgctttcaaatgttttctctctacaaaagaaggccatttgtatcacactacatattagccactattataactgagcaaaacatttttaaattgttttgctcaattttttttttacctcagtacatttatgtaactcttagctaagtaacctgaggaagttgtaatcctgttctgattagtcaaagattacaataagactactgtcattatgtcagtcttagctgtcaaactatgatgtctttgaggaagaagacattgttttctttttctttcatcaccttttttccacaggccaaatccaggctgcttccatttacacaaacattgtttcaggagggccaactatcttcttctcacaatcccaggtatacacagaataatatatatcgaaagttatcagaatatatgtatacatgtgtatatgtgtgtatatatgtgtatatacaacctaccacaagacattagctacctaaccacttataatatgctttcaatgttacttctttctttcatcaataatgttttcctttgggaaatctatttaatttttcttaatgttgtcttttcttaggcacgactgcacagttgatgttcctgtgttctacttttaataaaattcatagttcatgtcacagttcatccatcttttcctttgctctttcaaacccagaaagttctccttgtgtactgctttgttctgaattcatcacgtggatcaataagttttggaagcacacagtaagaacaagaataggtaattatgtctgtccttgagaaatagcctttacagtattagacatattaatattttatgaatatatttaaatatgattttgtcatgtttgtttaagcagtataaaaaagcaaacatatttggctagggtggtagagagatatttctttagaaagtgacttttttgtcttgctttgtttcttcagggatatgaaattactgtgaacatatattcatgttgaacttgatttttaaaggccaatattctgcccaaacctacagcgaggagcattctattcaacaataccttttttttgcacacaaaatttttccaaatctggcacttcgacttatgtataaaaccttctctctaatttgttcttccttgtctgctccaaaggaactgctatatgtaccgacctttgaacccataacacccagtttggctttttctcaagctgtgacctctctaatgactcccctatttccatttattgacaccacatgccaagacaaacgattccagcctgactggctctctagcctcatagccaggatcatagtatcttggattcatgctgttgggtagcgtgtgtgtgtgtgtgtgtgtgtgcatatgcaagagaagatcttccaagtccattcagagaacaactagtattcgcaaataaataaatcagccaagcttactagctatcatcatcattaaggatcagcagtaagtaaagatcaggttgatttcaggacttcagaaaataacttttgcatactcttacatttgatatccttcaaaattctaacacttgaccatctctcttagcaatctaaatatgcttccttcgtgatcttatctcaccagctctataggttaaaaatgttatttttggtgttgactctcaaattatttccttcaaactgcactactcaatactacataataaaagctaatttttattaagtaaccactgcacactcaatctgccctaagaacttttatattttaactcatttagccctcaaaagaattgtatctatttttacctcctttagagatgaaaactggagcatatacatgacatatgtgaaaccagctaaaattttcaattcctttaaaactacactttgtttgaaatgttttagggacagtgcattaaatcaaagaaatatattaaaaaaacttctaatacaatagaattctgataagggattagtttttgtataagcctgttccaatgtttgtatcatgtaaattatctcttactctttcaatatattacatgggtaaatcaaacaatagcaaacattttaaaccaaagatattttcataatcagagttgtagaactcaaacgtattgcaggtttaaataatttgataagtgtcagaaaaacaaaattgagacagtcattgtaatacttaatttttccacccagataacactgctatcaacttcttctctatctttcattctattttaatacaagctcttatgcatacataatatatatacatatagatatgcacattatatttaatagctgcacagtattcaatggtggggatttactttagtgtattaactttttttaagatttaggcttgtatcagttagctttggtgaataacaaacataccacaagtttagtgccttaaatacccaatttactatttggtatagattgataagtgagatggtttttctaatttggaccagggtaggctcaccttgggtgggcttactcttgtatctgtggttatctgtgtggttggctcttgactggataatctagaatagcctcagtttaaatatgagtttttccccaccatgcggtctctaattctccgacttacacaagacttgttctcataatagtaacagataaccaaaagagagaaccatcttaatcaagttttgaaggagaaagtagagaatcaagagtgacagtataaatatgcagcttcttttttggacctctacttgaaccaaattagttactagctaattgacaaaagcaagtcacaggaccaagcacatacttcataatgaagaaggggactcacccacaaagtgactatgtaggcaggcatggaatattgtcttcattgataaaatatatttgcacaaaggtttattatcttgattttttcttaagataaagggcaggaaacattctttagctaacaattttcattttatttttaaattatttttaatgagaaaaattgtatacatttattgtgtacaaaataaaattgttaaatcaagctaattaaaatatccattacctgatatacttatcattttttgttgtaagaacacttacaattgactctcttagcaatccttactcatatgttacttcattattaattatagtcaccatgttgacaatagttctctgtatcttgtttcttcattataactgaagtttgtatcctttgattaacatcttcccaatcccactcccacctccagccactggaaaacaccattctactctgagtctatgagtacaaattttttaaggtcccacaaaaaagtgagatcatatggtgtttaactgtttgtacctggtttatttcacttaaattcatgtcctccacattcatctttgttttcacaaatgataggaattctgatatacacagtaatggaattgttggatcatattgccattttattttaattttttgagaaattttcatactcttttacacaaatcctgaaccaatatacactcataacaacaatgcacaagtgttccctgttctccacaccttcatcaacatgctatctttgtctctttaatgaaagccgtaataataaatgtgaggtgatatctcattgtggttttgattttgcattttcctgatcattagtaatgttgaacatttcttcatatacctgttggtcatttgtatgccatccttgaaggcatgttgattcaagtccttaaaccatgtttttaaatgtttgtcttcttaatattgagatatttgatttccttatatactttgaatattaacctcttatcaggagtgtgacttgcaaatatgttctttccttctgtaggttgtctctttattctgttgattttttcatttgtagtgcagaagatttttgcacagtcccatttgcctatttttgcttttgttgtctctgcttttgaagtcatttctaaagcattattgtccagattaatgtcaaaatacctttccctatgttttcttataacagttttacagtttctatcttaagtttacattttaatccattttagatttatttttgtataggatgtgagtcaagagtctaattttcttctgcatgtatatattccattttctccacacaatttatcaaagagactctttcctccattgtgtatttttcacacatttttttaaaaaaatcaattaaccaaataaatcaggcatagtaagacaaatagtgcattatcttgcttatataaggaatataaaaaagttgaactcacagatgcagagtagaatggtggttgccaggagctggatgtgggagtaaaattgggaaggttttggtcaaggacacaaaattttagttagacaagagaagaagttctgggatgattaataataatgtattgtttcttgaaaactactaagagagtggattttgtgttattgacacacaaaaaaagatgtttgtgaagtaatacaaatgttaattagtttaatttagccattccacaacttattcatacttcatgataaataggcatgatttttaccaattaaaaatataaataggccgaccacagactaaaaataaaattagccagtcatgcctgtagccccagcttcctgggagactgattcaggaagctcaattgagctcagagtttgaggatgcagtgagttatgataatgccacagcatcctagcctgagtgacacagtgagaccttgttgcatatatatatatatatatatatatatatatatatatatatatatgagttatatctcctatatatagttatctcctatatataatctcctatattgatatgtaagacagagagatatagatatatatgtgtatatatatctataggtacacctacaatatatattattgatatacatatatattcctagcacattaaaaataatatatatatgtgtgtgtgtaaatatatatttaatatgtataaatgaggaaaacttaaaaagaacaattgactgtaaatgtgtggatttatttctgggctccctattctcttccactggtttgtgtatctgtttttatgctggtaccaagctgttttcattactatagctttgtaatatattttagtccaggtacaagtggtgtgatgcctctgacttcatttttgttcaagcttgctttcactattcaggattttcagtggttttgtaaaaacatgatttatttcctatttttacaaaacattttaatggaaatttgataaggattgcataaaatctgtagattgctttggtcaatataaacatttcaacaatattaatttttacaattcaggaacacagaggatcttttaatttttctgtgccttttttgatttctttctgaatgttttcttttttcagtatatacatctttcatctcatttgttagctttattcataagtattttttttggaaactacagtgaataagatcagtttcataatttcttttttgcacaatttattgttagtgtatagaaatgctactgagttttatgtgttgtttttatcctgcagctttactgaatttattagtcctatttttggtggagtctttatagttttctatatataatatgatatcaccagcaaacagagacaatttaactttttcattctgattcagatggcttttattttattttcttacttaattgctctggctaagacttccagtagtatagtaaatagaagtataaattcctaggatgatataacctactaagactaaataatgaaatagataatctgaacagactcataatgagtaagaaaattgaatcagtaataaaaaatctcccatcagagaaaaggccaggatttggtagctttagtgtggaacactaccaaatatttaaagagctaattccaattcttcccaaactaccaaaaaattgagaagaggagactacttccaaactcactctatgaggaaagaattatcctgataagtaaagccagacaaagaaatcacaagaaaagaaaattacagctcagtatacctgatgatcatagattcaaaaatcctcagcagtctatcactttaagccagtgagatttatccctaggatgcaaggatggctcaagatatactaagcactaaataagatatcacattagtgatgaggaacaaaaaccatacaataatatcaatagatgcagaataaacatttgacaaaattcaacatcatttatgataaaaactcaaaaattatgtataaaaaggacacactgcaacacaataaagactatatataaacaagcccacagcaaacatcatacacaatgatgaaaagttaaaaccttttcctctaagatgaggaagaaataattttatatttataatttgacagagaattttactttaagctctagaagattcagtgttaaacatcttttgtatatggagcttgtcaaaacacaagtgacaaattctaacaggtatggaatgaaatttataacaaaataaaaaaataacacaaagataacacaacattgctagctctgattcaaaagatgttaagaaattgaaaagtactacaaaaaagatgtcaatttttttaacagtggccacaggacactaaaaaacagcttcagaaacattaagaatcaatgatgtgtgaaatgttgacattttcagtattttggtttacactgttacactgttcggaagatgattgcctttaggataaaattcccatcatttcatgtcaaacttgaaaaattgaagtacaacaatatatattgtcgttacaaaatatacacaactgcctagtcaggctcttaacttctctggacttaataatatttttactctactttaccaagaagtctaacagctatatattcatattatattgaaaccttataagaaaattaatcctcataagcatgagtgagtaaaatgatccaagaaaggccagctcactgtgcataatcttggctctttttcgttaaaattgcctgtcaagtactgatagaaatttgagatgcagataacctgtagatggagatgctttgtcatgctacaatctaagccatgtatgtatgctaaatacacattcatgtgtgacatttatgaagtgaagatttcaaacctaccactagttaaataaatacaaaatggctcatgagtgtcaaaataagaccgtatatatatacatgaaattactttcttatctataaaataataactaagacaaatgataagaaattgtttcccaagaaaattttagtgaagtttgttctacatgtatgcattaataaaaatctcaacaatgacatccaatcgatacagttcactatgtttccatttcataatcttatggtgcttgttccactcatgcttgcaggatgcattaactagatttctaacgtctggtcgttcccattcctcaactatgttgtcatatttttttccatctcataccactaagtatcaatataaattataaaaagagcatcaacttagcttatgtcacatattaatttagtaccttatcaggaaattttgttttgagtgcagaagtggaagaggtctgtctctatccttttctacttttatttttcaatcttaatagacttggaagtattttactcatgccttgatagagcatccaagtaccttataatttccttgcattaacctaaattctcggcttctacttactatcataggagattggttgttgtcccacacaatcagtatcctcccacacaccactatgtataaaacattttgaaacgtttaagagatatcaagagaaagtactatatgcatgatctatgccatatagtatttgatctattactactctataggcatgatctatgccattacacagttattaatttgatagcctcctatattataataccataacccagatctgttggttaatatggcaaagtaatgtggaagttatttgtagttacaggttttaataaactatgcatgacaataaattaaaattttaattaagtaaacaaattattttgtatataattaaaatatattaaatacacctaatatattatttaaaataattaaaatgaaaatagatgattctttatctttatttatcttacaaaaagatcactggccaatatatcagcagcttgcatgtggtatgtctcattaagcatgaagatcaccatgtatactgtatcatagatttcatgtttttctcaaatgtaaggcacccctttaacttttcataaatattaacatattcagcataacaacatatttgtttacaacatactcaatttaatagtatgtgtctgtataaaacaaatagataatatatgttttaaataccattttggctgtatgaaacaccagcctctttatgtgaacctttctcaacaagaatcaatatgggaacattcattcacatgtttaaattctattactgaaagctgcttcctttatcaggataaaacagaatcattggtggaaatatattttactattaaataaaatcaaaactatgtttctacaggaagaacaaacaaattcaactacaggacagagtaaatttaggagaaatttcctaagttatgactctgaaaaagaacagaagcatattatgtgagagaatacacataaaaatttgatactattgtatctattacaagaaatctaaaaatgtcaaaatggaaatgtcatttatattgttactatgatataaaatagaattgtctaaaattaatgaatatagaaggtattataagtctatttaaaaattccttaattgaaaacctatgtctgttaaaaacactgtgtgataaaatgacaaaatattagaaataatttttgttagtgacagtgtatatcttagaattttaaatacattttataatagcttatggtttttcattatattttatagtattaaggaattatatttgttccctattaatgttgttacaaatttgatggcttaaaacaccacagatttaatctattgtagttctggaggttagaagtcttgtcctgaatgtagctgggctaaggttaggtgttgacatggttgtgctccttttggaagctctagaagataattaatttcctgtttttcccaatttctagaaaccacccactttctttgactgaagtccctttcattcatcttcaaagccagtcacttcaaagtgagtcctttccacaccatcatgtctctgaatctctacctggttttctcttccacttttaaaggactcttgtgattacattagggctgctcaggtaatccaggattacctttcattataatatccttaacctaatcacatcaagaaagttcttccccccaggtaaggtaacaaattcacaggtatttgttacatattcttatttttatttatttatttattgagatgcagtcttgctctgtcacccaggctggagtgcaatggcaggatcttggctcactgcaatctccgcctcccaggttcaagcgattctcctgcctcagcttcctgagtcactgggactacagatgcacaacaccactcccagctaatttttgtatttttagtagagatggggtttcaccatgtctgccaggctggtcttgaactcctgacctcaagtgatctgcctgccttggcttcccagagtgctaggtttacaggtgtgagccactgtgccctgccacatattgttacatatttataggtaattgcttcagcaacactttgtttcctggtacaaaagctatattactttccaattgctgctataaaaacttaccagacaattagtattgctgaattagaatcaaagtatcacatgattacttcctttttgaggaatctaatggtgtgcattcatcagggttctctagtaaagcagaaccaatagaagattgtgtacacacacacacacacacatggggacatcaaaaagtttgtggaaaaatggaattaaaccagaaaaaaataaaatataaacatgatttctcaacataatctccatcaatttcatgacacctttgtaagtaatgacaccagccatttagtccatccctaaagaaccgaggttcttgggaatttaaccatgtcaatgtagtcttttttatactattaactggaaaaaaatatttaaatatgtttttaagattaaaaaacaaaaataactcagaaggagccaaatcaggactatatggtagatgcctaatagttctcaaaactcataaaattgccgttatttgatgaaaggaatgagcacaagactatcataatggaaaagggctcttaggtgaagatttcccaggcaatttttttttctgctaaagcttcaaccaactttctcaaaacactttcataatagtcaaatgttattgttctttggccttccagaaagtcaacaagcaaattgccttaagcatctccaagggagttttgccatgattttactcctggccagtccacttttgctttgactggaccactaccatctcttggtagctattgctttgattatgctttgtcaccaggatattactggtaaagccatgtttcatccaccattatcattcttcaaagaaatacttcaggatctttatctcattgtttaggatttccattgaaagctctgctcttgtctgcagctgacctgggagcaatagttttggcacccgttaagtggaaaatttgttcaactttaatttttcagtcagaattacgtaagctgaaccaatcgagatcatctatggtgtaggttattgtttctgctgttaatcattggtgcttttcaattagaacatgtacaaaataaaatttttctttgaaaattgatgtgaatggtttgccactgcagaccccatctttaacattatcttgtttcttcttaaaacgaggttggtatttgtaaactgatgatttctttggggcatttcccacataaacttttggtaaagcattgatgatttcaccattcttccacccaaagttcactgtaaatttaagatttgttcttacttcaattttagcagaattcataattcatttgcaatcaattaatatttgtcaaagttgccaagaaagcataatagaggaagggaagtcttttcaacaaatggtattgaataaactggatatttacatgcagaagattgaaatgagacccatctcttacaccatatctaaaagtcaactcaaaatgcattaaaaacttaaatagaagacctgaaactgcagagctactagaagaaaacaaagggaaaccttttggacattgtttttggcaatgaattcttttttggttataaccccaaaagcacaggcaacaaaagcaaaaaaagacaaatagaactatgtcagactaaaaatctcccactcagcaaagggacaaattaacagagtaaaaaggcaacctacaaagatgaggaaaatcttcgtaaccatgcatgtaatcagaagttaatatgcaaactgtacaagaaactcaaataaatcaatataaaaaaagaaccagttataaaatgggtggaagaactgaatagacatttctcaaaaaaagacatacaaatgaccaacaggtatagggtataatatacaatgtcactaatcaacaggaaaattaaaattataatgaattatcacctcttatatgtcagagtacttataaaaagtcaaaagataaacattgttggtaacactgtgaagaaaatggaacttttgtatactgttttgatcatagtgtaaattggtacaggcattacagaaatttatggaagttcctcaaaaattaaaaataaagttatataatctaagagttccattttttggtgtatatccaaaagaactgcagtcagtatctcaaagagatatctggagtttcaaacacattgaagcattatttgtcacagcaaagatacaaagttaacataaatgtccatgtagaggtaaattaagaaaatgtggctgggtgtggtggctcacgcctttaatcacagcactttgggaggccaaggagggtggatcatgtgtcaggagttcaagaccagcctggccaagatggtgaaactccgtttctactaaaaacacaaaaattaggccaggcgcggtggctcccgcctgtaatcccagtacattgggaggccgagactggcggatcacaaggtcaggagattgaaaccatcctggctaacacggtgaaacactgtctctactaaaaatacaaaaaaaaaattagccgggcatggtggcaggcgcctgcagtcccagctactcaggaggctggggcttgagaatggtgtgaacccaggaggcggtggttgcagtgagccgagatcgcaccacggcactccagcctgggcgacagagagagactctgtctcaaaaaaaaaagaaaagaaaattagccaggcgtggtagtgggcacctgtaatcccagttacctgggaggcgaggcaggagaatcgcttgaacccaggaggcggaggttgcagtgaactgagatcgcaccactgcacgccagactgcgaaacagcaagactccgtcaaaaaaaaaaaaaaaaaggaaaaaagaaaagaaaatatgtatgtgtttgtatatcacacatatttaacggactatttcatggaatactatttaaccttaaaaaagaaggaaatcctgttatttgttacaaattggatgaatggagaacagtatactaagtgaaataagccaggcacagataccaaacactgcgtaatctcactgtgtgtggaatcatctaaaaaaatctttctcacagaagcaaagagttgaacgatcattgtcagggtctgggatgtagtggaaatagggagatgttggtcaaatgatacaaagtttcagttaggcagaatgaatagttctaaagatctaatgtacagcttggtgactaaattgcatgcttgtactttgctaagaaagtaaaaatcttaaatgttttcaccacacacaggcaaaatggtaattatgtgagagatggacatattaattagctcgattgtggtaatcatcttagaacatatacatataccaaaatatcatagaatatatcataaacatatacaatttcaatttgttaattacatctcaataaattggagaaaaatgaaaatataaggagatagaagcatctagtttagtatgtgtgaaatcctttctctcataactaacttacctacctcattgttatattcaacaacgaaaacaaaatccatagggctctacctgccacatttctataattactaaataactttatgtatccatttggtgattagaatttctaattttacagcaagaaagcaatataaagtagataaaatatgcaacattgcatttaggcctagaatgttagtaatagaaataaattagaaaatatgtaggtatgtgaacacaaaacattgtgtttttttgtgtgtgcgttggaatagaaatttctccacaaactaatcagaggtaaatttatttccacctcatcaaatgacctggaaggagagtcattattccttctttaccctgcagaacgatatatactggacgtcagaaagatgagagatatttctataggtgttcttacttttaaatagcttgttgaataaaacttcaccaaagacaaatcttatacacttttaataaaaataatttatttagttattacatcagttattccattttgtttataatactaaatatgtttattttatacatatagaactagtttattcaataaatatttcataagtgtatacattatcttttcatctgatggtaaaccagtacagtatatcagtattcacagtccatttaatgtgctgagtgtttttgttttttgttttgagatggagttttgctcttgttgcccaggctgaagtgaagtggagcgatctcagctcactgcaacctccgcctctcgggttcaagctattctcctgccacagcctcccaagtagctgggattacaggagtgcaccctcatgcccggctaatttttgtatttttagcagagacgaggtttcatcatattggtcaagctggtctcgaactcctgacctcaggtgatctgcccacctcagcttcccaaagtgctggggttacaggcgtgagccaccacgcccggcccagtgtatttgttaaacaatgttaacttctttgatttttaacctagcaatgtgaatggcagtgcctaaagcaagaagaaaagacattgtcactgtcactggatagtttagtgatttttaatagtgcaaaccagtatagctaaatgatagatttctttacataatgagtctctgattaacaatacgagttggtcttggtttgctttaaaatgaaacttacccatgcaaaaagcattcatttgcatacttgtacacacacttttaagtaacacttacactgtataaagtgatgtagatatgggcctattttcagattcagtcatttgtgtaaagagatgactactgtatctagataatggcaaagtttcttcaattagaggcatgggaagaatggaacacagagttcaatcataattattgtagacatttcaatggactgtcactatatacacatttaaagttcattaggttcaagtggcagtagcaatctaaaattgtatataattccaaacaataatctaacaatgctgaataatgtcacttgacatcaaacattgactaaaatttatcctaaaattataagcttagtatagaatatttccacctaaatactgccttgcagcaacagtaaatttatatagtgctaccacatgtcatcttgtacttaaattaggtgcatcatgcccctaaacagcctgttcttacaacaatcttcaaaagtgattttaagctcaaactcctgtgcacagtatcaacaaatttatcacctactctgctggtgcatcgtgttggaaattgtttattttgtttcattgagctttgaaagtgatcataaattctgttcaataaaaggagaatgttaagaatgtcgattcacatgccaggtggatatagtaataaatatgacagctaggatgactataataaaatgaatagaatttactggcagggcaagactcttgtactaacatgtaaaagacaaatgccattaaatatcttgtatttcatgatatggtatgtaaattttttgaaacgtgtcatattctttcagaatcttgcaataattgctaatcatgaatgttaacataaagtaattgcatcttaagacaaaattatatgaaaattacaaagttatgtagtctcgttgaagaatatagagcctctgagtaaacaattcattcacctgaaattcctgatattaaaatagtctaaataaaggaaaagtctattttttgtcaacaattgtaagttactgagagcctgagtattctctcttggcctttgtttaacatgttttccctaggaaatgagttagatctagagaataagaccttagataatatcttcctttgttgggtgaaaggcttatcttgggctttcagttcatttctggcatgtacaaaacttccaaataagcacacagtatcataccaccagaaaagtttggacaactttaaaattaattaattttattgtacccatcagagaactgcggtttcagagtaaattgtaattcagaaatttggagcgacaggttcatatgagttctagctgaactttgcttacttgcagcccaggccaccaagtcataaactgatatgaacacttaaatactaattttgatgagtagctaaaggctaaggaaacagctggaattcataatattataggggtcccttcacttttgtgacttaccttcaagaatcctatcaggttctcatggtgaagattcaagaataaccttgtcttactctgttttctgttgcttagtatagaatatttccacctaaatactgccttgcagcaacaataaatttatatagtgctaccacaaatcatcttgtacttaaataaggtgcatcatgcccctaaacagcctattcttacaacaatcttcaaaagagtacccaaaactggataatttatacagaaaatgaatttatttgctataattatgtagactgggaagtctaagtacaaggggatgcatcttatgagggccttcttggtagcagggaatcttcacagagtcctgagtcgacacagggcatcacatggtaacaaggctgtctgctaggtctggtctctcttactcttcttgtaaagccacctgtttagttcccttgataagctattaatccaataacccattaatccatgagtgggagtatgaaaatttaatttctatagttttctttgaattaaaactttatgaataggttgtgaccatttttatctctaataatatatatcatacattttaatctattaatgtggtttaattagaattctaatggaaaccatgtgtgtggcacattgctagtgtttagcaagttttttatgttatgttattgtgattagttataattggaattattttaatttactttttaaacattttgttttgttatatattcttttcaacaatttctctttctcttgccttacttaatgtaatgattttttaaaccttaatctgtgattattctcatcagatttgggagttatacaccttgttacaaatacttttaatggcgagcatggaatataattcatataacccaagcttcatgtcttacacaaaaattaactcaaaatggttcatgggcttaaatgtaagacataaaactataaaacctttaagaagatagaaaattagcaactccaaaacaaataattgtcagattcaccaaagttgaaatgaaggaaaaaatgttaagggcagccagagagaaaggtcggattacccacaaagggaagcccatcagactaacagcggatctcttggcagaaactctacaagccaaaagagagtgggggccaatattcaacattcttaaagaaaagaattttcaacccagaatttcatatccagccaaactaagcttcataagtgaaggagaaataaaatacttttcagaaaagcaaatgcggagagattttgtcaccaccaggtccaccctaaaagagctcctgaaggaagcactaaacatggaaaggaacaaccagtaccaaccactgcaaaatcatgccaaaatgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatacgcacccaatacaggagcacccagattcataaagcaagtcctgagtgacctacaaagagacttagactcccacacattaataatgggagactttaacaccccactgtcaacattagacagatcaacgagacagaaagttaacaaggatacccaggaattgaactctgctctgcaccaagcggacctaatagacatctacagaattctccaccccaaatcaacagaatatacatttttttcagcaccgcaccacacctattccaaaattgaccacgtacttggaagtaaaacactcctcagcaaatgtaaaagaacacaaattataacaaactgtttatcagaccacagtgcaatcaaactagaactcaggattaagaaactcactcaatactgctcaactacatggaaactggacaacctgctcctgaatgactactgggtacataatgaaatgaaggcagaaatgaagatgttctttgaaaccaatgagaacaaagacacaacataccagaatctctgggacacattcaaagcagtgtgtagagggaaatttatagcactaaatgcccacaagagaaagcaggaaagatccaaaattgacaccccaacatcacaattaaaagaactggaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgataaaccgctagcaagactaataaagaaaaaaagagagaagaatcaaatagacgcaataaaaaatgataaaggggagatcaccaccaattccacagaaatacaaactaccatcacagaatactacaaatacttctacgcaaataaactagaaaatctagaaaaaatggataaattcctggacacatacaccctcccaagactaaaccaggaagaagttgaatctctgaatagaccaataacaggctctgaaattctggcaataatcaatagcttaccaaccaaaaagagtccaggcccagatggattcacagccgaattctaccaaaggtacaaggaggaactggtaccattccttctgaaactattccaatcaatagaaaaagagggaatcctccccaactcattttatgaggccagcatcatcctgataccaaagcctggcagagacacaaccaaaaaagagaattttagaccaatatccttgatgaccattgatgcaaaaatcctcaataaaatactggcaaaccaaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgatcatctcaatagatgcagaaaaggcctttgacaaaattaacaacccttcatgctaaatactctcaataaattaggtattgatgggatgtatctcaaaataataagagctatatttgacaaacccacagccaatatcatactgaatgggcaaaaactggaagcattccctttgaaaactggcacaagacatggatgccctctctcaccactcgtattcaacatagtgttggaagttctggccagggaaattaggcaggagaaggaaataaagggtattcaattaggaaaagaggaagtcaaattgtccctgtttgcagatgacatgattgtatatctagaaaactccgttgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcgaagagaataaaatacctaggaatccaacttacaagggatatgaaggacctgttcaaggagaactacaaaccactgctcaaggaaataaaagaggatacaaacaaatggaggaacattccatgctcatgggtaggaagaatcaataccatgaaaatggccatactgcccatggtaatttatagattcaatgccattcccatcaaactaccaatgactttcttcacagaattggaaaaaactgctttaaagttaatatggcaccaaaaaagagcccgcatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaagtaatgccgcatatctacaactatctgatctttgacaaacctgagaaaaacaagcaatggggaaaggattccctatttaataaatggtgctgggaaaactggctagccatatgtagaaagctgaaactggatcccttccttgcaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatccgacaaagggctaatatccagaatctacaatgaactcaaacaaatttacaagaaaaaaacaaacaaccctatcaaaaagtgggtgaaggacatgaacagatgcttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatggggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctctaaagacacatgcacatgtatgtttattttggcgctattcacaatagcaaagagttggaaccaacccaaatgtccatcaatgatagactggattaagaaaatgtggcacatatacaccatggaatactatgcagccataaaaaatgatgagttcatgtcctttgtagggacattgatgaaattggaaatcatcattctcagtaaactatcgcaagaacaaaaaaccaaacaccgcatattctcactcataggtgggaattgaacaatgagaacacatggacacaggaaggggaatatcacactctggggactgttgtgggttggggggaggggggagggataactttaggagatatacctaatgctaaatgaggagttaatgcgtgcagcacaccagcatggcacatgtatacatatgtaactaacctacacattgtgcacatgtaccctaaaacttaaagtataataataataaaataaaataaaaaagaaaaagaaaatttgggggatctatggttaggcaaagtttggactctacagtttggcagagagttcttacactaaacaacgaagcacaacaaagaaatgtttacagtgaaattcatcaaaattttaaaaatttgttccaccaaggacatttttaagagagaatgaaaagacaagctaaagagagaaagtattttaaaagtattcagtaaagaaccaatgtctagaatatataaagaatactgataacagtaagaaaacagtctcatcagaaaataggcaaaaataaaaaaatagctatttcaccagataatctatagttagcaaataagctcacaaaaatatgttctttattattagtccttagggaaatgcaaattaaaatcacaatggcatgtcattacctacgtatcacactggctaaaatgagaacaagtgccaatatcaaatgctaggaaagatgtggagaaaccggatcactcatatattgctaataggaatgtaaaatgctacaacttttattgaaaacagtttggatggcagagtcttaaaagtaaaccacttttaagtgtatgttaagtgtatatgcaaccactatacaacccagcaactgtactcctgaacattaatatcagaagtaataagtaatgttcatgaaaaacttgtgtatgaataattataacagcattactcattattgccaaaatctggataagtccagatgttccttaataggtctgtggtcaaacataaaacaaaatactactagggccgggcgcgatggctcacccctgtaaatcccagcacttcaggaggccgaggtgggcagatcacgaggtcaggagatcgagaccatcctggctaacatggtgaaaccccgtctctactaaaaatacaaaaaattagccgggcacggtggcgggagcctgtagtcccagctactcgggaggctgaggcaggagaatggcgtgaacccgggaggtggagcttgcagtgagccaagatcgcaccactgcactccagcctgggagacagagcaatactctgtctcaaacaaacacaaaactactcagcaatttaaaaagaaaagaaaataataatctattgacacacacaacaatctggatgaatcttggggaattatacagaatcataaaagttaattctgaaaagttacatactacataaatccattcacaagttgaaatggcaaaattacagaaataaagaacaaatcagtggtttctagcattttagagtggaggaatagatgttactataaaaagacatcatgagggatcctgtggtgctggctcagctcttgacagtatcaatgtcattatcttgtttatgatgttgtattatacatttcaagaggtaaccattggggaaatataagtattgagtatatgacaattctttttttattttttttattttttttttatttttaaaactgcatgtgaatctctgtttttatgttaaaaagtttaacttttggaggaatctgtttatttcttgtatttatttattttgtattttcttcaacttttattttggattcaggcactacatatgcaggtttcttacctgtgtatattacattacaggtttggaatatgaatgatcccgtcacccagatagatagtttttctacccttgcccccctccctcccttctcattctagtagtgtccagtttctattgttgctatctttatgttcaggagtacccaatgtttaactcccacttataagtgagaacatgtaatatatggttcgctatgttaatttatacttagttttctgtgttaaattgtttaggattatgtcatccagatgcaaccatgttgctacaaatgaacatgagtttgttctttttcatgtctgcatattagtccatggtgcatacgtaccaaattttctttatccaatccatcactgatggacatctaggttgattccctgtattattttttatatatttattattattttttttttgagacggcatctcactgtgtcacccaggctggaatacagtggtgagatctctgttcactgcaacctctaaaccaggctctaaaccctgggtttaagcaattttccttcctcagcctcctgagtagctgggaatacaggtgtgtgccaccatgcccagctacgtttttgtattttcagtagagacagggttttgacatgttggccaggctggtcttgaactcctgacctcaggtgatctgcttgcatcggccttccaaagtgctgggattacaggtgtgagccaccgcgcctggccaattctttgtctttactattgagaatactgctgtgatgaacatgccagtgcacgttgtggacattaatcctagagaggtaagtaatattcatgcaaaaacttgcgtatgaataattatatcagcattgctcattattgccaaaatctggataaatccataataataaattataaattatcaatccatgataataaatccatagtccataaattcaactattgacccattaatgagtctattgttgaacacccataaaacaaaatattcaacaatttaaaaagaaaagaacaatctttcggtatgatatatatatatattttgggtggagtatatacctggtaatggattgctgagtcatatagtaatactaagttctttgaacaatctccgaatttctttcctcagtggctgaacttattttcattcccaccaataacatgccagcatctgttattttttgacatttaataatagccatttagtatctcattgtggtttctatttgcatttctctgatgaatagagatgtggagcacttattgatagatttgttggcagcgcgtatgcattcttttaagaagtgtttgttcatgtctctttcccattatttaatggagttatttggttttttttacctgttcaattgtttaatttcctcatcgattctgaatattaaatctttcctgaaggcctagtttgcaaatagtttccctatactgtaggctgtatgttttctcttttgatagtttgcgttgctgtgccgaagatttttggtttaactaggtcctacttgtcaatttttgttttccttcgaattgcttttgaggccttagtcatatatgctttcccatggccaatgtatataatgatgtttcctaggttttcttctaggatttttatagtttggagtcttacatttaaatctttaatccatcttgagttgatttttgtatgtaatgaaaagtgggggtctatttttattctccatgtggctagctgctatctcagcctcaattattgaataggtagtcatttctccattccctacttttgttgacttggtcaaagatcagatggctataggtgtgtagctttatttatgggttctctattctgttccattggtctatgtatctgttctcgtaccacaagtaccatggtgttttttgctactgtagccttatagtagagtttgaagttgtgtaatgtgatgcttcaattttttttgtagctattctggctattttggactttgatatgaattttactatagttttttctaattctgtggaaagtgataaaaatagtgttgattctacagattgctttgggatatatggccattttaacattattgattcttccaatccatgagcatgaaatatttttccatttgtttctatcatctatgatttcctttagtagagttttgtcatacctgtagagatctttcaccaccttggttagatgtattcctaggtattttagtgttttgttgatatcataaatgggattatgtttttaattttgttctcagcatgaatatttatgtatatctactttgtattctgaaacattactgaaatcatttatcgattgcaagagccttttggcttattaaatttatacctaaggatttcatctttggggtgctaatataaagggtattgtgcttctacttgtaaattccaattggtcatcactagtacataagagagagtgatgtcgtgtaagaaagcgacaaactttgcatcctgcaatctcactataatcattttataattttttgagttttttgttgattcttttatattctacatagatgatcatgtcatctatgaatgaaggcagctttatttcttcattcccaatgtatggcttttgtttatttttcttgcattgcattaggtatttctttaagtacagtgttgaaaaggagtggtgagagagggcattcttgccttttttctggtcttagtgcaaaaacttctagtttctcacaattaagtatgaggttaatattagtttaatgtttgaatttttctattttattgacagatttctttatcaagttaaggaacttccttttagttcctagttcattaagagttttttttttttcttttttaaaccatgagtagatgtggtctttcacatttgaaagagatttattcttaagtattttatattgttgatggtaatttaattagtattacttttaagtttcaatttctagtctttttggtagtatatacaatatgtaaagatacaattgattattgtctattgttcttgaatattgtaaccttgataaacacagttgttagttttcttggtttttgatgctatatcacattttttcaatccacaaataaaaacaatgttatttctatcttttacacttgatgcctgctacttattttcttgattattacactagctagtactctactacaaagctgaatagaaatgctgagaagctagaatccttgtcttaattctgatgttaggaagaaaatattttattttttattcttaagcatatttttatctgtaggcctttcttacatgttcatcatcagatcaagacatgctcttctactattaatttgccaagatttttattagaaatgtgttctggatactatgtaataattatatacattaagataaatagggtttttttttagatttttatataatgaagcacatcgtaattttgtaatgataaaccaatctcacactgttcagataaacccatgtatcacctgatatatcattcttttaaaatattctggcattttccagctagtaaatactagcagtcttggtctacctggatgctcagctctctctctttaactcaggcagtttggcagacttgcctgaatctaccatcatggcttggaaactgggtcaatgtagtgagttgataaggctcaagtcctttgctcccatactttaaagatttctctcctttgttgtctcaaattctatttcttgagaactgacatttattttcttttttccatatttggttgtttcaaatgggaggccaaatattgtccccgttatctcattgtaaccagaaacatatttttcacaatccattctttaatctcaaaactataccttttaaaaattcccctagtgactctcagttggaaagtaatataattttttgtctcccccttgaattgatagttttgatggatatagaattcaatgttaacatgtatttctcaaagcatgttgagaatattccttcccttttttaaactttcattgctgcttttgtgaagtattctgtaagtctatttattattctttaagtgatctatctcatctttttgatgcttttaagttgttctcatttttagataacatgattttaattttattggtctaatttgtagtcctttatgtttatactgttcagaatataatcattttcttaactatatgtatgttttagatctctaagttttttcaatgtttcaatttttctcttcttcacttttgaaaaaggacatatttctaattaactgctcatagaaaaagcaaatatatgtttcagtcttgtatcattgcccttcatcttcccttatgttgatattacctagaatattagttccaagttattttatctattgtttctattttacaaatttacattatgttgaatgagtgtttttcttttcacatgtaaaatactttatcaagatgtgtgatcacattgatctcacatgctccctacagaatttacaaatttctcttatttattgatttgaattttcaatcgaatctaccctatagcctcatttttatattttataccctaattttttcctatcatatttttcaattcctactttatttctttatttctattaaatattgtgtgatatttaattttatgtgtaaattggactgggacatggggtgcccagagatgtgatgagacattattctggctgtatctgtgaaggtgtttcttagtgagaataatatttgaatcaaaagacagtaaagcagattgccttcccaacatgggtaggcctcatttaatctactgatggcctcaacaataggttgagtaaggaagaattcgctcctttgcctgactgtccttgagataagagtcttctcttgcctttggactaagactcagactggaacttaagccttcagtgctccttaatctcagggcatcagacccagataaaactatgctgtttgttttttttggctctgcagctttctgactccacatcttgagacttctcagcctccataactacatgagctaatttcctacaatacatttctttctgtatatatgtgtgtataaatatagatccatttctcctgggaacctgaagacatgttgcttttattttatttttgtatctgatgttcgtgtgggtctgattctgctatgttcatttttactatcattcatggtactttgtttctttatgcttcagagactgatgtttaggaaatttaattctaaataaaattattaaatttttaaaaataattttctctaaaacatttttaaattttttgtttgctagttttctgaatgatgacaaagcagtaattttaaattttaaattatatagccattgtggagctgtttagaacatggtgatagtgtaaattaggttctcaaattcacatgaaggtaagattgctattagaattttgtgtgtgtgagtgtgtgtgtgtatgacacacacacttagaatttaaagaaaaaatgagtagaaattttattttcttctgtagaagaagtatattttccttatatttgttaatcctggttttatacatactctctgataagatctactattctgcatggtctcaaattttgtcttctatttgtaagctgtaggtaatttagagaccgacagatgacccggaggcagcatcaagtctaatgtttgaaaatcatttttaatttatgatttcccatagtttctggactctgacttttcttcgtacttttctgtttatgaattcatataaaaagttgttattgttattttaattgtcaagcgttttcagatatgttgtaccaggaggttgctaatgaatatactagaaaacaagttaccagaaaagtaaggccaatgacatagagttcttaagaagtatgaaaaagccctgtactatcctattcatttgctaaatgttgcaaaaaaacaatagcctaagaaaacataatacgtctacacatcttgagctcattttaacgtttacataaagtttagaattaactgaagtcttaatagttattaagaagttccttttatgtgttaaatatgtatttttttgtattacattttgtataagaaattgttacggaaatactaacataatctgtgtttcagaatagctagaaacaaacaaatgaataaatgtgataggtttaaataaaatatttgggaggttgcagataattgatttatctttgaaaaaggttgaaaaaaatcttagtgagatttgagaagacaaataaaagttactgcaacaataacattatctgactgtggaggaaaaaaataatgcctctaatctctctcctaccagtaggggaagggtggtaaatgaagaaaggcctggaaaagaaagaatcaactatgaaagactataatgcatctggacagtccctaaggaggtttaagaatcttcctttttttcaatgacgtgtctgtattgcctttgatagtaaatcacagttgctgtttaataaaagtttatattaaattctctactgagcacttcttaaatgacaaaagcaaatggcagcatatactctctagaaaagtgatgtctttatttgtggaaaaatgtaatttttgtaataatggctgtgtaaccactcttcaccaagctaaaagcagaagttttacacatgtgcctcatcttattgcctagtagctgcctagtttattttatggtagcagctcttgggtgttaatcaaatctgaagttctcaatgcccctagtaccaacagtagcccatattaagtgcttaaatgtatttgttgcaagattggataactgaagtgtcctttggcttagacctgagaaatgaaagataaatatgtaaaataaaaacattactattttcaattcttcaaagataaatcagtaaataaattataagaccactaaaatgtattcctattatatgaaacctaatagttatttaaaattgctcctccattttacatttactatttcttaagcataagaaaagtcaataatatcctttgagaattagtcacaaatgcttaatattaagtgtatagaaaactttctttctgtgtaaacataatcttataatacttaaaaaataaagtcaaacagtgtgttatatatgaaaaacactatatgcgtttgcttttttgggtccacactttaaaagatactggaaaaacacttagaaggtcactgcattaaatgttttcttttttttttttttttaaggcagagtctcgctctgtcacccaggctggagtgcagtggtgcgatctcagctcactgcaagctccgcctcccaggttcacaccattttcctgcctcagcctcccaagtagctgggactacaggtacctgccaccacgcccggctaattttttgtgtttttagtagagacggggtttcaccatgttagccaagatggtctctatctcctgacctcgtgatctgcccacctcggcctcccagagggctgggattacaggtgtgagtcacagcgcccagcctaatgttttcttacttattagaaatgtggacttggaaataatccaaaatgttaattaaatttattttaatttctaggcaaaaaatgtttaaatttttgtgtatctcctcattttcaattgtcactggagattgacttaaaacaagcttagtaacaactttgtaataaatgatcccaaatttagaaaatatctacccatgtgtgtctaatgtgaatggcccctttatgccataatttaaacaattttttatctctaagaactgttacactcataactgtagcatataaagaaaaggccaatttgtgtcatttgatgaaagcaaaacaaatatttaaattatggatataatatttttcacataagaattttaacataccatagttcaattgttactacttctcactcaacattctacatgcttgaaatttgtttaatcttcacatatggcactataaaatgtgcatagctgcacatgtaccttatcttactgcttagtagctgctttagtagtaattatcagtatttgccttattttaccgcctagtagttgccttaaaagttattactatttttcacatgaagaatctcagcgcccataagcactgtgtagacataatcagaataatgtgaatttgaggtgcctttcacatgtttaacacaaagggacaatattgcttaatacgtcgatattgaacaacaccttttttcaggataagttgatataatatgttcgctatatgttccatgagaagcaatttatagtcccaactattctcttaaaaccaaactagagataccataattagtagctgcattcaatgtcatctacgaaggtggagtttcttctccagttctagaatacgtgtttggatatccaatgacctgttacataaactttataactaaatataagtcaaatttgtcggctgtggctcaacccttgggattcaagtcaattgtctcttatgacacatggaggcaaaaagcagtgtaattgtttttcagtttttaaaatgtgctataaatgtagtgaacaaacacttcagtttccccggaaaagtctcaatttatgcctgctgcaatgaagtaccataagtgtcccagtttggatgataaacaaggtggttaacgctacccataaactcacttctgatagtgtagttgttatcatactgacttttatttggaggagaaaagtactgcaagatcaatgcatatttcctcagatgtaggaggtgtcctgaaatggcaatctgcagaaaatggaagggtaaaaacacagaagtttgaaaatggtgaccaaaattaataaagggatgtatgatctcctaaataccccataaaatgttcttgaagtaaaatttcacagaaccaactaactatataggcaggcactattgtttacaaattgattcacaaactgtaaatgtcaatgggtgaatgagctctcagagcatttcacagtgctaagattaaaatacatgctacttctctgattgctgtaaacagtagttttttattttattgcagatctttaactctactattccagaaatgacagttttaaaagtgtcataaaaatgaaatttcaatacactgtcaatcatcctgattccatattgactgaagaagaataaaatccacttctcaagaattggcttattgtatgctcgtgtcttataattattgtctcattgattctgccaaaagagagttaattgaattttaagcatattgaaatgatgtttttattctgacaatatctttattccttacaaataaatttagagcataaacaagaatatataaaacaatagttattattcatacttcccatgaaatatgaatatttgattacctctgtgacttagatgatttatacaacatatgtattgattgagattaaaaattagactgcttaaatctattacctgttttcttattccttatcaacattcctgatcataatttctggtgttgaaatactacttagaaaatttttaaaatgcagtcattttaaaatcctgtgcttgaggataggaatatgttctaagaaattcattgttaagagatttttgtcactgtatgaacatcataggatgtacttacacaaacctaggtggtgtagcctactgcactcctaaggtatatgaatagcctacttctcctagtttgtaaccctgtacattacattactgtactgactactgtgggcagttgtagtaagacagtggtacttaccattgtgtatataagcatagaaaacgtccaataaaaacataatattataactttatgaaaccacagtcatatatgcagtccatcattgactgaaacattcttatatagtgcacggttgtaccatatttataataaaaatattgtgattaatattaacttaattttttaaatgtttttggctttaattactacaatgtcacttgacttatttttctatatactcttgtgtcaaggctagcctgttaattaaactgttttaagttccaaaaaaactgcaaatgcaaattctatcattttattcactaaattatcaaataatttattccaataacacatttacttgatcttctctttagatgacattatagttattaaggttaaggtgtgcattatgtttctattttataattacaaatatatttaatctaccaatgtattttaaacaatataaattatactaacattagttgcttctgaaagactctaataacatattctcatcactaaatttacaagatactttgctaaatttatttttttataatacatatacatacacacacactgtgaaattttgtaaatgtaaaagtataaagagagaaattaaactgtcctataatgccatttatttataaataactaacataaatatttgcatgttttctgtcattgttttttcgtaactgttgatgtattttatactgtagaccttttatgtgatagcttttctgtgatcatatcttcctttttttaagtagatgtcaatgtctctagtgtcttataattagaagcctatgtcatagacaataagggtggtatttctacacagtttttcctctgctatcagtaagcctgccacttattgaacttgaacctgagctcattttccattttgatatgccaattacgagcctaaaacaagtaactgtaaataataccatttaacatttagaacagtacagagtacagctctccaaatgagtttagcaatacttagagccagatttgtttgtgacaatgtaagttgatactattgacatttaggatgtgaactcaaaggagctacacatcctgcaatgttctggttatttcctaccaaaaagacatactgctaacattgagacacagatgggcatttaagaacaaatgtttttacttaaaaacaaaaaaaaaaaatttgccttgctcaagatacaagaatgtattcccaggaaaatatatgttggctctaagtatctttcctcttttgcatggtgtttcaaattatttctcagctatgcttcattgatcatgattggagttatgacatttttcctaactgcaaagaaggagaaacatttctcctccattttctttttggctttgatgttgtcagtggattcaaggaacagacgtaaaacaactgattttttttttttttaaccagaagctttaatctctaccagagaaatccttttaatacatgagaaaaagtaagtggaaaaaatggcgcaataattattctgaagattggggatagaatgctgggtatattctggggaaagaatgtaatttcacatatgtcaatagagatgtatgtgtgggaatacttaccatataattatattaaaatgcataagattatttttaaaaagcatccagaataattgtggagcatgttcagtaataagaagtgaagttcttcaacattttaaactcaagaaacataggtggatcacctgaggtcgggagttcgaggctaccctgaccaatatggagaaactccatctctactaaaaatacaaaaattagccgggcgtggttgcttatgcctgcaatcccagctacttggtaggctgaggcaggagaatcgctcgaacccaggaggtagaggaaatgctggggaaagaataggctatattcagggaagggtcatgccattcattacagaagaaaagaaaaggatggatgttactgccagtaaatgatgacaacatggaattatattattcctgcttattcatgctattttctaaaactcaaatctctctaccaaaatctagactgttatattcaactacattattaactttgctatttgaatggctgttttattacctaaatattaataaatcaaaagctgactttttgaccatcacccccaaacctgctccatccacagcccccacttcagtttactaaaactgcctttacagttgtatagattaagaacaatggagtcattcttgactccctttgcaatccatgttcagtccatcaggaaattgtattgagtctgtttttaagaatataaacaaaatatgacccttctttatctcttccactgctataatcctggaacaacccaccatgagttattacttggattactgtaataagctgccaattaattaatgctctttgttttaattcttaccccagaaaaattgattctattgcagatagtctttgaaaaataaatgtgatactgtcattccgctcaaaatgttgcaatgttttttcgtgtcatgcagagtaaataccagatcttgtaattgtcttctctgagacctatcttggtaatttcccctttcactctgttctgagcacattggtatccttactcctcctgcaatactctaggcacactttcactttatgatgcatgcactagaaatattcctggaacacacttagattttatattgtcatgaataacttcttcatctctttcaagtctttactcacatgttactctttcattgaaggttataactaatcacactagggatattactctttacttatacttctgatttatattactctttctttcttttattcatgtagttgtacttctttcttttacttatatagttatcttttataacaagatactttattcagtgatatagcctaagtgcctagaacagggttctacacaggacaggagctcaggaaataatcgttgaataggtgaatgaatatgaacctgagagggaaggttatccgcagagagtgatttaatggctgcttttcaatcttcgacatgtttttcaccacagagcttttgacacagttagccttgccttctacttggaaatatttctccatataatcaaggtttctttcctaccactttggaaactccacttaaatatgtttcttgcctttaaaatgttgaagaacttcacttcttattactgaacatgctccacaattattctggatgctttttaaaaataatcttatgcattttaatataattatatggtaagtattcccacatatacatctctattgacatatgtgaaattacagagtcttgcaagttgtagctgtaactgtagctggatatcttcacttaaattttgttgtctttttaatctccatactgctaaccagttctcttattttatcctatacagagaagccataatcatatatttaacatgtaaattaacttttgttactttcatcatacatataaaacaaagaatggcttttatactcagctaagtcctccatgattggcctacacctacctctctaaacatattttctacaaatctgattcttactaaatctgcttaagccacaatggctttttcaatatcctcatctcagagttgtttcagttattgttcttacgtcctactgtccccataatttatcctagtacctgttcacatgatactttcctaaatgtttcctccctacctaaaattgcatcaacttctatttttctcagccagcactaacccagttgaaaataataccacatttttgttaatgtgattgtttactccaattttctattttctcatcaggcttcatgtgggtaaggatcatgactgttgcatttttctataaaaaaattttggtagaggccgggcatggtggcttatgcctgtaatcccagcactttgggaggccgaggcgggcggatcacctgaggtcgggagttcgaggccaccgtgaccaatatggagaaactcggtctctactaaaaatacaaaaattagtcgggtgtggttgctcatgcctgcaatcccagctactcggtaggctgaggcaggagaatcgctcaaacccaggaggcagaggttgtggtgagccgagattgcaccattgcactcctgcctgggcaacaagaacaaaactccgtctcaaaaaaaaaaaaaagaaaaaaagaattggtggccattatcctaattcacttacaagagagaacatgcagtatttggttttcttttcttataagtgacagctaaacttgtatatgtttggacacaaagagaaagagaagaacaatagatgccagaacctacttgagtttgcagggtaggaagagagtgagagttaaaaactctcctatcaggtacaatgctcactacatgggtgatgaagtcatttgtgcaccaaagcccagagaaatgcaatttacccatgtaacaaacgtgcatacctgcgtatatacccttagaacctacaataaaagttgaaaaagaaaacatatatatatatattttatgtatgtatatatatacatacaatatatatttagtcttcttaagtcatatatatatttatatatacataaaatatatatgactatatatagtcttgtcttatgtatatatatttatatatacataaaatatatatgactacatatatagtcttaagtcttatgtatatatattttatgtcttaagtcttatgtatatataagtcttatgtatatatatattctatgtatatatgtatatatgtgtatttatgtatatatttatgtatatatatttcttaagtcttatgtgtatatatatattttatgtatatatatgtgtatatgtgtatttatgtatatatttatgtatatatatgtcttaagtcttatatatatattttattatatatacatatatacttttatatatatacataaagtgtgtatatatatatttattctcatataaaataaagaatgcttaagaagaggatggaatgccataagacagaagataaacaggtatttcaagggtctccaagatcaccttcaggctcagtgattcactagaggcactcaggaaagttgttatactcatgcttacattttttttttttttttttttttttttttttgagacggagtctcgctctgtcgcccaggctggagtgcagtggcgggatctcggctcactgcaagctctgcctcccgggttcacgccattctcctgcctcagcctcccaagtagctgggactacaggtgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcctggcctcatgcttacatttttaagagtgaaagaatacagattacaatcagcaaaaggaagaggtctgtgggacaaggtccaagtaaaaccagactcaagcttctaggtgtcttctgttggtagagtttcaatgacctgtttagatctcccagcaacaacttgtgacaacacatggaaagctaaagtgttatcaatcaaagaaactcatgaagctttgggtgtccaaagtctaaattggaggctgacatgttttgactgtgttcccacccaaatctcatcttgaattgtaattcccataatccccacatatcgtgggagggatccagtctgaggtaattgaatcgtgggggcagttacctccatgctgctcttcttgtgatagagagtggggtgcttttataaggttaccccaaaatttggaagcaactttggacttgggtaacaggcagaggttggaagagtttagagggctcagaagaagacagaaaaatgtggaaaagtttggaaattcctagaagcttagtgaatagcttggaccacaatgctgatactgatatggacaatgaagtccaagctgaggtggtctcagacagataggaggaatttgttgggaattgaagtaaaggtcatttttactgtgtgaagagactggtggcattgtattcctgccctagctatctgtggcactttgaacttgagataatttaggggacttggcagaagaaatttctaagtggcaaagcattcaagggtagcataaaagtttgaaaaatttgcagcctgacaatgggatagaaaagaaaacccacttcctggggagaaattcaaggctgctgcagaaatttgcataagtaacaaggagctgaatgttaatcaccaagacaatgggaaaaatgtccccagggcatatcagataccttcacagtagccccttccatcataggctcagaggcctatgaggaaaaaatggtttcctgggctgggcccagggaccatctgctgtgtgcaacctagagacttggtgccccatgtcccagccactccagccatggctaaaaggggtagaggtacaactcaggctgtggctttagagggttcaaaaaccaagccttggcagcttccacatgatgttgagcatgcagatacacagaagtcaagaattgatgtttgggaacgtctacctagatttcagaggatgtatggaaatgcctggaagccaatgcagatgtttgctacaggatgaagccctcatggagaacctctgtgacagcagtggagaaagaaaatgtggggtcataaccccagacagagttaggtgataaaccctgacagactccctgcttgcatggccttgtggagctgtgagaagagagacatcatcctccagaacccagaacagtagatccatcaacagctggaactgtgcacctggaaaatcctcaggtactcaatgccagcttgtgaaagtaactgggagtggggctgtaccctgcaaagccacaagggagccaaagctcaaggccatgggagcccacctctagcattcaccagacctgggtatgagatgtggaatcaaagaagattattttggaactttaaggtttaatgactgccctattggatttcaaacttgcttgggccctgtagcctctttgttttggccaatttcttccatttgaaatgggtacattcacccaatgcctgtaactcattgtatctaagaagtgatgaacttgctttggttttacagtctcatagttcgaagagacttgccatgtctcagatgacattttggacttggacttttgagttaatgctggaatgagttattactttgggggactgttgggaaggcacaattgtgttttaaattatgaggatatgagatttgggaggagccagggataaaatggtatggcttggctgtatcctcacccacatctcatcttaaattgtagtcccataatcccatgtgtggagggagggacacagtgagaggtaattgaatcatggggatggttaccctcatgcttctgttcttctgatagtgagtgagttctcatgagatctaatggttttataagggcttttttctctttgctctttacttctccttgctgttgctatgtgaagaaggatgtgtttgcttctccttttgccatgattgtaagtttcctgaggcttctcaagccatgctaaactgtgagtcaattaaagctcctttctttacaaattacccagttttgggtatgtctttattagcagcataagagtggactaatataggggcctaccacataggcatctagtcgctgcatgactgacttcagctactcaggttccagtcccttaggatgaatacattcagacaccataaatcacagtgtaagcataaattacctgatcacactggtccttcaggaccaaagctttagggatacataaactcacttatcaaacaaacaaaatattctaaggtctcagagattatctttttcctaaactgtcaaactactctgtttttctgaatatgtagagtttgagcaacctgcacatgctgatttaaccatttcctccagaaaattaagtttaaatagaaggagctactattttttttaggctttgatgttctcaaagtacaggttttaaataaataaaacctcactcttcatggaactgatatgtgcaaatttcagtttccatgatttagagaaaataacaccattccccaaacaacaaagtgcaatttttaactaccacaaaatgtaaactgtaattgcacaaagtataaactttgctgctggttctgcagcccacaaattaccatgtatgcaacagagtcatgtcctgatcaatgactaatcacggcttttcttgtgattcagtttacacacagataacaaatgtgtagtgttgttcccttttctccgagtgataagcttacatgacatcttataaaaatgaaaccatatattatatccataataccattatatattaatataatatagtattttaatagagtatagtgtatattagttgtataataccattattgtattatatacactattgcctatgtaaacaaaaaagtatctgagaaaagtctcaatcaatttagaacgtttatttaatattttgccaaggttaaggacatgcctgtgacacagctgcaggaggtcctgatgacatgtgcccaaggtggggggatacagcttgcttttatacattttagggaaacaagagacattaatcaatatgtgtaagatatacattcttttggtccagtaatgtgggacaactctaactgggggcttccaagttagaagtagatgagagtcaaaaggttgcattattttcagtccttgattagccttccactgaatacataatttgagctcttgatcagccttccaatgaacacacaatttagtctggctcagtgaatctgcatttttacataaacaatagggcagaggaagtaatcagatatgcatttgtctcaggtgagcctcagagggatgacttcgagttccgtctgtcctttgcccaaaaggaatttccttgtgggcaaattgtgagaaagatatgtagctttttatattttagcaatcatatttagaaatataatggaaagtgtgtttgtctgacatagttcccagcttgacttttcctttggcttagtgatttgcgggtcctgaggtttattttcctttcacatatataatatattataatattatatgtaatatctatataatatataatatttgtataacactatatagattttacaggtgaaatgacagattgtggcaatgatgacactgccactgcttgaaaggctctaaataagcagccagagtaatttagtgaaggtgaacttatcaatgtaaataaagaagctgattacggtaaaaggctagagatgacacacagaaagtaaaaacaacacaaaacttcacattcctataactctcagagatatttcttaatgttgaaagtgtaaagaataaaatattgggggctgatccaaatttagaaaggaatataacaattctccaagacatacaaaaagatgcttgcttagtggtgtaagttatacaaccacaaggcaatcaatgttcaaaatattcttgatgagattttttttacaaagaaaacaattttttaattttaaaaattacagtgtactaaataaatattagttttactatttttttatttccctatatattttatcacccacactaagagcattttaaaatttttaacaaatattttataggtcatggaacaatcataattttccccattgattattaaggtttattgccacagtttcagctttcatagtaaatttttatggtctcacactctcatgcaaagcaaagtctgtttgtatcttaaattatcataaaattctactcgtttttgtctttcttctcctttaccttattgattgctgaaggacaggacttcgatttgcatattccatataataagtaccagataacaaaatttgaataaaagtaaaataatccaatgagcataattaatttgccatagatgggtagttaacactgaaataaaatatgagataattgaataaaaaatataaatgtctctgccatcctggacttttaaaatgtatttatctcattaaagcaaatatgtacctaaaagactcaaacagtttaactatattcacaggccccaattccctaattactttccacctgtgcatgccattctgcactttctcactgtatctctataaaatagcatttttttcccttaagctccatatatcctaaaaatgcgtagaagattatatcagttatctgttgctacataacaatttactccaaattgatcaccttaaaacaaaagtttctaatgacagaatgctgaatgtggctcagctgaatatctctggctaaagtttcttgttttttcaatcacactgttgtccagggctggagttttatctgaagggcaacctggggagggtggaatgtcaagttcatttatttggttcgtggcaatatttagttcctcaaagatgttggatgaacagcctcagtttctacctggctattgtctggagcctctcacttcttgcaattttagacttttcgtagggtatctcactgtatgacaaatgtcttcccagaaagtgagcaagccagagagtgaggaagagcaccttagatgaaagtcaacagtcaattttgtaaagtagtcttccaagtaatgtctcattatatatgcagtattttattacttattagcatctcaaagagtccaggacacactcaaaaagagaacatttcacgaggtacaaataccagaaatagagatatgtaggagccaatttagagacatcttatcacaaaggcttttcagatttcaatttcaacctattgatatttgggacagcatctgtgtatttatgggatttggaatctgagggataagatctgatttttttttttggcaagcctcttgcctatccattaccaacagtcaaaggggaaaatattggcctctatatcatcttccattgcacacaggcccatgaagagtttatggggagactttgagcttgccagtggtggtatagccaattgaaaaatacaatttacttgaaaatataaattctataaattatccagagaaaaattagtttgtaatatctagaggttatcagagaatattgtttttcaacttattttgatttactacacacacatgcatacacacaaacacatacatatatgaagagataatctacgattaattttataattaaagtaaaagtattaaggacttccccaaatcagaggttattcagtctaggtgaggaaaaaaacatgataaactttcaggatatcaaaactagtcgaagatatttttctttattctctgatcaaaacaatattaaagaatcatgaaatgtaatgcatagaagattcagtattatgctatcttattcttttatattaaaatactaagtataatttcaaaatgaatatggatgaggaggattaagtcatttattaaactagcaaaaattactgaaaaaaatcacacctccattatcttatgtgatgctaggtagaaaagtattaacataaaagagtgaattaattatctcaattagacattcctgtaaaattataatgacctcctactaataccaaatataaataccattaataaaatgttaatggtataaactagggaaaggctgttgtctggagcagacgataatatcatggtcttgatttgttataatttaaaataaaacatatgaatttaggatagctggctggcttgaaaatagggagaagcccataaataatttttttctcaatgcaatcaacagtatataaaagaaaaagtctccaaaaccataatagtttccttttgtgaattgtgtttctgcacacattgtcaaaacttcttaatccaaaattgaaatacatgttaatataggaggaaaatgagtttttgttgctccgtctgttggttttgggatcctccgggaaaagaatgctttatctgtgcccaatgcttgcttatgccctttaaatatgtaaattttgatgctgggtaaaaattattatttgcttgaagctgcttttataattcaaaactttgcatttgatatttttcaattgaaagatatctttttgttttatagtaacaaaattaatcaatatacagcaaagtttttgacagagcctattctcactggaaacttgtaagcttctgtatttgtagcaattcgagtactttatctattaagaaatgtatacatgcattaatacaacttgtttggatagggtggaaccatttcagaattcaccaaaattctattttttttcattctaactgtacattcaccaactataggtgaatattggtgctttaaaatgtaaacccttaatttggttgttttgttttatagattattttttataaaatcatatacatcttcaagctgttttagcatatgatgaaagataatagatgttggatgaaattttaggtgcactgaaagctttgaacagaactataactgattgactcacttaagaattaaacttgaggccaggagcggtggctcatgcctgcaatcccagcactttgggaggccgaggtggaccgatggactgaggtcaggagtttgagaccagcctggtcaaaatggtgaaaccccgtctctactaaaaatacaaaaatagcttggcctggtgtcaggcacttgtaatcccagctactaaggaagctgaggtgggagaattgcttgaactgggaggtggaagttgcagtgagccgaggtcgcgccattgtactccagcctgggagggaaactgtctcaaaaaaaaaaaaaaaaaaaattaaacttgaggctttaatggtgccccaccctgctgcaatagactatttaatatatttttcaccaaataaatttattatttaatattttgttctcacttaaaccttaaaaaattacaaaaactgcctcttgtggctattatttttgtcatatttaatataatttcaatgttttagaataaatatataaacacgtttatttttgatagtagaaaacaatgaactgttttctacatttatttaggtatattctttagtatgcttccattataattttaaaaaattaatttttaaatatttagtttcaagcaacaattattagaaaatgttttgtacactctatttgaagatatagtttctaaaaattcttcatgttctaaaaattcttcatgaatttaatatgctgattattcttacaatattttttttacttatggctgctttgcaaaatataagataatttatcttagattatcttaatatatgattaaggacagagaaaatttaacttgatcaaaaacataggaactgatttatacatttttaaaaatcgactttattggatctttggaaacttacctttttcctctgagtggttcagttatgcagacttctgcattgcataggtattttgttcccatatattttctcattgcaactcttttcttcagcatgttctatccttattttaaaaggggattttagaatgttagcagtttgaatttcaataatgcggttgctcggagaggggaaggtattctaagacacagggtctctctttttttgaatttaaactttgagtacaaaggctgaataggaaacctacatgtcttcattattacctctttggtagggtaaaaaatccataccttgaatatggattcactatttcactaagcaaaatttgagttttatttctgtattctattggcaggaaaataaaatttttataaataaataactttttaaatggagagagatttctgaacttattacctttaagtttttcattatcctcttactgaggtgctttgtggtgctaacattttaaagtcaaaggattttgctgaacccaaataaaaacatataaagatttcaagaacctattttggatttttaaatagttatatttagttgaagaaatttaaattacctatttctacgtaatctttttatgtagccaccatgtactatgtttgtgtatgtttgcaaatgtgtacatatatgtaaagtttatgaaaagtattccatattactttagtatttctcttctttctattacttgcttttatttaattcaggtgaataatgtgtgtgtatgatatggtttgtctgtgtccccacccaaatctcatcttgaattgtagctcccataattcccacgtgttgtgggagggacctggtgggaagtaattgaatcctgcgggcaggtctttcccattcagttcttgtgatagtgaataagtctcacaacatctgatggttttacaaagggggttcccctacacaagctttcttgcctgctgctgtacaagatgtgtctttcttcccgtttaccttctgccatgattgtgaagcttccctagccatgtggaactgtgagtcaattaaacctgtttcctttataaattactcagtcttgggtatgtctttattagcagcgtgagaacagactaatacagtatatttgcatgtctatacacacacacacatatatatatatataactatttaaacttatgtctataattttatatacaattacattttacagccaggtgcggtggttcacgcctgtaattccagcactttgggaggctaagatgggcaggttacgaggtcaggagctcgagaccagcctggccaacatggtgaaacctcatctttactaaaaatacaaaaattagccagttgtggtggtgggcgcctgtaatccaagctactcgggaggttgaggcaggagaattgcttgaactccagaggtggaggttgcagtgaaccaagatcgtgtcactgcactccagcctgggcaacagagcaagactccctcttgaaataaaaagaaaaattacattttattatgcatttggaaagatagactaattcataaataaaaagactaaaattattagtacatgccaaattacaacctgtctttcttttgtcacacacaatatgtactgaacaattgagaagatgattttattcaggctattgcaatacagcaaacattcataaatggcaaacatcttaaaaaaagaaaggaggcttagagtagtatagcttcaggtacaagggagtcatccccaagatgtgggggagtcatggggcagagtgacagtaagtcttacctgaagagtggaggtgggtagttcttgtcacatgtaaaaagtaggtggtccttggacacacaaagtggtgaacagatatctcaatttttgttgttttccagaagcacgatgatcagctaaagtccagcattgccatatatttgataattattaacctaaaaaggaaaagaaggtgaaattacattaaaagtttcattaattaaatgaatcttggttatggcacttggaaaaaatagcaaactttttacccaaagtgttttattggacaaatgtttcgctgaaggtattacagtttagctggagtataccttatttacttgacttttaacatatataaataaaagagtatttggttattgttgtgtctatataatgtcttctttgaaaaaatattaatttaagagctaatcaagcttaccatttcaatgaaatgagccaaaagacacaacttaggaccaaactatctctttaaaaataatttttctttttacaaacaaaaagtgagttacttctcatgtattaatctatgtaaatttccagactttgtattaatatcttttaaaaatacattaatgctatttttattgaatgttttatgaaacattgaatacatctaaaatcaactagtttgcacttaaggacttcattatattctttcaactatattgcttctagaaatgttagtaacttgttctaaagaagtatataaaatgtttattctgtatgtaaaatgttagtgtaaagtacaatgtattttgtagcctacttagtattaatcagaggagtaaaatgtaacaatattagaatgctaaaagagtcatactaatacaataagcatgttttaaattcatacaagaaagttgaagattaaaagtatatttcaggcagtaagatcaacacgctaggttaatataataagatattcagaattatgagaatcactccccatttcatcaatgactatattagacaaaatggagtgcagaagttattggctacgatgtttaaaaggatgaaagccgagaaagtatagatttatgataaattctgaaaacaggaatctactggaagatgggaaatgtatttacttttatatttttatttatttattttgagacagtctttctgtcgcgcaggctggagtgcagtggcctgatcttatctcactgtaaacttcgcctcctgtgttcaaacgattctcctgtctcagcctcctgagtaggtgggattacaggtgtgtgccaccacgccgactaattttgtatttttattaaagacaaagtctcaccatgttggccaggctggtctcaaacacctgacctcaaatgatctgcctgccttggcctcccaaagtgctgggattataggcatgacccactgatccaggccagaagatgggaaaagaacatttagtgagtaagaattcaacgaattgcttaaatatattaatgtataatcggtgtaaggcagtatacagcatttccagtataggattcctagttccggacctgtttgtctatgacacctgtgatgttgtgcaaaaggaatattaataactgctaaacataaaattagaattaatacacttactggataaacacacaaaatatctaaatgtgtatatattagtatttttattagaagagaaattttatagatatttgcgtatatgcatagacttaaaaatatataaatacagcttatttggtacaataacatctgaataataattttaaaagtacaaaaataaaatttcaaaaatgtatacacctgaaaaacactagtcttctaaactctagggaacattattgcttcattttgaatttcttcaagattttttaaattcttacctcactggctgtgggccctggctcacctgcactagatttaatttcagaataataaaatataatgcattttttgcttttaaggtttagtaaatttttaaattaaatgtggcctctgtgttttttctttattgaaatacttttaattattctctttatatagaggtttctgatttattcatttttattcaaatatctttttgtttaatgcctacaatttatcaagctctatacttagactataatgatgaacaagactaacacaagtgctgtgctaatggaaagcttcaatatcatatcaaacatatatttattatcatgtaatttatcacataaattatcacatgtaaattatcacataatttattatcatgtaataaatttcaattataataaagaattgaatttcagcattctatgtgaagaattaacagaagaatctatataggtttgtgttctcacgcaaatacccatataaaggaatagtaagagttaaatgtcttttcaggtacagaaaaactgacttagagcttgaagtaaccatgacaaataagggaaccaaatgaaagtcaatatagctaaggtatggagagttacaggaatagatacgtgaaaagatcctagaaagttagacagaaagaaacccctggatggtattattggctagattttgggtctgttcaaatatcactaggaaggccttgaattgttctatacatcagatgaccatcagttttacatttacaaaaggagatcttaaagaatgaagaacaaataacaaagtaggaagagttaattttgaaacatcacttaagagaatattacaataatccagaggagaaatgatggccacttgacaatgaggaacaaaatggtgggtgggtttcagaggtatgtatgatatagaataaattggatttgtaatataattgatgtcaaataagagaatcaagaataattccagatttggggctgagggaaaaccattatgtaaaccatggtgtaattttctgatttagggaacacagaaaatatataagtttggagaggagatttgtgttaaataggtagtgctgttgagacagttcaaagtggatgtcaataagaagctccatatttaggccctagagcaacccctactggatatatgaatatgagagcctcacaaagagattgcaactgaaataatgagagtagatgcacactaaaattttttaaacgtccactataaatttcagaaaaactttaatcattaatgaatgtatacatgaagagaagctgacaagagactacaaaagaatgtccagaaaaatagcaggaaaacgttaaaatggcattttacggaaatagaaatagaaaattcaagataatatttttagagaaaaacaacgccaaccttatagggtactaaagtcagggcaaggcaaattaggattaaggtatgttcattgcattcatgatatgaggtctttaataaacttgctccaggtaagttctggaagaattatttaggcagccccttgaagtgtgttaaggaatgggtggctgatgaagatttgcaaatagcatttgtaaaaaacttcatagaaaagtttgcttatgttaaccccataatagcagtgtctactttaatcctgagaagagttatcagatatttactaacactattttatttttcttttactaaatatattaagaatatatatgatgatgaaagctctgacatttcatagtggttccttttctgagtttaaaaacttattttttccttttgttcggtttttaggcttgcttaatatttaccagtactgatttatattaaatttgatgaagtcttataaaaatgacccttcacaaatttttcacaaaatgatcttcaagtctagacaaaaagaaggatggagaaaaaaaaatcaccagaatcaatctgcagttcagaaattcagtagctttgggatgctgggaatctctaatgattattgtaaaaactggagatatgaataagcaaccaagtaaagcagccattgcacatcttattcctatttcccacttctcaactttgtctggaaaactcttccagtaataaactggtaattacatccaacatgatctttttcttattcctacctctcctccctactcctataaaatcttttctgcaatagcaacacttctttgagggacagaaaatgtgtaagactgaatatcaagtaaactgtcaaagagtgaatacgccttatctaaattgctctattataatcttgaagtataaagcagatcaagaataaaagtccaagaagcagaataaacaaataacttaagtctcccttaatccagtgggaattgattgattgccaatattaaatttacaattcatactaatatataaattagctatttatttcattggtaaacttgtttactaatttatctaaattcacaagcacaaatgttttatctaaaaatctaacctccgtacaagtgactataattagaaatataatatataagattttaattcaaatatctcatagttataattacttttttatttttcctcaccacaaacaactgctacatatatctgtaaattttgctttctttctacctttccctttgagatcctaagtgttctattactaaaatttacatttcccacattgatagatatttgataggtttctaagtttttgctgttataaacattgttaatatgagcaactttaaacatttttggcatgcatatatgagtatctctaatgaatatacataaaactggaataaggagttactgagtaggcatatccaactttccaagataaagcataattattttccaatgtggctaagaaatttaaactcttaaatattaatatttcacaacttcccactatattttacttgctaatttttggtactttcaaactataagtttcattaacatagtggctataaaattatatttatgtagtaattttttgcattttctttatcacaattaaggttcaacattttcatattgttatttaatagtaatctactccctgaatttaatttattttttaaacctgggtcttgctagatttcaaaagtaacgttgtttaattaattgttgtaattctatcttataccacttgtttaggttgcaagtcagtccaatgaaatgaatccatgtttactctgtataattgatttctaagtcttcatgaataagaaacacaagttatgtgctatttttatgctagcattatacactttttctctgtgtgtttgtatacatatgaaatgatatatttgggttcaaaaattaggattataaagggcttccaaggatgcaattaagcattttgtgtgctgagcatctttgttgatgctagtggtttctgtagcagtgttcttccaagttaaggaaacatttttttaaaaggcaatgatttgtttacaagatacacagagctgggggctttgtggaaataaatgaggtcaggaatttgagaccggcctgaccaacatggtgaaaccccatctctactaaaaacacaaaaattagctgggcgtggtggcgggcgcctgtaatcccagctgctcgggaggctgaggcaggagaatagcttgaactcgggaggcggagattgcagtgagctgagattttgccattgcacttcagcctaggtgacagaatgagactccatcttaaaaaaaaaaatcaaattaatgtagttctgtatgacaaagtgcagtctatacacagataaatatagatgctgtgctctctagacaaaatggaaaataaaaaaaaaggacagtatgtaatccatcaatgaagaagctggaaaaataaccacacatgtctaaaacacatggaaaagaagaattaaaaggcttattccagacctgcaaggtggcgtcaggaaaatagggatcaaaaggcccagaaacgtagaaatacttaaaagaactgttcattttctgttgttcaaggttgttctctcaactaaggtagcattttatatgctcgttttatatactgtggattatccctatgacgtgtttgaagcactttaaatcttggtagattcacggatgtttactactttaatgtgtgtaactctgtgttgtcttatcacttatcttagtcttctgcattcatataagaagataaaattacgcttatatgaaattgtaatgttacctaattaaatgtttccttcatgggatcagggccaatgtctgcttgcttactagtctatgttcaatgtctttctggataattaccacgttagaaaacttaataaatgttcattgagaaaataaaaactaaaataattgttgcccattatttattatcaaattatatttatatataaataagaataaaaattaaattgtattaaaattaaataatctatagcccctgtagggtaaatcccatgtgattttctggctgtaaacaaaataggtataatccctaaggaataaataattgtgaaagcaaatgtgaatgaatatattttaccaatggaaacaatgtctttgaaatatcaattatatctggaaataattggtttaatttagttttaaattatcaattatgtaacacagggtgcaagcaagtctctgtgtctctgtcgatatttccgagagagaaaaaaaagagaaacacctattctaacttaaatctgatctttacttttgttcttcaaattaagtccttccaagaaaaaataaatataaaagtcccttagggttaatagaataactcaaaacataatcccaacaacacagcacttttaaagctattatttactgaaaacttgtactagttgctatgaaaataatccttattaagttcatgtgtagagataacatttagtgtaatttaaccagaaatggtgtagaataacacagaagaaaaataaaaattgaattttgatgtgaaaatttaactaagttgtattaattctaataatatgtattatccattgtcagtgtatggtaatcagattatttctttattagaaagagctcataaaattgaaggaagcttagagtaattttgtaagttcactatgttcttgaaaacaacagacttacaggggaaaatattcaacaacttacttaagactatcagttatccttccataataactgtgtcaccagctcctgcagaatgtcatagaattttatttagaatgtttcattttataatttgttttatcccatatattgcaagacattaaaatattaacaaatgtacatggtttcgatgaataccagcatacattttcaatttgcaaattatagctcacttagaagttgtaagggattattttctatggataaataatatcatttataataaagtttcaaattattttcctcagaaaggttgaagtaactttttgttaattaactgctatatcagaaatgatttagctaaaaaagcatgaataatttattgtcacaaataattataatttatatgatttacaattatgaatgtcttatgatttattctacattttcaatttatgtcattcttaggtactttcttaaataactatgaatcaaaacatattgagaaagcactaaaaatatttttattacattcgtaggcattaactatcttccttatatattccttgacatactttattacttaaataaaacatataactctatttaaataaaaaatgtaaaattatattttaaaacatggatattgttttgaaattatgtatatatcattttaaatataatatttaattgtattcatttcaataaattatttgattttgattttctctacagtcttttgtggtcacacatttaatcacaaaacacctgtgaattacataatcttattcgtaaaaattatagacaggaacctaagcagaagatgttatcgccagttgaactatggatgctttgttgtatgactgcatttacaaattatttgacctcctttagatttggtcttatgttgagtataggcaacctattttaaaatagccttcttcacatttgttttctaatcagcacaaaaccatcaacctctacctggagaattgctgtgaatttagaatttgcaataagtgttgagttcttcatagtgtgcgaaacaatttgtattcattttgcctatttatatagaaaaatgtttggtcttgatcatactcttgatgattcagtaatattattcagaatgatttataaaatattttcaatttttagccctttagtttgtcttggatgaaatttgaaaacatactttaactttgttcaaaattattttattccactgtctaggaatgtaaaataattacaatttttgtgtgaatcttgatgattacacatggcttaaaaattattagcacaattattctttgaaggaatgttactaactttaaattattagacaacattatactatgataatcagtttaaagcttttttctgaaaaaaaaggggcatgttatcaactctaattttggaaattgtgacaatgtttaaatgtatattatttaaacacaaagttttgtagctttctcaaccttctatgaatgaatgcacgcaattttaacctctcattctataactatatatatatatattttgaaagagtaagtataatttattttttcttaatccctatatttttaataattttttttttttgagacggagtctcgctctgttgcccaggctggagtgcagtggcataatctcggctgacagcaagctccgcctcccgggttcataccattcttctgcctcagcctcccgagcagctgggaccacaggcgcccgccaccacgcccagctaatttttgtatttttagtagacacggggtttcaccctgttagccaggatagtctcgatctcctgacctcgtaatctgcccgcctcagcctcccaaagtgctgggattaataaatctttatatcactaatttaacattgttattagttgtcctagcatatctaaaacaatttttgtataaacattatctagctctcatagatatttgatttttaaacattttattttataaaagcagtcttatgggacaaatgttcactttatagtagtgtttcattgatgttgattctatttgataagtaaagttcatctcccatgtaaagcagaatattcgtataccattttagttattgacatttttttctatgcttctgattttatgaaaaagaagtccaaatttgaattatacaagtaaaataacacaaactaacatcaacacaggaatacctattaaatgcacttttaaatatatgcataaattgctaactagtttttaatttaagactataaacttgaatgatggcagagtatgaatatatagcctgacaattgtcaacttacgagacacaatattatatttatttaagtgaacaaaattttccatattcttattttctattatttgtaatcgtctgaataagtacttaatgctgaaactatgttttcccaatgtaattaagacagggaaatcctagaaaaaactctaggaaggaattcatgactaagtcttcaaaaacacttctaacaaaaacaaaacttgaaaagttttaatctagttaaactaaagagctcctgcaaggcaggagaaactatgaacagagcaaacacaccagttacaaaatgagagaaaatattcacaaactatacatctgacaaaggcctaatagtcaaaatctacaaggaatttaaacaaatcaatcaataaacaaacaatgccattaaaaagtaggcaaaggccatgaacagacacttctcaaaagaagacatataagcgaccaagaaacatatggaaaaatgctcagtatcactaatcatcagagaaatgaaaatcaaaacacgagataccatttcacaccagtcagaatggcttttgttaaaaagtcaaaaaataacagatgttggctggattgcagaaaaaaaggggattgcagaaaaaaggggaggcttatacacgttggtaggaatgtaaattagttcagccactgtgaagtgcagtttggagatttctcaaagaactgagggttgaactaccatttaacccagcaatcacactactgaatacatatgagaagaaaaatgaatattctaccaaaagaaagatgcacctgtatgtatatcacatcagtattcacacagcaaagacatggaatcaacctatatgcccatcaactgtggaatggataaagcaaatgtggtccatatacactatggaatactatgcagccatagtgagagaaaaaatcatgtcctttgcagcagtgtggatgcagctggaggccattagcctaagcaaattaatgccgaaacagaaaaccaaacattacatgttctcacttataagtgggagctaatccctgaatacacatggacacaaagaggggaacaatggatgcaggggagtacttgacggtggacggtgagaggaggaagaggatagaaaaactaactatagggtactatggttattatctgggtgacaaaataatctgtacaccaaacccctgcgacacacaatttataacaaacttgtacatatacccctgaaactaaaatcaaagttaaaaaaatgaagaaaaatatagtgtttcagatcccatcctggaactactgaaacagactctggaggcatggtccagtaatttacatttgaagtaataattgatggtatattttttccatcctttaaatctatgcatgttgtagaatttgaagtaaattttccagtaaacagcatatgggtaggctgtgtattttatcctctctgtcaattgcttctttaaattgacatgtttaaccatgtgcaattaaaaaaataattctatatcagagaaacatttcccattttattatttatcttctgcttgcttcctctgcttcttattccattgtttctctttttttttcgtcttcttctaggatacttgaacatgtttttagaattctatcttaatttttttcataatgctttgagtgtatgtctttgtatatttttcttagtggttgctctgtgtattacattattcgtatgtgtcttagaacagtctaatggtatcaacattttaacatttcaagtgcagtgtagaagactgactttcattcaaatattttactttctgacttttaattatgattttcttttttatctgatggtgtcattattttcaatcatcaatatgaattatacaactcatgaagatagtctattgcatgaattatacagtgaatgaattgtccaacttgtgaaggtagtaaattgtatgtgtccacatatctattctttcagttgtatttccttcccggtgatccatgagttgttcttttataatttctttgctttatgaagaacttccttctgccatttttcaatgatgtcctcaagatctgctacccaaattcttttactacttctttgatatagaatgtctttgcatcccaaattcttttactacttctttgatatagaatgtctttgcatccccttcattcatgataaaaatttaactggatatagatttcatagttaatagttatcttatttctgcacttaaaaacatcgtgcaatgtttttctagacaccatcatgtcagttgagaagtatgctgtcatttgtattggtaggcaatgcatcatttctctctggctattttcaaggttttgctttgtcttcaatgttcagaaatttcactgtgacatgacttgttgggttttgggggtctttattatatgtagggtttctttgaatttatcctatttacagttcactcagtttcctaactctgtatatttatgtattttaccacatttagaacatttctagtcattatttcattgaatgattttgcagctctattctcacttccctattctttgattttaatgatacaaaagttggatctgtttttctgccccatttatgtaaatactgcaagatatatagatggaccctgacgtcaatgatggtttaatttaacatatttttgactttataactgtgcaaaaaatatatgcattcatttaaaatcaaactttgaaaacctatacaactattgtgtttttcattctcactacagtgtttaataaattacatgagatatttaacactttagtacaaaatagaatatgtgttacttgcttttgcccaactgtaggctaatgtaagtgttctgagcacatttaagctaggctaggctaagctatgatgttctgtaggttaggtgtattatatgccttttttacttataatattttcaatttataacagatttattgagttgtaactccattgtaagtcaagctgcatctgaatttataattttaatggagcttaataaatgttgtaaaaattaacaaaattgatgggggaaaacatttgagttgtgattcaaagtctatttttaaataaaagttgttaatttagtaaactatatatatatatcttaaaattaaccaagaatacattacttgtggtttattagtagggtcataaatggcataataacatataaatataaaatatttactataaaataatgttaaaactaacattagcttaaaatgtgtctaacatattttgagaacatgtataattggaaatatatttattatattatatttgaggtattttgtttagagactatatatcaatagaatacttccacttatgattctttatatcattaccccaatcttgccaaataatttataatattcataataaaatatatttcagataatgattcttggggaactcttaaggaactctaatgatactgctaaaactatccattacaataaaaaactcaaaattatcataaaataatcaatgttccctttatacttttagagtataaactaaaataatggagttattataaaatttagcaaatgaattctcattatttctctgtttgtactatttacattccctactatacagagaatgatacttacagtaggaaatttagatcatatatcctttttattaaaaagcttctaaagctatcccgtttcactgagaatataatacaaatctacctcatgtcttgctcctcttgctgtcaatcactcagctactgaatgtgtctcaacccaaccataaacactcctgtattaggattcttgttagctgctcctagaagattttttcaccagattctgaatgcctatgatgtcacattcagtgtaataataaaatggccctatatcaaagatgcctgccctggatctcttgtctgaaacagcccatcttttaatcttattctgctttctttttcaaaagattataaatgggtaaaaaaagacataaatcctatgacacagcactaaatgtggggaaccaggaagtattatgacaataaaatttgtaattaagatattttatgggcaaagtcctcaattttatgattaacattaactagtatatacatatatatatatgtacctagggcctaccttcatgcaggcagttgactactagagtataacttgaaaaatgctaaaacattttccatttttactacaatgtttgccaagtgcattgttttgttttaaagatatgctttttactttttctgacttcattcagttcacataaagagtatagtctagtcaatattatctcttatcgcccttgagagatactgcaaatggggaaaggggcatttcttcattattgtgtagaattgtgtctagagtggactaaattaattatgtataggctggaaaaggattatgaatattttaaaaccttctttattgttgtgacatatttagaacattgagctgaatgaaagtcattgttaaacacatttgttgagctagtaactgccagaaacaatgtaatatgaataaatatgtacataaatttataagagaaaagtcaattttgggattttgggaatggattaagcaaatatatttgtatagagtagagatgtttgagaggagactgctagatatatagactggagtagtagaggaagtcaaaaaggattgaacataaagaaagaaatataccagtaccagctttcaaatgttctacatagaggactaagtcccaaataaagtaatttaaaataaatttatgagcatatataaatgcttggactaacatcattcatttttgtttcccaaaagctgattcctttattctcagctttattggggttatactgataaatataaattttatacagttaaagtgtataatttgattttttgatacactatatattgtgagtcaccacaatcatcctagttaacatgtttgtcacctcacatgttaaacttttggtgagaagacttaagatctacacttaaccaatttcaaatatacaacacagaatgattacctatagtcaacattctgtatattagatctccagaacttattcatagtgcataactggagaaattctacagcatcaatcataaaaaatatagccatacatatttattttctaggtttgtgtgagcaaagatcaaagataaaagagtagaataattaaaaatctctatcattagtaatcttaggacatagttacactagttaagtattcttattaatacctagttgaatactacctcagtgaaggaaacattaagtgaatatgacacatcaccatagaaaagacctcacagagactaaattatttctttcttatataattattttttcccagatttattgaagtatgattgacaaatgaaaagctgaatatattcaatttgtggtatatttgacattgagtatacatgtatttatcattgctatatctgcctattcaagtgacaatttatcatcatataatgacctgctttgtttcttgagacaagttatcacttaaagtctattttgtatgatataagaataactatccctcttctctttttgtgattattttttatgaaatatctttatcctttctctttcagcctatgtgtgtcccataaatctagaaaatatattgtagataacatacatatatatgtaatatttatatataaaaatttattcagccactctgtttcatttggttggtaagtttaattcatttacatttaaaatttattaaattgatttgatttataatagattaaatggatcacattaagtgtaacccatttaatacatatacatttaaaataattattgataggtaaggaattacttttgccatttcattaattgtttcctgtctctttgtaattttttaatcttctcttgtgtttctttttgtagtttggtaatttttttgtatgatgtgctttgattctttcccttttagcttttgtgtatctactgtgtacacgttgaacattttctagataaagaagtctgctttaagctgataacataacttcattgcatacagatactctacactttatgttttttcttgtatatgcagtttatgtaaatgatgttacattttctttctacaatgtattgatattaaaaaaatcccgtggttatggttattctgactacttttgtcttctagtttatatactgcttttaataatgatttatgttctactattacagtattaaaatattctgtttgtttatcttttaaattatatttttacttttatacacttttatgttgttgtttaacatctgtactttaaaacttgaaaatcttcctttagcacttcttgtaagacaggtttagtggttaaataactttcttatgttttgtttgtcttggaaagtcttatcttttctttattcttaatgtacagtctcaccctgtaaagtattttttgttggcaagtgtttttccttttgttcttctagtactttggatgtatcatttcattcctggcctgcaaaatttctgctgacaaatacactgataatctttttactcttgctgcttataaaattatctcattgtctttgacttttgtcagtttaattatatctatttggaaatttgggctttatgaatcaagatgttcatttctccttctagatttggaaagttttcacctgtcgtttctttaaatatactttctgctgtttctctcccttttttccttcacagattcttgtaatgaatacattgttattcttgatggtgtcccataagtcctttatactttttttgctactttttttttcttttttttccctctctaattggataatttcaaatgatctattttatagttagctgattcttacttctgaattattgagtctgttgttgaagctacctgttaaaattttaagtccagtcattgtattatttagttccaggatttctttcttttgtatggtttcatttatttgttacacatttaatattacttgtgtattgattttctgatttttgttccattatctacatggttttttttttgtagctcattgagtttccttaagatgattattttgaattctctgtcaagcagtttatgaaactccatttttttagagtcaattactgggcctttattagtttcttttgatggtgtcatgtttttctgattcttggtgatcattgtagacttgcattagtgtccgtacatttgaaggagcaaataattttatcattgtttacagactgattctggcagatatagaccttcttctgctggatacccagactggtgggactaactctgtgactgtaggtgagcaggaatagagttgggttgtggggtaacttttgggtctacagttgagtctgaatatgacagtccttttaatcagagtcttatataggtacagctcctgccaaaaagactctcattgataaggtcccccgtggacccctgggtgggcaggactgccttcaggaacccagtagagcaagactgtatccagagcattaagctatttcagggtctacaggcaagtctgaggtcagcaggcttctactgggaatgacaatttgcatggctcctgccaggtttttgagtgggtaacactgcctctagaccatgatagcatggggctagagtgggccattgagcttcttcaaggggctactgtccagtccaatgtcagtgggcctgttaacatgggcataaagaggcatatctctcattaggtaccagagcaggcaagactgtccctggactgtggtagtgtggggctggagccaaattacagggctgctgcaggatctgtagtcaggttcaatgtcagagggcgttttacccggggtagatatgggcatgagtcctcccaggttcctgagctaatgaggctggtgtgaaaaccacggcaaagcaggacaagagctgatcttccagaagtatatggctgcctctagtctaaagctaggtctgtggttggtaagcctgccactgaggcacaagactgccctcttatagtggatgttttggttttaaactccactggagattcacaatctcctatccggactccaatgctcctgcaaaggcacttttgactgtgaatggctgctaaatctttcttgccattggggaatgtgaactgggaaatttctgttctgacatcttgctgacctaggctaacatgatttgtatctttctggatttcattttttcagatattaaattctatttttcatatttacatatctttataattaagaattaacagcactattaataattgataaaatcagacttaactttagtaatttatgtttccaatgaatgtaaaacaggtactttaaaaatttttattaatatagttgggggttgtaaaaaatgagttagacaatgagagagtgtaagacttttactaaagagcctttattaaatcaagtgcttctacattgatagaattggcagttatcataataaatcctcctatacttttatgctgttttgaaaatatataatgtaaaactaactttttataaaaatgttttttatttttttattttttcatttttttaatgttttaatttttattttttattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgttctcatcgttcaattcccacctatgataaaaatgttttttaacaaaaactatgcatttttaattcagtttttttttttaattttttccagtgaatgttaatatatgttgtttgaataaatattcattgtgttcatagttctatctgaatgagggtttttttctagccatgacagaagaatctcttggtatcattataggttttgatatacattgatatgctgaaaattactttacataaaaaaagaaccattatgttatgaaagaaaaaaaacagaagaatttagactccaaaattgttttagctcaaatataggttatctctgttcaaagagacgagagtctaacatctacaaatcccaaaatcacctttgtcattggcatccagttagtgaaagaggagaaaatacaaattatcactttgttggatatacttatgaattaggccagagagagacaaatattacttctgcccacatcccatcgactataacattattattatggtcacctagccccaagggatacttggaatataatctatctccatctgcacaatatattgcagatctatattctgcagatatatatttgcagatctatattctgcagatatatatttgcagatctatatatctgcaaaagggaaaataaactgtgataatcaggtatcaacatcttacacatccgtttttttattcttacctcacactcatgctttacactacataaatactgtaactactcttgttatcactactagcactaaataatagcaataatgatgataagaactactgacattaagcattatgtgctaaacactgttttgtataacattatctattcctcccaacaatcctatttttagatcatattatcatcattaacttgcaaatgtaaaaacagaggcacagaaaaggagataaattgcccatttttacacaaatactaacagagtctatatctacatggaggaaatatatggcaagatcatctattcttaggtatacacaatgggagattatttaacactgctttgcggaaacaccttaaactctccaaatctggttttctcatctaaaaaatgtgggtaatacgtatattctagggttggtggaaaatataaattataccatgtctaaaaatggcctcagctactcgggaggctgaggcaggagaatcgcttgaacccaggaggcagaggttgcagtgagccaagatcgcgccactgcactccagcctgggtgacagagcgagactccactgcaaaaaaaaaaaaaaaaaaaaaaaaaaaaaacaggcaaagtcggttattgatacagattttcaagctaaaaactaaaattttaaccacaatgtcatcattttttaaattcatcatgcaagagaagatatgcccatactggattgacctccacttttacttttgtgaaaaataactgactgtgaaattctttcctaccataattaccaccatcaaaattttgatactataaactcatttataagcatgaaatgttgattttaatatttaatgttttaacatgtggaatttgaaataacatgataaattttagattatcatttaatcatgttttgttgtaaatacagttaaaagattagctctccttctcctagttagctgtgactctcattctgaaaatataaaaactttaattgatacagaataagaaattatcttagcagatatggaccttgctcaggatgagtgaatatacataaactaaaatgtcacacgagaaataagaaaaagtggcatattaggaaactgatgaagtgtccagaaagattggtctttttaaactttattcaaccctctgttaaaaaattcaattggttaccattactcttcaggtaattatctaaatcttgaattcgattgtatgtcctacttcagttctactctacctctagagtgatatgatgttattacaattttatttgttccctatgctacattcatgtgaactttcatttcttattgttccaagctcatttcagtataaacaatttatggaatgtttgtcaaaagcgaccccatatgcatgtttccattaactgatttattcaattttcagctcaattgccactttataaaaagaagcttccatttatttatcattttttaaatgtccattatacatacattttctgtaattcttctctttagaaattattagagcagaaagttgtatatgtttaagattatttaattaactctttaattctataacttaattccataaaggtccatgaaagtaagaatcatgtatgattttctcaaaattaatttctagcccataccacaaatgttatgtggtagagttttgtaaataattgctgaatagataaatggttctcaaaaatatttatgatataaattgaattagatttcatttttacatagtttttcccattgtattataatgcccttttccaacaatattcacaaaaacaaagacactattattgtagttacactgtatttttatttatttatttatttatttatttatttatttatttatttatttatttatgtagacacagtctgtctctgtcacccaggctggagtgcagtggagcaatcttgtctcactggcaacctccaccttctgtgttcaagcgattctccagcctcagcctctgaagtagctgggattacaggcgcatgaccaccatgcccagctaattttggtacttttagtaaagccagggtttcaccaggttggccgggttggtcaggaactcctgatgtcaggtgatccgccgcctcaacctcccaaagtgctgggattacaggtgtgaggcaccacgccaggctcctttattgtagttacactttatgatgctattgacattagatcatagactaatgttgctcctgagagttgggcagcataatgcaactgagtgaacagtatgtaaactaccaagaatattaaattataatttgtattgacataaaaaagtagtaatttgagatgtaaggaaagctggaataattctgtagttttaaaacataaggattctaacagaccaaaacaaattacgtataaaacagaaatatttactggctaactctaatttccaaagtgatggtgaagaaaaaaaacaaaaacaaatctcataaaccaactcttccttgggctaatgatttctaaaatgtaatgcaagttacataaaacttctgaaatatttccatagtcataaaatgcttctgtgggttaatttaaaatcaattctctagctaattggtacaaaagccagtgaaagctgctactgatttttgagaagactcaaatagaaaacagtcatttgccaaatcctctgatagtgagattcacaagcataattatgtgccaggttttcatctctaatctaaaccccagtgaacatttactttgaaggaatcaataataaattcaaagagaggacagaatccatagggtgagaataaaagatcaacatctggcttcaagtcttctagtgtgcatgtatccaagcaattacacagactgagcaactgagaattgagtttacaatcttattgcaaatttttaaagaacttcaaactttagtcttttcattttcttgtgacttaatctatgttcacgttccagcctgtcctctgaattcttcagaacggatttatttttctaatgtcatatgtgccttaggcagcatccagctatcaggtctctgcacacctaggagctaattggtggaactgctttccataaaatattcataccagtaactatttttaaagttaatttaaaaactacttctctttcattttaatctcaaatattgctagtgaaattttatgtgatatctttacttacaatcccaaaaggtattgaaagttatgaactttccttagaggaaaagatggtataacttcatagtcactgcctcattatcctatactgcagtttggctttgaaccaccaatcccagaagacattacaataagttatatacgcattttcttgaaagaaatatgatatattcaagtaaaatatatttaattttctgtaagttccttggctctgaaaacgataaaacaaaatgtaataccgttatacaaaaattagcacacctctattccttaattttgtttcattttgtgtttttaagtaattagacctgtttatacttctaagaattattacacaaagataacactgcatttcagagggccctgaaatttactgtaaataatttcttttacttgagaatgagtgtaagcacacacccaaattctagctcgaacagaatttacttaatattttaaggttcaattttcatcaacagaattagaataataatactaacatcataatattaatagaatgattaaatttggtaatatatttaaaattcctccaaaacttgaaaattaaataagtgctaccaatcgcaacattagtttcttttgattatgagcctcagtgattatatgtgtgcctatattagaattatttttactgcaataaagaaatatattatgaaagaactgttcaagtcttatgtgtttattggcacctattaaaaaagtaattaataaaatttaatataaatgtattgcaaacatttgattttctaaatattgtttaaagccctctttcgcagaaaaaccataaagcatgttgtttttacaaaaattaaagaaagtagaaactgagaggaaatatatgtatgatcaaatataacttgtaaagctaaatattggctctaaatggcagcgatttaagtcctgaaagtagatatttcatgccatactgatgagcataatatcaaaaaataatgtttcctggatagttttttactgtgtttatgtcctacgccttgtatgaaaagaacttatgaactataaacagaattatgttgtctccaaagagatcagggaacacacattagacaccactctccgtaaacctacttaaaatgaactaaaaatatttagcctgtgaggctattgactttgactaataattctaataataattagaatcactctttttttagatatataaatttcacaactgaaatggatttggtaatgataatattgtctttatactacagttatcatttgcagcaataataaatgtagacggtttcttacaatacattagatagataatattaacacacacatatatatacacacacacacacggacatatatacacatacatgaaattatgaaattctggaattgagctcagaaatttgcattttaacaagccctattttaacaagatgtttctgatgcatgtcaaaatttgagatgtaccagtttaaacaggtgtcttttacatttactcatttatttacctttttgaagatcttaattcttcttataccttctttagactacctgagatagtttttattcagcctgaagaatttcctacagtattttggtagcgttgctctacagagactaatactattagctgttgtttgtctaagaacatctttattatgacttttattttgaaggttatttttagttgggtataaaattctagatttgcatatttggggtgggaaggcttcaagccagttcccaaactgaatcagcaaattctgtagataagaaggcaatcagtaatgaaattatcaatgaaaccactctcatatatatatatgtatatatatatacacacacacacatatgtacataattttgttcccacaaatgttattcttgagattttttattttttaaaaaaattattgcaacagttttagaacaagtattgtttcttaaccattccaatcaacaaattaaatttcatttatagtgataataacaactgaggtaaattctcttctattataagccagttattttgagaatgaaagtaacagtttggaaacaagacttttaagcctcctatagttcctactatggaaggatgcaactatcatgcctcattcattgcactaaagattatttaagaaaatgcaaaatctataaaataaagacattttaactactaaaccaagtaaacaatgaaaaataataattcagaaaatgattaagaaaacttatttgatagaagacaaacgagtctacacatcaaaatgcttcttcaagagccagaataatttacttttaatatatataaaaacattagtttgtgttatcgttgtgtccggaattggtgggttcttggtctcactgacttcaagaatgaaaccgcggaccctcgcggtgagtgttacagctcttaaggtggcgcgtctggagtttgttccttcttgtgttccgatgtgttcagagtttcttccttctggtgagttcgtggtctcgctggctcaggagtgaagctgcagaccttcacggtgttacagctcttaaggcggcacgtctggagttgtgtgttcctcccggtgggctcgtggtctcgctggcttcaggagtgaagctgcagacttttgccatgaccgttacaactcataaaagcagtgtggacccaaagagtgagcagcagcaaaatttattgcaaagagtgaaagaacaaagcttccacagtgtggaaggggacccgagggggttgccactgctggctcgggcagcctgcttttattctcttatctggccccacccacatcctgctgattggtagagccgagtggtctgttttgacagggtgctgattggtgcgtttacaatacctgagctagatacaaaggttctcctggtccccatcagattagttagatacggagtatggacacaaaggttctccaaggccccaccagagcagctagatacagagtgtcgattggtgcattcacaaatcctgagctagacacagggtgctgattggtgtgtttacaaaccttgagctagatacagagtgctgattggtgtatttacaatccctgagctagacataaaggttctccaaggccccaccagagcagctagatacagagtgtccattgatgcactcacaaaccttgagctaaacacaaggtgctgattggtgtgtttacaatccctgagctagacacaaaggttctccaaggccccaccagagcagctagatacagagtgtccattggtgcactcacaaaccttgagctaaacacaaggtgctgattggtgtgtttacaatccctgagctagacataaagactctccacgtccccaccagactcaggagcccagctggcttcacctagtggatcccgcaccaaggctgcaagtggagcttcctgtcagtcctgcgccgtgcgctcgcactcctcagtccttgggtggtcggtgggactgggcgccctggagcagggggtggtgctagtaggggaggcttgggccgcacaggagcccatggagtgggtgggaggctcaggcatggcgggctgcaggtctggagccctgccccgcaggaaggaagctaaggctccgtgagaaatcgagcgcagcgccggtgggccggcactgccgggggacccagtacaccttccgcagccgctggcccgggtgctaagtccctcattgcccggggccagcagggctggccggctgctccgagtgcggggcccgccaagcccatacccacccggaaccccagctggcccgcaagcgccgcacgcagccccggttcccgctagcgcttctccctccatacctccctgcaagctgagggagtgggctccggccttggccagcccagaaaggggctcccatagtgcagcggtgggctgaagggctcctcaagtgccgccaaagtgggagcccaggcagaggaggcgcccagagcgagcgagggctgtgtggactgcgagcacgctgtcacctctcatcattacaaaacaacaaaacagaaaccatcaaaagcacgcattagctaagtttgcaaaaaatatgaaaatatcgaattgccattataactatttgtaatacaaagaagtaaagaaagggccagaagaaaagaaaggaatggaagggagaaaagaagtcaggctttacagaaaagaagaggaaaatgaaggacaggacgggagacatgggagccttccagccattgcaccttgtagggttaattccctcaccactctcatttttctcctgccagggagagcctcagcactccagacctgctacaccttgtgtgggacaaatctctcccacctctgcaagtcacctgtcaaggtgaactgttttcaggcagagggagcttttggctaagttggaaaagggggaaagagagagatacagagagagacagaatgaattaaggtccacatacaaaaggcacatattcacagtcacatgtacaaataaatgacgtacctccatagaaactcccgtttaagaggctgggtagagtgtcaaatccctcacctcagattcaaacgccttccctccccaccttacccacgggcgactaagtccaaaccgagaaaagccccacaggtgccacaaatacaaacgcataaaatgctcaaatggtttcactagcggccaagtctaaatagagcagagccccagcaacagttcaaagggggcagagggtgttcgggtgcactccaactgagtcactcagttctgaagttcaaagttccaaaattctagtttcaaagtttgtccacttctctaaagatcactttgtttgaaccaacgaagcactgaaggcaacagacactgcaacaggaaaagaaagagaggatccccctaagacagcctcaaggaaactccccaccgttccagctaaggggtcagctagccacaagcagctgtatttcacaggcagcaggcagccccatggtttgtctgatggaaaccagaccctccggctcagcccccggagcacacagggcatgtcaccaactgaacaaatcagttccggatgctcattgcttgcagagtccaattaacaagagtgaggtctgggagaaagtaacttattaaccaaacctagcaaaggggaagcagttggattgccatccaaagtaactactttgactttttaggggcgtgggaggaaaggcaggggtttaaaaaggaaaacttgataaggaaggcgtgtaagaatggggatgagtataatggctgtgtgtcttcttcagctgcttatcttgagttgcagtccacctggacctcaggctgacagcatgtcaacaatggctgggttgttaattagccagcttgaagcaatctctggaactttgcagctgggtctgcagaattggtctacctgtctccagattagtccctggaacatttaagaagacatgtaattagatactagcacacagttagataaatgtaaagggagtatatatgttgaaaaggggagggatatggagtctattttaaggttcattaaaaaaaaggttctgtattttgcctcaaggttgtatctttaaatgcaagagaaggaaaaaaaaatgcattttgaagtcaagtggctgggctacaagcaaagagccccgtttttagttccatactttagttgcaaagagccacttaaaatggcatatgataaccaaggcagcccatattcaatgactaattgaggtggaggcacaaagatccttatattttggccaatgtgggattattctaactggatttttgtgttccagttctcacaatataaggttgaccaaggctttgttgagcttgcatcatagtttaacttctttctctgcccaaccacataccttcatccccatctttttcacaaatacttatcacttataaacattatgcatgctaaattccatctcagtgtctacttgtgaaaaacacaacctgtggcatatacagcccactgtgacactaaagaaatgaaaagacaaaaaggaagagtccaggtagagatgcatgctaggtattgaaacttcctgtatataatacttacatagaaaacaatgtgatattttatctacttacattattacaaaacttgatacagaatttctcacacaacaaaaaatcctggagagtgtttataaatacctacagttgtcttatttatatgcttgctaatttacttgttacaaattgtatgctctatgagagcagggaaactttaaattatacacatgactgtatcttcaaatagcaatgaatgaaaaagtgtcaagcacacactagattgcagatccttcagtatactaaagatagagaaaatattaaaagacaaacagaagactgaaggaaagacacaaatgactgtacacatatcaaaagacacccaattttattaataatgaagaacatttaattgtaaatgttaaactttactgttaaggaaaagaatgcatcagtgggaatgctcagactttgatgatgtgagtatacgtcatcagatgtgtaatgacacacttcattagaaggcagtttggcattatcagaacaattgaatttgtgcttacttcgtgatcctgggatctcccttttaggcctaaaccctaaatacattcttgcatatttgctcaaggagacatgtaaaattatatccataaaaacaatgtatgtaagtttaataatgtaagcaactcaaataaccatcaacaggataatggacaatttttgtacactcattcatgcaataactgacagaagtaaaaatcaatgacaagtaattttattaataagcaagtattattctgacaaatataacactgagtgaaaaaaatgtcagagaaggatatatatactatattattaaaaatatatattgttggccaggcgtggtggctcactcctataatcccagcactttgggaggccgagggggatggatcacgaggcaggaagatagagaccatcctggctgacactgtgaaaccctgtctccctaaaaatacaaaaaattagccaggcgtggtggtgggcacctgtagtcccagttactcgggaggctgaggcaggagaatggtgtgaacccagtaggtggagcttgcagtgagccgagattgcgccaccgcactccaggctgtgtgatggagcgagactccatctcaaaaaatatgtatatatatacatatatatagtttaaaattgtgaaaagtatcttaagctttcactgataagcagatctccaaagagaagtgtctgggcacgtaggcataggagcatggccaggtaggagaacactagtttttgacggcaactcacttcagagactgaaatgcactggccgtgcactaagtctgatgtagggtagacaacctctaccctcccacctgccaggaaagcaggtggtcagacctgaaaaattaattgcctgtggtcagacctgaaaaactaatcatagagtttggactaaaattgaagttctcaacgttaattttcacaaattctcagccattattttttcaaatatgtattctccctctttctctctttctgctcctccaattacaattacacatgttagaacatttgctattgtttcacagctgttggatatcctccttttgttccctaactagatttttttttctttatgtttcagcttgggtatttcccattgaataagcattaagttcactgatactttcttttgctgtgttgattatattgaggagcttagagaaggggttctttcccattatgtattttaatttctataaatttcatttaattattcttatgatttccaatggcttgctaaaataaccaattggatcatgcacactatccttctatttttgaaggttttagaattttacatgtgttaattattattttaaatttcctgcttgatagtcacatagtttcaacatttgtgtcacatctgaatctggttataataattgttctttctcttgaagatgttttttgtttgtttgtttttattttgctgtggatttttctttgcctttttaagctcccttgtaaatttttgttaaaaactgacatgttgtgtagagcaataaataatagtaaaactgaggtaataattacatgctgcaaaatcatcacaacttttcttttgcttaagcctttagttcaggaatttttaaccttgtatctagggtggttggtactttataggggcacaatttattaacataagattcagaattttaggttttactttctgctgtaactcagagacagtattgttttatgttctttcccttttggccatctcctaacagtgtgctgctgtcattgtaactcaagtaatctggtttggttgtagtgtgagggtaatggagtatctgttcttctctttaagactcagcctcaggcatgcacaatgtctctggccttgtgcatgtgtatagctttctcagttctcctttcttctactgctttaagttctgagctcagcgcctaatccttaccctcttccagatgtaagctttatctctccctcctccttgctgtccctcagctgaaatgagggttcaccaatgcatttggtctagctgctagcagcattagtcttccttctacgcattgttttttgtgtagttagaaaggtaggttcttggaggagttgtttgtcccttctatgtggccactgttcctctcctccaggtctgcaccacaatcgacacagctcagggctttttggttctgttctgtgaggtgtggtagggtttgtggagaaatgacagataagagggtacaaacttagccacatttctacagcccaaaaaagttccacaatgtctctacaatttcttactggtgtgtgattgcatctaacactgttgactgcgtgagcacctcctctttcctgcaggcagtgtctttctttagaatttggatcagttcacttggtgaccatagctttttaatgagctcacaaagtcatgaagttaattcagcttttttattgctgttgtaaaagcaggaattccttctagctttctacattctggagaggaacctagatgtgcaatagtaaattttaggtcaataaaagttattgtgtttctgtgaatgtgtaggattgcatattacatataatgcagatggaaattgaattcagttattagaggcattttctaaaatctttcataaaatggttaacattgtttattttcctttgggaaaaagcaattcttagtgccatttgtaggaccaattattgatttgacaggttaaataattaagggctcagaaagtgtctgaaatgcaaagctaatgcaaatcacttactgataacaatttagaaaatatcagtggttttccatcaacaattaaatagattataccgcattctgaggccactgtgaaataatttgagaaatgttaatttgatccaggatgtaatcaacgttaattggttagaaatagcaatgtaaatttaatcaataataatatttcaattttgtgattcctttccttttaatgagtacaactctgtcattagtaagtgaaaccttcggtatacaaattacaggacaatacaaattgactcaaaagagttcaaatatattgcaggataatgacatttactcaaaaaaggttcaaattcattaaccctacaactcaaatgatattaacctatgtcaggtgggtgaaaatagcaggcaggtgtcacagagaatttccttaggaagctatatagaaatcagagaacaactcatgctaagagctctctttcatattctcaattactttaaaatattttacctattttcaaagaaccccggtaaacacagtaagcacatacacatcaatttaaccaatatttaatattctatttttcatatatctcaatttgaagtactgcttttgtgttgactattaagtaattatatatagaaactgattcctttgcagaagctatgccattgctaacttcacactgtgatattaggctatatgacaagaaggatgaatcatcattctagagatcaaagaactaattaataggagaaatataggggataaaataggattcagtggattaatgccataatagaagaatgggcaatttaatttgggtatgtcttataagaattattgatctctgcctaataatgactaaagaaagaccaaggtggagaggtaaaggagtcagactctataatcctcatagtttaatagcaaatgcaagaggttaaggaaggcccttgactcagatttggggagcataaattaaattaccccacatttggggtaatatttctttaaaacaaatagcaattcagccacatgaaatattcatggaggtattccatatgtaataaaacataacagccccaagtgagttatggttttgacataaaaacggggtgtcagtctaagatttgtctgctactagcccagaccatgtacccaccttagaaattctctgctacccattacatttttttcaataattttttctttgtatttcttcaacacgtattgtttaatgctttgatactcttcacaaatatactcatctggctaaaaatacatattgttatgtaattatttaatagtgggtaagtgtttgattaacactattgtgggaggcagaataataatctcaagaaagatggccatgtcttaatccctggaaactgtgactacattaagttacatgacaaaggagaattaatgtagcaaatgaaaataaggcagctactaaaataaccttaaatcaaggagattatcctgaattattcaggtaggaccagtgtaaacactaaggcccttagtgagaaagtgtgagacaaaaaaagtcagagtaagacaaggagatgcgatgatgggaaacaaggtcagaaggaaaacaacttctgggtttgaagatgaacatgagggccatgagcctcagcttatagactttgtaaaagacagtggaatagattctcccccaagagcatcccgaaagaaacgcagcactgcagataccttgattttagcctagtgagacccatctttgatgctaaaatacagaactgtaagataataaatttgtggtgttttaagctattaggtttttggtaattagatttcaagcacaaaactgatacaaacaattttaaaaatgaatacaactgctcaacatatttaagacataaaataacataatctcattttaaaacaaactttcctggtggggtaccatgacatggaaatgttcattgagtatggaagtatctcgtaagaatagaagtcaacaaaagccacataactgagagacaaaatagttgactacatgatagacaaaactgtctgattcccaggatctttggcagtatttaattaatcatgggatccttgggacaaaaataaacaaaaatctataatgtcatgcttaattttcgtagtatgaacaccccaattccgatatgttgacttgatctctaaagaatagggcttgatttgatccctgtagaataaataatttaatacccgtacttggcttattttatatccccagagtcctttgaataaagtgaagcctggatgatcttaaataaatgtaattcaatacttactatgcatttgtccatttagcattccccatacagactagttactaattaccaaggtaatggtggactaaaaaaagaaagctatccataccttgcaggaattactcaacaatagccctgagctacaactttttcatgaagacagtatttaacattgactaccttacagagtatcagttttaaggatcaggtggtacagtttttaatccagacatgcttgtatatggattctaacatctgtctacgatttttcctgtttttcagtggatagtggaaatatatatcctttgcattgaaagaaattccacatttttcccttgaaaatattataagaaccatcaaacagtagtcattagagcttggctaacaaaataataaatgaaatgaatgctatattcctcaggatacttccaatagtaacctcatcacaaaagccttgaaagatgcatgagtgaaaccactgtcattctcttgttggacaatgccatggataggtgggtccagtagaacagcaaaggattactatgcactgcaccaaatgtaatcttcttgttagaataaataaatacagaccctagcccctgttgtgcacatattattctaccagatgctgtttatatgcatatatgtaaaaagaaacacacatacacatctccatcactaaggcctacagtttctttgtacccaatattcttggaatatcaatagcatatttgtataatgtcttaatcttgtcccatttcttagtgagagtcatagtagtggctcctaggatattgtgaacattgcaattccttcctcaggaagtaaaattttcttttgagaagaaactacaattatgctctttgtaatgataaaaactaactgcctggctgttagacacaataaaacctatgttaccctttattaacttatctctgtccatatacttgggcatgctcatcaaaatttcaccatctaaaataagtgatatttctcgggctagatttactcatgtcctgaaagcctacataagtctcattagcatgccatcctccttcctagtatatctcctgctgctgcattacatgccctctcttaaaccagatgtatagccccatggacttttttttattagtagtagccgagaaaaatgtatgtggatattagatgacggtgagcattttgctattgctgaccaaaatcaaaatacttgagcctaatagtcccagtaaggggagacatggaaagaaaataatcatctaagattttttcccaaatgaccacattgacatctacttttagtaatagagatgtaggaaattatgggttgtgaatatagagagcaaggagaattggttttctaagtcaattgcaaagtaattttcttagatgaaggagttatagcatcctgagataaggcagcatgctgtttctaagttcaagaaatgctcagtgagacttgctgttttgcatggaattagttttttatatttattaatttattatgggtctttgaatctctctttcctatacaattcccaaacttttacatataaggtctgtagaaaatatgaatttatgatattttaattcagtgatcagaatgaaaaactttgagttttactgtcagctacttcattcctgttgctctggaggtaaatagtatttttctatatgtttagaaattgttatacttgagtccatgctttcaaccagtaaattggcatttgagcttgtgacacttttaaaagccagttcagaaatcttagaaggagccaccttatcatgcatcaaaatatataattggcatagaagaaaaataagcaaaaaatacatactttaggaaacataaacaacatatgtaaatgctgagaggtagagcaaggtggcagaatagaaactccactgattgtcccccatcccctggaaggacaccaagttaacaaatatctatacagataaaacactttcataagaactaaaaatcaggtacctgcacagccatgggagatagttggggagtggggaaaagaatcaagtgggctcttctggttctagattctaggacttgactcttggacagcattcctagacctgctctgggccagaggggagcccactgccctgaaggatgagtctcaggccaggcagcattcatcacagctgacttaagagcccttgggccttaagacaacattggtgcgtagtctggcagtactcttcatggcctggggtggcagtggctaaaggatgaggctcctctgcctttgaaaatgggaaggaagagtgaaaaggactacatcttgtggcttgaatgtcagctcagtcacaatacaatagaacaccagatagacttctaaggtttttgactctagacctgactcccagacagcaattctgtagtcacctggggcttgagggaactcattgccctgaaggaatgtctccaggcctagctgactttgacagctgctgactgtagagccccacgaccttgagaaaacataggcgttagccgggtagtggttacagcaagccttgggcaagacccaacactgtgcttgcttcaggtgtgaccccagagcagtcacagtggaggtggctacgggggcttttgtgtaattccacccccagctttaggtggctcggaacagagcaagagagactctgtatgtttgggagaaagaaagggaagagaacaagagtatctgcctggtaatccagataattcttctgaatcttgtccatggccatcaaactggtacgaacacaagtccacaagaaccacagtattactaggcgtggggtgccccctaaagtagatatagcttagatcacaatacccgagtctgttcatacatatgcagtcttcacaagaagagcagctacaaataataccagacagcaaagtctacaacagatacctaactcttcaatgcctcaaacctgaaaaacatatactagcatcaacattctcctggaaaatacgacctcaccaaatgaactaaataagccactgaggattaatcctagagaaacagaggtatatgatcttgcagacagacaattcaaaatggctttgttgaagaaactcaaagaaattcaaaataacacagagaagaaattcagaattctatcagataaatttaacaaagagattgaaataattaaaaagtatcaagcataaattctggagctgaaaaatacgaatgcattggagtcctttaatagcagaatttatcaagcagaagaaagatgtagtgagctggaaggcaggctattttaaaatacacagtcagaggaaacaaaagaaaaaacagtaaagcaaacctacagaatctagaaaatagcctcaaaagggaaaatctaagagttattggccttaaagaggacacaaagagttagaagtacaaaatttatacaaagagataatacatgagaacatctcaaacctgtagaaagatatcaatatccatgtatgaaaaggttatagaacaccaagaagatttaactcaaagaagactacctcatgacatttaatagtcaaactctcaaaggtcaaagatagagaaaggatcctaaaagcagcaacaaaaaagaaaaaaataacatataatggaactccagtacatttggcaagatactcttcagtggaaactgtgtaggccaggagagagtggaattacatatttaaagtgcagaaggaaaaaaaaatacccaaaaaaataccctcggatatccagggaaagtatcctttaaaaatgagaaagaagtaaagttttttccagacaaacaaaaactgagaaattttatcaacaccagacctgtcctacaaaaaacgctaaaagttgcacttcaaatagaaagaaaaggacattgatgtgtaataaataattatctgaagatacaaaactcactggtaatactaagtacacagtaaaacacaaaatattatataaaactgtaactctggagtgtaaactacttttatcctaagtagaaagactaaacaatgaaccaatcaaaataataaatacaacaaaatttcaagacatagtcagtacaataagatataaaaagaagcaacaaaaattaaaaacaggcagacaaatttaaggcatagagtttttattagttttctttttgcttgtttgtctatttgtttatgtaaataaagttatattgttatcaggtaaaaataatggtttataagatagtatttacaatcctcatggtaacttcaaacataagacatacaatggacacacagaaaataaaaagcaagaaactaaatcatattaccagaaaaaaaaggaaaaaaaacatctgcactagaggaagataggaagggaacaaagaaggaagagaaaatcacaaaacaatctgaaaacaagtaacaaaatgacagcagtaagttattgctcatcaataacaacagtgaacacaaatggactaaactctccaatcaaaagacatacattggctaaatggataaaaacaacagacctattgatctgttttctacaagtaacacacttcacttgtaaagacacacgtaggctgaaaataaagggatgaaaaaagatatttcatgtacatagaaaccaaaaatgatcagaagttgccatactaatattagtcaaaacagttttcaagacaaaaatcaccaaaaatggcaaagaaggtcactatataatgataaagggtcaactcaccaagaggatataacattttgaatatatatgcatctaacactggagcacccagatttataaaggaaatattattacagctaaaaagagagataggccgtaatacaaaaatagctggagactgcaccccactttcagcattgggcagatattccagacaacaaaatcaccaaagaaatagtggatgtaatctgcactctagaccaaatgaatctaatagatatttatagagcatttcatccaatggcagcaaaatgcaatcattttcctcagtacgttgattattctttaaagatagaacacatgctaggtcacaaaacaagtcttaaaccattaagaaaaatggaaataatatcaagcatcttctctgacaacaacgcaataaaactagaaattaataacaagaggaattttgaaaactatacagatacatggaaattaaacagtatctacctcaatgaccagtggatcaatgaagaaattaaaaagaaaattgaaaaatatcttgaaacaaatgataatggaagcataacataccaaaacttatggggtacagaaaaagcagtactaagagggcaattgtatagctatacttgctgcatcaaaaaagaggaaaacctttaaatgaacgatctaaagatgtattataaagaactggagaaccaagagcaaaccaaacccatcattaatgttaaatagaagaaaaaaactaagatcagaagacatcaaaaagaagatcagaatagaaataagtcaatttgaaatgaaaaaatataatgatcaattaaacaaaaagttggtttctggaaaagttagataaaattcacaaacctttaatcatactaagaaaaaaacataagatccaaataaacaaaatcgaaaatgaaaacggggtcattacaactgatattgcagaaattcaaaggatcattagtggccactatatgcaactatatgctgataaattggaaaatctagaaaacaaatggacaaatacctagacacataaaacctacacagattgaaccaggaagaaatccaacaactcaacagaccaataacaagtgatgacattgaagccataataaaaagtctcccagtaaagaaaagctcaatacttgatagcttccctgctgaattctaccaaatgtttaaagaattgatactacttctatttaaactattccaaaaaaatagaggaagaaggaatgcttccagactaattctacatggccggcattaccctgatacccaactagacaaacatgcatcaaaacaagaaaactataggtaaatatctctgatatacacttatgcaaaaattctcaataaaatactagcaaaccaaattctacaatacattagaaagattattcattatgactaagtaggatttatccccgaggtgcaagaatggttcaatatttgttaatcaattaatttgatacatcatattaacaacatgtaaaataaccatataatcatttcaattgatgctgaagaagcatttgataaaattcaacattctttcatgattaaaaaaattccaaaattcatgcagaaagaatatatctcaatatattaaaacccatagatgacagagctacagttactatcatactgtatggggaaaaactgaaagcctttcctctgagatctggaacatgacaaggatgcccaccgtcaccactgttactcaacacagtactgcaagttgtagatagagcaatcaaaaaagagaaagatataatgggcatctgaattggaaaggaagaagtcaaattatttttgtttgcagataatatgattctgtatttggaaaaatgtaaagagtccatcacaagaaaactattagaattgataaattcagtaaagttgcaggagacaaaatcagcatacaaaaatcagcagcatttctatatgccaacagtgagcaatttgaaaaagaaatttcaaaattggtcccatttacaatagccacacataaaatcaacttcctaggaaataacccaaataagtcaaagatttctataataaaaactataagacatcaatgaaagaaatcacctaaaaatgaaaaattatttcacgttcatggattggaagaatcaatattcttaaaatgtccatactaccccaaacactttacagatttaatgccatccctatcaaaatgctcatgatgttcctcacaaaaatatttttgaaatcctaaaatttatatggaaccacaaaagactcagaatacccaaaactatcctaaacaaaatgaacaaaactggaggaatcattttacctgactgcaaattatactacagagctatagtaacccaaacatcatgatactggcatgaaaacagacccacagactaatggaacagaatagagtacccagaaacaaatctacacacctacagtaatattggttttgacaaagctaacaagaatatacagtggggaaaaaagacagcctctttaataaatagtgctgggaaaactggatatccatatgcagaagaatgaaactagacccctgtctctcgctatatacaaaaatcaaatcaaaatgaattaaagacttgaagacctcaagctatgaaactactgcaagaaaccatttggaagtctccagaacatttgtttgggcaaaattttctttagcaattttgccacaagcacaagcaaccaaagcaaaaatggacatatgggatcacatgaagtaaacaacttctgcatatcacaggacacaatcaacaacatgaagagaaaacccagagaatgggttcaaaatttttgcaaactatctatctgacaagtaattagtaaccagaatattcaagggctcaaacaactttatagaaaaaaaatctaataatctgataaaaaagggtgaaatatttgaatagacattcctcaaaagaagatctacaaatggcaagcacgcatatgaaaaggtgctcaacatcattgagatcagagaaatgcaaatcaaaactacaatgagagatcaactcacccaattaaaatggcttatacccaaaagacaggaagtaataagtgctggcgaggctatgaagacaagggaattgttctatactgtcggtgagaaagtaaattagaacaatcactatggagaacagtttaggcattccaaaaagaaaaaaaaaagaaacaaaaaatgaaactaaaatttgagctaccataggatccagcaatctcactgctggttatagacccaaaagaaaggtaatcagtgtattgaagagatatctgcactcctaggtttgttgcagctgtgtttacaatagctaagatttggaacataactgtctatcaggagatgaatgaataaagaaaatgtggtacatatacacaatggaaaactactcagtgataaagaatgagattcagtcatttgcaacaacatggatgcaactgaagattattatgttaaataaaataagccaggcacagaaagacaaaaattccatgttctcacttatttgtgggatctaaaaatcaaaacaatttaacttatggacatggaaaatagaagtatggtcaccagaatctgggaagagtggtgtgagggttagggaatgtggtgttggttaatgggtacaaaataatagaaagaatgaataagacttactatttcgtagcacaacagggtgactatagtcaatgataacttaattgtatattttaaaataaattaaatagtataattgtttgtaattcaaaggagaaatgcttgaggtgatgggatacctcattctccattgtgtgcttattacacattgtatgcttgtatcagaacatctcatgtacctcataaatatatatacctactaagtacctacaaaaataaaaaaataaaatataagaaagaatcttcccaaaaatatgtaaatgccaataaacatgtgaaaatgcttaatttcattagtaatcataaacatccaaattaaaacttatacaatattttaaaagtctcacattacaagaagttagaagtatgttatatccagcctccaagacggttcttggtgagccttgcttcctggaattaatactttagtttaatgccctctgaattgcatcatgctagcctgtatatcaatataatacagcagaagtaatttatgccctttgagactaggttttaagtgacatttcagtttctgctttgctttctgggattgttcagtctggggaaagccagctgcctgtcctgccattcatgaggacactgaagaggcccatgtggacaggaacttggccaccaagttaacagccaccaccaatttgcctgccattggcaaatgcactgcttgccatttttcatttttcatcttccatgtgaattaatcaactttgaagcagatcttctaaaccctgtgaggctttcatatgactatagtgccaggtgatgtttgcttgtgacttaatgagcaactctgagccagaactggccagatgagaagctccttaattcctgacccacagaaaatgtgagggatgataaatcactatggttgttttaagtcaccaagttttagagaaatttttctctagtaatatgtgaaacaataaccacttttacatatctgctttgaaagtataaattggtaaagatactttagaaaaacctgctattatttagtaaagttgaaaatatgcataccatattgcttagcaaattcacttattctcacatactacagtttcatgtgaaaaaaaaatctgcaccagccttggttataacagcaaaatcagttataattcaaatgtctaataacaatagaaaaattgaaaaaacaaaatgatatataattttataatagatactacatatcaatatgactctacctatcattaaaaataagcaatgcacacctgaaataaaatttccagacctcaggaagatataatatagttttattttatgtatctctcagaaagagtgacaatggactatattgtttaggattgcacacataagttgcaaaaatgtaaaggaaagtgagaaaatgattctgtaagagtacatgatgatgataataataataatagctacatttctttgtcaagaaatacacaaggaggaaaaaggaatttatcgttgagaagatgtgtggtaggggtggggttgtatctgttgtcgtgacaattttctatctgttgaatttgtttgtggttacatagatacatggatgtttattttatacttgtttactaaattatatgtgtctattctatgcacgtttttatattatgttttacaatataaatttacttaataaacaccatatagcacttacaatgaactaaaaaatattctgaaaagttttatgattattaagctttaattttcatagcattaatttgtactataaaaaagtacttttattagcctagtttacagattatgaaactgagacacaatttatcaaaagtcataaagtctttcagtggcagtttggctccatagcctgtgtacttaggaactagactattatgtgtgttttattctttgttattatttagctagttggtaggtttttggtgcttggtatggtctaaacagagaagagaggaaagggacattcttttgtgtgtgtgagaactgaactgtgtcattcaatcctcctatgcttcagtggcaaaatgaaaggtttggacaaaataagtaatttcaaaattccactatgttgagggtcatggaaggctgtaaggaaggcagaaaaagatgtaaatgcatggtagtacacaagtttaatagaagtaccacctttgtctgtttcatagacgatactgttttgtaaaataatgaatgaacaaagtccattaaactttgaaatattagaaaatgcaggcatttctaaacgatacacagtgacaaagttactgtttcactgctgcctggatagcttccctaaaacgtctatccacatgcattttgccaccagtcatctttaggtcctgataacttctgatacaattcttatttttatcttaataagatacatctagatactgaccttgtctctacaatttgagggcaaatatctttaaaggggcaagatcaccataacacagagtaatttttatgccaaaatgtaacaaggagtagaattataatatgtctccaagtaagtttcagaacgtttgaaaaacccaagaaataacagcacatataaaaatataaacacaaatagaattttatttgtttaggagaaacaaagcctttttgtttataagcaatattttaatgcatggccaattcaggggaaagtaaaattatgacttgataaaataactcacagtcttaatacaagccaactgcactgaaggctttatgttttacatagatttaattgtaaaataaataaaaaatattcaacccctatcaccgctaaaccaagaacaaataaatgaaaggagattcaagtaaaaatctctgacagcatagaaaaaagtgttttctagtaaaaatggaacaatagatacacgaataaaatcatttttgtgtttttaaaatgtagagagatatggaatccagagactttccaataattgacaattaaatatatatattatatatataaatatatacatatataaaatatctataaatatatatacatatatatgcttatttaaacccttattattgccatattcacagttctttgtacagctgaattttttttttttttttgagatggagtctcactctgtcgcccaggctggagtgcagtggcacaatctcggctcactgcaagctccacctcccaggttcaagcaattctcctgtctcagcctcctgagttgctgggattacaggctcccaccaccatgcccggctaattttttgtatttttagttcagatggggcttcactatgttggccaggctgcagctgaaaattttttaatccaactagagacaagactgggagactgaaagcaaggaaagtagtaaataaaaatttttatatgtaataattaaagagagatatgatatactccctttggcattatatccactttctgaataaaggaaactatttgtagtttaaaagaggctactcttacagaaaaaattgtcaggagttcatatagcagaaatgtgcctcgaaatgtctttttattgtgaacagacctagtgattagttggttttaggtagccagcccctacgcatctatctgacccacaaatgtgtcaggaaaacaaaagtgggcttccagttggcctcaacaaaactatgggaaaacttcatcatgatatgcttttcttaaaatatcttgaacatatgtttctagaagaaagggattattgacagtcatctgccccagaatacatacagatatgggcatacatacattgcctttcatttaaatgatttgagattatttatttttataaatctgtaagttgtagatagaaaagatgaattagatatggactagagtatatattatttgaaatcaaaaatagttttctcaatgaatgtagaaattttcattaacgttattgacctgcagttttcataaatatttttccaagaaagggatgaccgataacatcactgtgtgtatgtatgttattataaatttataaaactggtgagtctgtaaatcactgtggagtggggtcactcaggtaaagtaattctacaaaacactaaaaaaaaagactttaacatcagcattcttaccaatgaaatatagtgatttctgagttttccaaataaaaataaggaaaaggtttctgtcgcagacttaatcagctgttgtcagcattttaaagtgtcctttaaaaaatcatttatttttaaattttgaatcaagcagcttttactttaacaaaatgaaaaaatattttttgtctagatgcatgcataatcacatttttattaaggttaataaattcaaagaatagattatagaattcattacttgattgaaaatgtttcatgattttagagatttctgtagacctgtatagttcaggaacttgacattaaatggtaaatagagtatttggaaatgttatttattgctcatgctgatatttgaatatcaattcctcattcctctgatatttaagagtcctaggtgtctctttatgggccacagaccaggaaaatgaagcaagatagatctgttatttacaaccttcttagtataaactctggtgaatttccccttgaatgactcatttcaattgcctaattcagtcacttattaatgtgggcaactcagtttactgagtttgtatgtgcgtcaaattcagaagacacaaatgtgatgatttcagttcttgaggtaaacactatagggtagtaaaatattcatgtaaaatattttaacagcatatgataagactaaaagagacatatgttaaaagctttatagtatcacacaggagagaaatacaaattttatgtaaaacatttaggggaaatcctcaaaagtagtctctttaaaattttaatggaagagttagattttactagaggcaaaataaaggacattccagttgggtgggataaaagtaaacaaatgcaaaaacacaagtgggaagaaataggcctgataaataaatttatagaaatttggtgtatctgtgagtcggttgtaagaattaggtctgaaaagatcagttagagtcacataataaagggccctttatatcaaaaattaataattttaacaggctattttgaaatagacattattgaaatattgcatttgttgcaataacacaacagatttacactttaagaagctaaatctggctacataaagactttgggttaacagagttaagaaacaaagcctggaagaccaagtctttagatagaatattatgagagtttatgtcagaggttgtgagggtgaaaaaagaatgtagaaacaaaatattttgcagatattgttaaatgatttggtgatggtataagaatggggaaagaaagctaaagagtgtctaattttgatcctgggtgaccagggataaggtagttgcatagtagatctgagaattgagaccgaggacatcaggatagctaaaagaagatgaattctggcttaagtagattaattttgctatgcttgtatgacttctttgtggcaaacataataagaatacaaaacttgataaaaggtaaatatattactttatcaagggacagtaaataattgagaagagatgcaatgaatctgtagttctgaggagcatcaaaatatagtgattaaaaaagaggggcaaatattatttttattcataaatactaaaatttggaagcaagcaagatgaccttcaataagtaaatggataaagtgtgatacagacacacaatgaattataattcagaaacaaaaataaatgaactatgaagctatgaaaaatacctggaagaggccaggcacagtggctcatgcctttgtgaagcctaagtgggaggatcttttgaggtcaggagctcgagaccagcctgaccaacatggtgaaaccccatctccactaaaaatacaaaaattagccagatgtggtggtgggtccctgtaatcccagctactcgggaggctgaggcaggagaatcacttgaacccaggaggcggaagttgcagtgagccgagatggcacactggactccagcctgggtgacagagtgagagactctgtctcaaaaaaaataaaaataaaaatacctgggggaaacttagatgcatatttactaagtaaaaggagccaatctgaacaggcttcatactgtaagattccaactacattacattatagaaatgcaaaactacagacacagtaaaaaatcaatggtttccagggctttaggggcaggaagagataagtaggtagagcacaggagatttttagggcaatgaaatattctgtatggactacagtgatgtgtacatgtcattacacattttttcaaactcatggaatatatgaagtagagtggcccttaatgtaaactatcaattttgtttaatgatagtgtatcaattttggttcatcacttgtaataaatataccacattacttcaagattttgataatagtacacactagggggaagggaagtcatatggaaactgtaaatttaaaacttctctaaaacataaagtcaaattaaaaaattaagggtacaaaatgatggcaaatatttaaacaactgtgagagaaaggggaaaataaaaagacacaggaaatgaaacaaaaatacatgatcaaatgaatactggtagagggaaaaatcacatggaaggcaaacactatacttgtatcaaatgggatgaaaactgaagaaaatacattttattttgctgttatgaactcactgacaaccttaacaacaattcattctgtaaagggaagattagaaactggaattctgttggctagggactgaattgaagatgaagaattaagaccactatctagagattaatttctcttctgcagtttctactttaaattcaactctggcaatgaaaactgtgtaatctttgtattctagccattccactgctcatggaccatcagggactattcattacctacacaatgaagtccaacatttttaaatatacactttgccaaccttaaatgtatgtaactctgccacaattccaggtctttcctgatattgaaacaatatttgttttttaataaatgggtgaaaggagagatatattttaagttcttctttcatatataggttcaaaatagtgcaattaaaaaattctggaccaattcaaatgccttgagaaataaaggaatgagaataaaaatttaagtagtaaccaaaggcaataatgtgttttgttaaccctattaagaaaggcacgaccttgatatgagtgtcatgagagaataaatgaaaaatcttttcaagatctgaataatttacgagtgagcatttgagggtagttatttctgcagtgcctagatagatactgaaacccaagcctgtcacatgcagaagaaatatcaaagcgagatcaagtcgttccctgggttctgaagcttaaactgatgaaacgttaacaagatctatggttatgaggccaggctggagctcagcattcttacatgttttgactacaggataactgtgcttagagggagcagcaggtcttggtaaggccagatttgcttctctcacaccaggggctatggaggtatcactatcctgcatctcccaggtcattatttactaccagtcacaaattgactctttgagccagatgacattgtctctttcaggaggacttacatatttgcattctgaatcattttgtgatgaacttacaatttacctctccaggaaaaatcgaagattaatttcaaatcattgaaagcagctctaattctgcccatactcccttcacaacacataaaaagagatctggtgagcaggggtcttttctcttgctttcaatttaaatgaacactctaccaattttaaaataatttaaatgagtatcatgcctatcgttgaatatcattactttttaaattttttaaataaattctttttatgatgattattttagctgaacctgggaatatgatttacactgtcagagcatgtataaaacatgatagttacaccttattttaaatacatgctttattttaaatgttggctattcattttaaatgcacaatacaaagaaatcaagcaaaagataaacaattgtattcatagtagtctatgttttgtttcaactttttaatccatctagtttggagctctcaattctggaatatgaagcttcatccttaactggatactgtcccagaacatcttggaacatattcttgatatgaagaagctgacactatccagataagtttcctgtacccaagaattacacaactatgcaacttttatatccttcgttcattaaattggctaatattcaccatactatttacaaaagcaaatataacacattgacattccagcttacctcaaagaaatacagatatccacaaaaatatatttatttatgtggtcttcacactagattttaaaacaaataaagaaggatttttaaagacatagattttatagaacttacaataagcagctgaattcagtatcaattttcttaatctcctcatttgatttaatgttcttgtaaacagataattgcacaaaacagtttccctttattctcctgccctaacctttactctgtcaataatgagggccagaaaaaagtgactattaaaaattctaaacacaagctccctagatataaggtaagctctacaatgcaaaaaaaatcaatctttatcaactaaataatagctcctactatttgaatctcagtgaaaagtattattaacggatggtcactatctattaaatactacagggaaaaaaaaacagcatttatttgctgagcaccgtcgtagtttttttgcttcaaactttctcccagttgttcactagtacaaactttcccctcatattttgttttcataaaaaatacattgtttgaaactaaatatgctacaacagttttatcctacgaaatgaaaagaaggacttaaaattgacaacaaaataaagagtttgcaaatacttagtaattaaagtgatactgttgactttttccttttcatagcctgtatactatctctgctaggatgttccaattatttaccatctaccacagacccttctaagtaaattgcagacattaatttatgttattctcacaacaactctaagattaagtgccattgttttctctagttttatgcatatagaaactgatgcagagagactgggtaatgggatatggtcacagaattagtcagcaatacagagagatatcaaaacaggtacatttggatacaaagttcccatgtttagccaatacgatattctaaaatttagtattgatattcattagatcaatttcatacatatagaataaaccagtaaccaggctacaaatgtatgctttgatgttatggcaaaagaaaacaacaacagctgcaataaagttttattaaaaggtgttaccaatctacattgtttctggtaaataaagataagtacccctttagttaaccagtagcaatcaagtagctgcagacactaattacccaaatgtccagaagaggcctgaagaagcctgaagtaagcgtccaatatgggtctgagtgcttaggtgatatgaaaacccagatggatttgtagaatgcagtgttcatttatacaatgtaatgtaagcactcctctagcaccctgagacttagttggagaactacagggctctgtggcctgctgtatgagcgttcagatattattttcaactcatatgcaaatattcagatttcaaatagaaagatactctcccaaggtctgaaaaatctaggaaaacctaaacaaaggaaaaattaaaaagtaacaattaagtgtaaatgccaaaatatttgtgcttaacagttaaaaaatgtgagcaactattaaacattaaagaaaattgaaaatttaaaacagaaaaaattgataaataattcataattatatatatatatgaattattttttgtttgtgaacatatgcttataaaccaacatcaggtaaacagagaaacaatcaaagaagaggagagctcaggaaggggaggtagtttgggagtggggagcagggaaacacagtggtgccactgggaaaacttcaaatgaaggagaggggcacatagcagcaaaggactgtgaaaattcacagatcaggccaagcttatccaccatgatcaagtgggcttcatctctgggatgcaaggctggttcaatatatgcaaatcaataaatgtaatccagcatataaacagagccaaagacaaaaatgaaaattagtaaaataaaatattagtaacaaaatttcctcattttatcttatttttacttcatctttgattctttatttcatgttttatttttgtatttacttttacacatttgtataatttataatgttctaattacttataaataattttcttttaaaaaagtttcattttggaaacaacttccaattaaacctatatttcacttttagttataattaaatgggacatatttcagagtacaggctaccatgcattctcacaaattccaaagtattgccttttcggaacatgaattttatggcagattttcacaacagatggaggagacaggagggatcagggctgtgaacgtaaggctctcagggttcctgataggcaggatagaagtagagacaaaaggagtcttgcccattaaatgactgattaatgattcatggatttttaaaaattagaagatttgaagagtatgtggcaaggtcaccaaggacatggacctgaccttcccatcctactttgtaccataatggctttagcatctaggatgatggcttggaaaactttcttactgaatttttagatgacatcaaggctatagaagagacagttattacattagaaaattagactaaccttatttttaaagaccttgataatcctgtgatatgaggagaaacatagacaaaatttaatagaggtaaacacagattcttgtgtttttaaaatagttgtgaaatggagaccaaaaaaggtatattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaactccattgtctcagcccaaaatctccttaagctgataagcaacttcagcaaagtctcaggatacaaaatcaatgtacaaaaatcacaagcattcttatacaccaacaacagacaaacaaagagccaaattatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactgttaccaaaacagagatatagatcaatggaacagaacagagccctcagaaataacgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaaggtggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtgggattattcacaatagcaaagagttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggagtcgggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaacaaacaaacaaacaaacaaacaaaaaaagagtttagaaaaagaaaaaaaaaagaagaggtaatgaaacaaaatttgcctttatttgaataagtattaaccaaaatcttgttttaacttcaaaaattataaaataaaaagtgaacttaggatcaacactaaagagacattgttaaaattcattcattaatatattctttcaaataataatttaatgccttatataaacaaaatagtgggtatgcaattctgtaaagaaataatacctgtcatcaagaagcatgcaaccaatttgggtagaaccccataaaaagggctaattacaacatacaattaaaaatgcattgacaggtataattacagattctcaggaatttgtgaagtagaagaacatgttaatgaagatgcagaaaaattattttaaatgaaatttcatttaaaaaactttgagaaaagaattttgatgtggggaggaaaatacaggaaaaaatttaaaattgcgaaattagcttactaaaaaaattggcagtatagtcagtgattaaataaagatggaatattaagtagaggcaagatattaaaagatcttttaatataggtttaaaatttagatcaaactatttaaaaatctataaaattacaagttttgcatatgcgtatagaagattttattggtgattttgtttgcaggtcagtaacccagtactcttgtccccgtctatgttctctcttgctttgcaggaactgaactttgaatacctcttcccaaatcttttgtgtgcaaaagtcattttttgctaaatttggtagatggaagaacatatgaagtcacattacagctcatccagcagtagggagcagaactgggggctttgagaaaagttatgttttgtaacatctcttgggcatttaattgcactcactcacttttatgtccccagaaaggtatgatcactctgtgtattatcttgtgctcctaaaacttctctgaattaggcaagttatataaaaccctatatctagcaaaatattttcccaatatttttcctccagccgttgcaaacattttgttaagcactacattaaacactaaatttgattaagcaactttctattgaaatgcctacagcaatttgtagtttctattatcctgaacaaaaaccctgaccaatacgatatatggcatggacaaattgaatttaagcaagatatttcaaaaggtggggtgagaagacattagaatgtgttaagattggaatcaacgagataaaaatttaattaagatataatagtgaacagagaaaaaatacagtttttattttgtttttaagagacataaagcagtgtcaaagcttactcatgtatctaactgagatagctgaatgaatggatattacatttgctgaaactgtaaaacccagaagaaactagcgttttggtgggaagaaagtaaggggacagaaggaagttaatgttatccttgggacaaccaaatgcaatggtgggggttgggggtaattggaatctaaagctcaagataaaatcctgggcaacaagtaagaaaaaaaaatcatacatatttaagtttaagagagaccatgagcataaatgaaataacaaaagtatgcagagcaagtataaaagtgaaatcagaatttgggagaatgccaacaaaagaaagaagagtttaccaaataatcttaaataaaattgaaaaataaaaaaaaatcaggcaaatatgctttcatagaaaataagggaataaacaatttaaaagaagaggcaattcacaaagtatagaatcatattaagagatcaggtaaatgatggaatactatgcagccataaaaatgatgagttcatgtcctttgtagggacatggatgaaactggaaaccatcattctcagcaaactatcgcaaggacaaaaaaccagacactgcatgttctcactcacaggtgggagttgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaattaaaaaaaaagagatcaggtaaatgaagcattctccattgaatacttaatgtcaagaggttagtagtatacatgtttagaaaaatttcagagacttcatgtaaacacaggacagatttctgtggggttgagagtgcctaaaaggtaaagtggaagcagtgagtatgtaaaatactttaaagaagtttagcaatgaaccagaagggaaagaggcaagaaatgaagggggatactggattgatgaactagttgttgtttatatttcacatttttaattacaaaattaatattcatagaaatgtcagaaaatattcatgtaaaataattgataaatcatacttgatatatatgaagacatacaaaaatactttttaatattaatcaatatttatgtataaaatgtttttaattgtggtatagtaagcctttatatgagaatggaatcatttagttactcaaagttctgtttatagagacttataaatttttgacattttttcatttgatatgtatcactggttgttcgctttgctttgaaggagaaatggccaaacaggtgatgaggtactaattcactgtctgtggccagtggttggctggatggctagtgatttggaaggaacattattcaaaaactggtaacaaggaaatatggggaagaggggcagataaacctctatgaatatacaaaagtaaaaaaaaaatgaagttatttatgtcccttgtgaatgcttttcaaaagttgacctctgcaggagaggattttaataataaactgaatagcatcattcattcggtgtatatcatttagctttcttcctcaaccaaccctgtcatccataatgggttcatgaaaaatgtagccatgttggcagataggaaggttacacaggcgtccagcaacgtggacttccatacgcataggctgacctggaaataaccacagctgagtgcatcatctgccagcagcaaaagccaaattcgagtctctgatggcacaccattcctttgggtgattaccgtgaaaggatgattgcttccgccatggaaaggacagcattttgttcttactggcaaaaacgctttgcatatggatttgccttctctgcacacaatgcttctgccaaaaactaccatctgtggacttacagaatgccacatctaccatctttgtatttcacacagcaaggaactcactacacagcaaatgaagtgtggcaaagagcccatgctcatggaattcactggccttaccatgtagtccactgttctgaaacaactggctcaacagaacagtgcaaaggctggccttttgaatatttagttacaatgccaatgaggtggcaataacatgcagggcaagggcaagagtccccacaaggttgtatatgctcagaatcagcatccgatacatggttttgtttctcctgtagccaggactcacaggttcaagaatcaaagtgtgcaaagggaattggcaccactcactcttatccctggtgactcactagaaaaatgtttgatttctgttcctgcgcctttatggtctactgaccaagagatcttatttccaaagtaaagaatgcttccatcaggagacgcaacagtgcttctattgatatgaaggttaatagtactgcccgtctactcagggctccttatgcctctgaatcaccaggcaaaaaaggaagttactgtgctggctgaggtcagtgatcctgaataacaaggagaaactgaacaacgactccacagtacaggtgaggaagattatatttggaatacagagaatttcttagagggtatcttagttttactatgctctattattaagtaccacgtgcctagaattgcattcattcatggataacaccatatttgattctttttcaccaacttgctattggatatcttcagtcttaacatttttcttttctccttttatattatataatggacatttgcatctatattccatatgttttcaccatcactgatgcatccagtctattggaacaatatacagatgctccttgatttacaatggggttacattctaataagccaattggaaatagtgtctatcatagtcaaaaatgcattcactatgcctgacctactgaggcaacatagcttagccttgcctaacttatgcattctgagaacattttcattagaatacagttgtacacagtcatctcacacagggactattttataacaaagtgttggatatcttatggaatttactgaatactgtactaaaaatgagaaacagattgggtatatgagcaccatcgtaaagtaaaaaaatatgtaacttggaccatcgtaagttaggaactgtctgtatttcatcttgtttacaaactgttagatccaattgacggtttagtccaactgttagatccaattgatggtttagtcctcttctccttagcattttagaccacttacacatactttatgtcctcagaaattctttatcacttttattacataatttttcctggttctaatcctaccttaacctacagcttttaataatccagataaatttattgtttaaatacatattacctgaatggcactgattttatctgctaagtgcttacttggagtctcaatctacaaaatcaaagtttcttaaagaatctgcttctcaaacaatttttagaaataactttataatatgtcttacctgccccaataaatattcagtggatatgggagtaagtaaaactacaattttgaggctactgtatctgatatttacaccgaaaaataataatgaactctcatttgctatagccagaattatcaacacacctatcgaagactactcagacttccgtcattgcctaaataaaatactggttattttagctatctcttttaatattggaacgagaacaatctttattcttgcttaccataccaagtagtttgatttttggttctaatcctaccctaaactacaggtctgaggctttcggtttgttcatccttatataatttttttaacctgggtacatacatttgccaaggtaagatgagagaagataggtgaatgtggttgctcccacactataagttagaaccaccagtctttttggatcttgaatcctgtttccatgtctaaataacattgataagttctttttttatgtgataacatttgtcataagagttttattaaccttccctgccagctggctaattcagttgtggtgtgctccccttcctgaaacgtatctgacatttctgtaaataccttcatttatacagaaaacgggattatgctagcagcaacagtgatcactgtttacatatcggtattttgaaaacacgtaaatggacttactagtgacttatttaatataactgtgacttctactggaaacaaactttctaaaagtcaagcataaaggagaaaagacaatatatttatttacataaaagtagaaatattgtttagaatttttttttcagaactcaaaggcaaacagtgaattgggaatgaacgtctggaaatcagaaagaagatagtaaacatatttaagtacttcacataaatttaaaatacaaataaaaataattttgtgataattaattaataatgaagaaatagtttatatcactaacatccaaagctatgcaaattaaaagagcgattttactgaaagataaaatctcaataatatagcaatattagtttctttgtgtgtgtatgtatgtcttttataatttctaatttctggaaagaaattagcaatattgcacagcgctgctgggtgtacaaaaagaacttacagtttgagagggtaatttagtataatatgataaacacttttcagtagtttctaggaaaataattgacaacctgtcctcaaatttatttaagaatatacctataattcccaggtttataattctgaagcatctaaaaatgaaaaaaatttctaataaaaagtgtttgattaaataaattataggtataattatagaatatatttgaaaataagttctaaagaatggttaaaattataaaatggtgagatgttttaaaaatctcctaaagagctctaagacactttttcatgtttgaaagatagaaacattttaaatacaaaaagtttaaacataaaaatgttaacaaaagctatcagaaactagaatttcattatgttctctatgtgtatagacagatgatatatatatatttatacctgcatgcatagttacagagatagatataatgtgtgcatactcattaaaataaaaactaatttgaaaaattgattaactagataagttaactaaaatatagggtgcttttctagaaaactcaggtcaaaattttagccagtgtcttacacacacttgagtaactgcccctataaatgcatacatacatacatacatacatatatacatatataaaggaatacataaagcttttaaaaccttgaatagttcaaagaaaggataaaaatcttctctctgtgattgagaattgatatggatcttagaaattattcacagacgttctcacaactatttccttatgcttatttaaaggaaaggtcacgtaaaatacaatcattttatttttctctttcagattccttctagagtcactctgattgcattaatatgctaatattaatgactggccaatattctctatagtttgttgagctttattccccaagaatattatggcctgcgaattgcagtaatttcagcaactgtgaacatcccacggagaatatgaactggaacattttttagatcagcataaagcgtggaaaataaacaccactcagaggatttcctctcaggtattcatcatctggttccaagcatgagtcagttcaattttccctccatgctcaggaggtcaccactgtggaaggaagctctaccttgcttcccatcccattactcccttcactctcatctgtagtttaagggactgatagaatacagtagcatattatttgagcctaaagcacaatgatctatctgccttcagaaaattcactactcacctgctctaactttccattcaagaaagaagagaattaaacattgcaatgaatttgtgattatgctatgttaaaatgcggacctggcttagggaaatgaccagagaaaattagcagacggcttttaaatactagcctttagaaactatgagggttgaagagaagtgccttcttgaatagccacttaattttgtttatgttccttctctccaaggtcaattttgtatgtatgcacaaaagactgctgcctgcgatgtgaatcaagaaaggacaggaaaaaaattctacttttaatatttttagtttgtagactttcagaaaaatttacatccactttattagtgtgaaaaatactgttaattattaaaattcaaatataatgtaaagaattattagctcattaaactataaattaaagtatcagaattcaagtaagctaaccaggtatcctagaaaaacctaaagaaatacaaatccaacaaaatgatttagactgtggggaaggaatcaggatatttcagctaacctaagagttttctataccataatgtctgcgtgtgtgtgtgtgtgtgtgtgtgtgtgtgtgtgtgcgcgcgcatgtgtgtgtgtatctgaaaatagaaaaatgaagcagagaactcatagaacacagtattcttaatactgtacagttgctcctattcactatttcttctcctctgagtcattattccatttccttttctcctgattttcttgactctactctttatatttctgcttcattctttggaattccctacagtctttaataactttatctctaaatgttttctccaaatgtttacaacatcttcaccttttgtttaaggtacaatttcttttcaaacactctcagtggaagctaattcattctccagtactcatatcataatctctgaaaatgtgatcagcatcctgtttaggttcatacccactttcttctccctttcattagaaaagaaacatatattagggttcggcaactgtactagctatagggatttcctgaaaaaaaaggcagtatgatttttacctccagagcatttatagtttgcaaaaatgttcattataaaagtcataacaataaagtataattaaagctattagagagaaaagatagacatcattaaaaacagagcaaaaactttattttaataattaaggaaaaaaatgccctttggatgtaatttttaacttacatgtacaaaagaggagcagtagctaccagtaggcacttttgttctagaagagaaaaaggaagagtgtgtcataatggaaataagatgcattgtatttgggaagcactggaaatatttattatagctaatgcatagtaagcatatggtaaaggagaagaagctaaggctagataagtctacaaaacagatcttgtagaaccttgcttattgtgtttaagggttgaattccattgtaaggaaaacaagaagtgaatgaaccattaaaaggagatgtgctaatatatttgcattactggaagtccactctgattgctttgattatagtcacgtgccacataaagacattttggtgatgaaagattacatgtaacacagtggtcccataaaactacaatgaagatgaaaattttctattgcttagctatgttgtagacatcataatagtgcaatttttatttttataataaatttaggatagcacaggtgtacagcatttataaagtctagagtagtgtacagtaatgttctaggtccccagattcactcactactcacgcactgagtcagcaagagcaacctctagtgctgaaacctccattcatggtaagtgccctatagaggtgtaccatttttatcctttataccacgtttgtactgtatttttctatgtttagataagtttagatatacaatggtaaaaaactgccatattgcctgtgctattcagtacatagtatacatgtttatagcccaagtgtagtaggctctacataaaacctaggaatgtagtaggctatatcatccaggtttgtgtaagtatactctatgatgcttgaagcataattacatttcctaatgatgtgtttgacttacacaaacctcaattgtatagcatgtatccccgttcttaagtgatatggctgtagtttgaaagtgagttagcttaaagattcaactaaggtaattttctttaaaaaagttgtagcccagatgaatatattttcggtgaaaacggcaaaattagattgaatttagaagtatttatgacatagcattaaaactgcttagtggtttattggattaagagacatagtagatttaataaaagctaaaagtttagacaactgtttaagaaacttttactctatgcatggagatagagtggctcctggcaggagtaataaaagagaggattatgcatttaaagttgaattaattattgaagtattttaatactgattcaataaagttattaaaattagaggatgagatgaagatacaaacgagaaagatacatttggattcaggttccttgaagagttaaaaaggcatgaactccagggtgtaggtgaaaaaagagaccctaatcaaagaaacagctcttctattggtataaagaatacaggaggaaagcatgttgtacatgctggtaacttagttgcaaagaagttaaaggtgttctctcctgatggctgtcattattttctgtgaaataggaggcaggaccatcttctaagatgtgggaattaagggtcttaagtttaaaaagggtagtgaatatgtagtcattgtggtaaacgaaaaaaaaaattgacttttgacatatttataaatagattatgcaattttaaggactttttttttagtgactatgagtgtgacacagcaagagtatgtccagtagctaatatttctggtggctttacattgaatgaaatgactcctagactggcagccattttctatggaaggtgaaaggggaatgtagatgagcagaaaaaatctctaatatttttctaattactcttaatatggaaaaaagaagactgagtgagagagtgtgtagccaacatgggaaaaatataatgtaaaactcctgaggataaacaactcaatttattatccctctccatcgcaggatttagcagaggaaggaaaaacaaaatttgtcaatgtcaaaaacaaattatttgaaacctggtgtccccagaatagaatagaccactcattctcaggatgtatgctcatgcaggtgattaaaaaaaaagtttttgaagaaatagcagagttcagatttcaagaaaaatattggacatagatgtatcagaagtctctttgtacccctgactggttatcctaggctactaaaatgagagggaattcaaaccaaagatttcaaaatctcactcaaaaaagaacaagtataatggtcagatttggtgcaatgggagacaagaatgtactcacacttgattaaagccaagagaaggtttgaacagagccactcaatttgaatgtaaacagcaacagcaatattaacaacagcaaataatgtaaaataggcaaatatattacaataaaaaataaaagtagaaattagagtttaagaatctgaagatactaagggaaaaattaaggggaagacacccatttcatgctttaaagaacataataaccataatgattctgtaaagtaagagcaccaagacaaggcaataatataatgaaatcagattttaaatagtgagttcacaaggacagaaaacaaaataaaaatcaaaataatacagtcacaactaatgtaaaagaaaatgatttcaaaattagagaaattaaagaaaatgttaattgataaggaggacagagaaaagctattactctttctaatgaagaaaatgtaagtgaaaaaaaatactcagatatattccagacttctgggaaatacggctatctgaggaaatttaggtaatgacttagattgttcctaaaattaagtaaattcagttatatctgtgtataagagagacgctagaaaatttaatgacactacaatgccaagggggtaaaatgcacatttttaggtgttatttatgtatttttattctacataggtatgtattggaataattcagaaatgttaaaaaatagaattcatcagagtagctagccatggtaaccaagagtgaagtacagccatcagttaaataaatgttattgtttcttcccaacgttttctctccaatatactggagaagaaggaaagacagtatagagaagtagggaagaaaatacatcacttactttgggtttagggaacatcatgaaaggtagcccatttaaataagcatttcctcattcttaaggaaaatatactaccttaataaactagcacaagtagatttaaaatcaaaatttccaaaattttagctttctgttaaaattatttcccttgttcagatttgatgggtcaaataaggtaagagtcaaaatccctgtatcttgtctcctcactccaggaaggcattttaaacataaaatagtgaacagaaatactatattctggaatgaagtgtcatacctttagttaaactattatgtcaccacttcttacaatcctatgaactctaccccatgtttgtttccttgtatctaattataacccttaaatctggcttgatattaccctcttcttcaacactctttttgaacattctgctaaattctaattctagttattatactttgagttttcttaccatctcttccaccccgtctcagtttcacaaatggtcacaaatatctccagcctgcttaacactaacttatacttcctccacttttccaatgtgtagttcccaactttgacttactatcaaaatgctgaacctgcctcatgccttttaatatatattgaacacccaaaggtaccatatttggcccttggttcaaaatttgtcattctatcaacccaaatatcctttctattcaatgaaaaagacacttaccttatttcttcacagcagattcttacttcagtcatattctttcagtgagtttctctctttatctgagacgatgtcggcacgttctggttcataagtacatccatttcgtcccgctcaactattgtaatatagacatacatacacataatgaatacatttcttcaacacttttgattaatctgtgctatattttgttattgaaatatggttttactatgaaatatggtttctacattagaagccttacagggatgctattctcaatagcctttctttggtagtttgcaatcaccaataactcagcagtgtaaacactgatttaatgtaatactgagtgttattaatgctgatttgacttaattggatttattttttaaaagatgcaatatccatccacagcaaaattaataaatacattgtgataattcatacaatggaatactaaacagcaatgagaatggaaaaccttcaattgcagcaaaaaattatgatgaccctcacaaacttgatgtacagcaagaaaagtaagacacagaataatacatatgatacaatatgatttctttcttcctttttaaaatttagttttaattaaaaaatggcaatacatatttatgatatgcaacattatgtttttaataatttcaatatttattccagattcaaggatacatgcacaggtttgttacatggatatattgtgtgatgttgaggtttaggatatggttgatctcatcacccaagcagtgagcatagtacccaatgggtagtttttcagcccattcctccctgattcccttccccctttagtagtctattgctctcatttttatgtccatgtgtacttgtgtatgtaagtaagaacaggtagtagttggttttctgttcctgaattaatttgcttagtacaatggcctccagctgcatccatgttgccacaagggacatgatttcattctttgtatggctgtgtattattccatggcctacaggaaccacatttttcaatccaattcaccagtgatgggcatctaagttgcctttcctattgtgaatagcactgcaatgaacatacaggtgcatgtgtctttttaggagaaatattaattttcatttgggtatatgcccaagaatgggatttcccagttgaaaggtagctctgttttaagttcattaagagatctccaaactgctttccatagtggttgaactaatttatattttaaccaatagtgtataagcattctcttttctccatactcttgccagcatctgttattttttgactttttaataacagacattcttactggtgtgagaagatatctcattgtgatttggatttgtttgatggttaatgattataaaatttttttcttgtttgttgcacttgtatttttttttttttagacggagtctcactctgttgacaggctgcagtgcagtggcatgatcttggctcactgcaatctccgcctcccaggtttaagagattctcctgcctctgcctcctgagtagctgggactacaggtgtgcaccaccacacccagctgagatggggtttcaccatgttggccaggatggtctcgatctcttgacctcgtgatctgcccaccttggcctcccaaagtgctgggattacaggtgtgagccactgagcccggccatatgtcttcttttgaaaagtgtctgttcatgtcctttgctgattttcattggaattgtattttgcttattgaattgtttaattcattaattagtaaataataatgaaatggattgttaaataattctggacatcagacctttgttagatgctgtgttagttctgtctcacattgctaaaaggaaatacccaagactgggaaatttatacaacaaagaagtttaattgactcacagttatgcacagctaggaaagccttagggaacttacgatcatggcagaaggcaaaggggaaaaaggcaccttatttacaggtcagcaagaaagagaagggcaaacaggggaaatggcaggcgcttagacaaccatcagatcttgtgtgactcattcactatcatgagaatggcactggggaatgatccccatgatagagttaccttcatctgtggtcccacccgtgacacgtgggaaatgtggggattataattcaaaatgagattttggatagggaaacagccaaaccatataagatgcatgacttacaaatattttctctcattctgtagattgtttactctgttggtagtttcttttgctgtgcaggagctcttcagtctaatcagtcaatttgtcaatttttgtttttgttgcaattacttttgaggagtagccaaaaactctttgccagagctgatatcaagaagtatatctcctaggttttcttctagtatttttgtaatgtgaggtcttacatttaaatccattctgagttactttttgtttatggtgaaaggaaggggtccagttttattcttctgcatatggctaactagttatcccagctcaatttgttgaatagggaatcctttacccattgcttgttaccatcaggtttatcaaagatcaactggttgcaggtgtatcactttatcggttctctattctgtttgatttatctatgtatctgtattttaccagtgtcatactgttttggttactgtggccttatagtatagtttaaaatcagctagtattatgcctttggctttgttcttttttcttaggattgctttggctatgtgggctctttttttgttccatatgaatttctataacatgcaaaaatcagacaaacctacctatccttttaaaagatagtaaaatggctactcctgagaattatggggtagaagacaagagataattaaaacaaggcatattcagaaattctgggttgaaagttatgtggtgtcattgatttggatgctgtttagatgggcttatttagttttttaaaaaatatatatttagctatacacttttaggatttttgtcattttcgttaggtatattataattaagctttacaatgtggaaaataattatatttctggaataaaatgacatttcagtcattatctgctgggagaatatagagactgatagtagatagatagatagatagatagatagatagatagatagacagattgatagtagagagattctgttgctactaaccaataaataacttgtttgtaattaacaagtttttcctggaatttacattcatcatattttggtctgtgacccaatatttataatagcaaatatagattatattcatagaaaagtgtcctttgtaaagctatcatcagtgaggtcgacctatgaaccacagctctgaacttaataagtttcacaagctactcgtaatcttgtcctaaaatgctgacatacaaatcaacagaaatatttaaatgtgcaactgaaagcagtatttgaacaacaaagttgtaaaattaaaataataatgtataagtttaaataaattacatacacactcagtaaatattactctaaatattttgtttctgaaatagtttctttattgactttgaaataatttttctaaggatttcctcttataaataggaacatagaacacatggaatggattagttggttggcatttcagctttgttcttccattgaaaggtcaacttgaagtattttaaatattacatgtctgtgaagcccagttaaagcaacaacagttattctttaatcttttgaagaaatctactgcatacctattgtaatccatactcactaccaaccttttcaatagttatgagaattaaataaagttggcttttctagcagtgctgttgagagttgcttagtgttactgaccttttcttcataattgcttctacttttcccatcaatcttctggagaggatgattccagctttctgtatccatgttaccaggactgtaattatggaaatttatttatattcccataccctccattaagaaaatattgaggttgtctcttccagcatgtagatcctcccaataacttgggcaagcacttgcgtgatttgctcttataaaaaaaggaatatcctagaattcttaccatgtttactctaatttaaccatttcatataatattgtcctggatgaacattttaataatagaagtaaatatactatttttttaaaaaagcaaaaattcaaggaaaaaccactaaatgatgatgcactgattccaccatttcccattttcttatttaattaatccataatagtgtcatagtattctttttaaggcagcccaagtgatttaatataaagtcaagactaaggaccacaatacaatggcagggactttcaaaccatgtttgtaggcagggctatgagatgaaattagaatgccaaatttagaaggtaaattctagagtggtgcccagattattttaccacaacttaaaactgaggcactctatattttcagcattgagaagttatgcttgcaggaaatgtgaagtttctaaaaattattgagatttatctaattaagtaattgcttctgattttctagaactgtggttagaatggtagtgtcacatttaatttaaaggttcacatatacatacacatgcacaaataaatgcattcataatagtagagtagatgagcaaataactgttttgctgtatttcctatgattcacataaatactcattgtaaactggtccttccctcctcccaatacatttttcaaagcatccatttggatcactgaaatattttttctttcatgtattaaatgcacatggtgagagatttgagtaaaattgctacttgaaatcaggcaccaaaggttatataagtataagcataggaatgcaaaaataaacaaaaaaatagtattttggagatattttttgatgggtcacactctgctatttgagaaagaaagaaacaccatgtgtattagattagacctgctctgctgagctttttgaagattaaattgaacagtgcaatattttctttcatagtctaaaaaaatagaaactatgtacaaaatttggataaagaaactctgacaataaagagcaaatggaaagagaaataattaccctatctaaaatcaaatattaaaataagatatccatcaagagtcttttatacgtgatgcaaagtggttgttctcaatgtaggctgaaaatcacctgaggagatacagaacatattttctggaacgaattcacggagtttctgacttaattgacctgtggtatagtctggcaatctgtggatgatttcatttgctttgcttgtttgcttacttttttttttttttgattcattacagcttcctaggcaattccaacttgcagatagtgacagtgctatgaatcactagaggattttagaatgcagtgatagtcctcccaggaaatgggttgtaatggctaaatatatgcagatacttaaaggcaagaaataaaggactattcaagaaataggacacaacaattaactcaagaggaaggtgactatgactattgggagaaggtaactgggagcataaataatactttctattaatgggctgtggaggagtgctaaagctgagagttattgttagatcacctcttggtagttgatgaggtggctccctttggcataggggataagatacaagtaccatttaatgtgttttattttatacacttttaggttttcagtaggtctagtttctgattgctaagatttaatttgtattttcggttttaaattatatacacctatacttgcataaacttatacaaaaatttatatggtttaacattttaacataccttcaacaatttcgtgatgccaaattattattggtatttacaatccacttctccttctccagggctcattttctagaatagcttgttctactataaaaataacaatcctttgttaacaatttactatgtgctaagatccatgttacattcatgaagtgcattatcttacccctaacaatctctaagttaaaaagtgaaaaattattctattttacatgtgagaattcaaggcttagaaaattaaatctatttcttgaagacttaaaattctgaatttttactcaatcttattgaccctaatgccaaagctatttgatttaaataatttcctttttactttgacttatttaattgtaattgtttttaagtctttatttttactaaaattaactattttagtgttctttatttgtatgcactttaaaactagtagtacatagtctcttatttgttaatatttagcttctattttcagattttaagtttatcttttatataatcatgtgtttatttttcattccattagttacattcttttatatattttgtattgaatattaaagtcatcatacgttaagtatgaacttttattgcaatataaaatatgaactttctacacattatatttattttattatctcacaatacttctaattatttgattctgttttttctgatagttctctattactgttgattgcctctctttttattattatttttaatttttctttagaaaaatcacattacataacttcaaattacaccacagagttatagtaaccaaaacagcatatcactggaataaatacaaacacatagaccagtggaacagaatagagaacgcagaaacaaatccacacacctacagggaattcattttcagcaaaggtgtcaagaacatacactggggaaaggattgccttttcttcaataaatggtgttagaaaaactgtaaatccatatgcagaaaaatgaaattagatccttatctcttgccgtatataaaagtcaaataaaaatagattaaagacttaaatctaaggcttcaaactatgaaactactataagaaaacatcggagaaaatctccaagacattgatctgggcaattgcttgaacaataccccacagcacaggcatccaaagcaaaatgggtaaatgagatcacatcaagttaaaaaacttctgcatagcacaagatacaatcaacaaagtgaagagacaactcagaaaacgggagaaaatatttgcaaactacccatgtgacaaagaattaataaacagaatatataaagagctcaaatgactctatagaaaaatatttaataatgtgggttttatatttaagtctttaatccatcttgagtttatttttatataaggtgtaaggaagaggtccggtttcagtcttctgattaaaaaacaggcaaaatatttgattagacatttctcaaaggaagacatacaaatcgcagacaggcatatggaaaggtgttcaatgtctttgaacataagagaaatgcaaatcaaaactacaaggtgattacatctcaccccagttaaaagggcttatatacaaaagtcaggcaaaaacaaatgctgatgaggatatagagaaaaaggaaacccttatacactgctgatggaaatgtgaattagtacaacccctatggagaacactttagagatttctccaaaaactaaaaattgagttatcctaggatctggcaatcccactactgagtatataccccaaagaaaggaaatcagtatatcaaagagatatctgcagtcttatgcttgttgcagcactgtttacaatagctaagatttgaaaccaacctaagtgtctatcaacagataaatggataaagaaaatatagtacatatgcgtaatggagtactattcagccacagaaaagaatgagatccagtcatctgcaacaacatggttggaagcagagatcattatgttgagtgaaaaaagccagcgcagaaagacaaacattgacttttctcgcttatttgtgagatctaaaaaatcaaaacaattgaaactcatggatatagagcatagaaggatggttaccagaggctgagaagggtagtaaggggctggggaggagatgtcgatagttaataggtacagaaaaaagaatagaaagaataaataagacctactatagtctgtaataacttcattgtacattttaaaattactaaagagtgtaattagattatttgtaattcaaaagataaatgtttgaggggatagatatctcattctccatgatgtgcttatttcacattacatgcctgtatcaaaacatctcatgtttcctataaatatatatacccactatgtaaccacaaaaataaaaaattaaaattaaagtaaaaaataaaaaatatcagtgaacaaaaccaaaatcgtcttcttggtaaatgaatttataaattatatagtatgatagaaagctacatattttatagaaaatcaaagtataaaaataattttaaataggctagtaggtagtctattgaaaagaaaacatttggataagaattatattagtgatacaggggatctatattttagacagaggaaatactggagtcaggtattctaggagcacatattctatgagaactgagtcaggtattctaggagcagatattctatgagaatggaaaattagatccatggcctggctaataggccagtgtaagaatattggattttacactaaataaattggatgttggtaaggaaattgtaatatttggcttagaatttgtaaatgatttgtgtagctgctatgcttagaagagactaactgaagcaagagcagaagcagagagataatgtatggagttagagtatttcctaataaaagttaatgggtgacttggctcagaatggtaggcctagaggtattaagtggttggaatctggttatatttaagccatggtcaaaataatttctggatgaattgaatcaggtgtgtgaaaaaacaaaagagttaagtatatcataaaatctttcacacattttcatcctcctatccagactgcacttcaggttttctgcttaaaaattgcttcccatcaagtcctagaattctttctgagtgccttgagttaattatggttttgacatacatttttaaatggtttccattgttaacaaaatatttcaaatttggcataaccaaagctagtttatttttctaatttattatagtgtacacttcaagactacattcaaccacccttctgtcttcaagtcaatcaggaaatatagtctttaactactccatggtacacttctcgccaaacccaccaaattcttagttaagacttgataatatcctaaaatgtctagtttttatagaaagaacagcatatttttaaaataatataactctaaatattacaaattggataataactataaactcaagacttgtagaaattcaaacttcaaacacaagagaaatatcaagaaaactaaatgaatatatatcataataaatcattcaaaacctataatcaggtgatagtaaaagcatccaaagaaaaaaatatagagaaacaaaaatagaggggatgacaaaatttttactaaaagcatgcaagtaaaaagagaatagaacaaactctttaatgtatgaaaacaacttctttaaagtattggaagaaaaaactttatgtgaacatagagttttatactgagaaaatatctttcaaaaattaaggcatcataaggactttcagacgttcaacagttgaaataatctgtgatgagcagacccaactttaagatgttaaaggaattcctttaagaaaatgcaaaatgattcaagatgggaatatggatctactccaaggacagaataagaaatgacagcttccttggtaaatatatgagatccagataaaatgaatacattatcttgctatataaatatttttcaaatataatcaacaatttaaacaataaaaataacaatgtattgtgtagagtgcacatcaatattaccgcaaaagtctaatggagagaaatgaaacttttttacttatagtattaaactataggctaagtgttataatattacctaaagatttcttataataataagaaatctatactataaatagaaaagcaaccactaaaataaaacaaaaggttatagttgctaaaccagcaaagaagataaagtagaagcattcaatttattgaattaatcactaaaacacaaaaataaaagggaaaaaagaagtgaagaagataaatgtaaaacaaatggcaagatgataaatttctacctaatcaaatcaataaccacattaaatgtaaattgtctaaatacaccaattaaaaggcagagaattttccattggaaatgcatatgtaaaaactaaaattaaacaaactcagacatgtttcactctatataaaaaattaactcaaactggaacacataccttaataagagctaaagttctaaacttttgaaagaacataggagaaacctttgtgaccttggattagactaggaaattagcacattacaaaaatgaacctcattaaaataagaaaaaaatgtttaaactgttttagtaaaatgccaatcaagtatctaataatatacataagtggagtatataaaaaacagtcaataaagggaaaataattcaattaaaaaatcaaattgttcaatgataaaaacacgtattttaccaaagatgatattcagatgccaagtaagcacctgaaaaaaggctcaacattattagtcattaggtaaatgcatattaaaactgcaatgtgatattactgtacaactacttcaatggctaaaaattaaaagacagtttatattaatttttggaatggaggaactcaaacactgctgttgcttatgtgaaatctaattatgctgaatgatacaatccaaagaaaggtacataccctgtgacctcatttgtataaaattctaggaaatgcaaactgttgcatagccaaagaaagatctgtggtttcctggacatttgatgacagggatagttgtggcagagaaggaataattacacaggacatgaggaaacacatgtagtaatacacacattgagtatctgtattttggtaatagtttcatggtgtatatgtatgccataatgtcaaattgtacaatttaaacatatgcagctcattaaatgtcaattataccacaataatgttgactaaaaaacttttaagaaatacatgtgattcaaataattttacttatttatctatgtaaacatcttattctacttcccatttcaacgaggcaaaatgatgtatgttttaaaatatatacgtttgaggggatttttttctgattttcattgaggacatgtttctaattgaatttttatattccatggcataaaatttcatacatatttatatttgctgtacattttaattatatatctagcattttttctttttaaatgtagacaatgctaaaacttgcatattgatttagacattctcaagaaggtgacatttgttaccatcagctgttaaaatattaattattttatgatattgcattgtttttgttaattttgaataaaccagtatgtcatagtatatacagatgtggtgatattaacaaaatattgaaacattaagaatgaaaatatggaagggttaagaatcctaaatgtctttatgataaatctccatcaattataaggaactcagggcagtcactaatactccttttcattttaaaacctggtcctataattttttggtagattttaaaatgtaatcttacaatctaaagcagcatgtgctggcatctacctaaggaactcatttactgagccctgccatttgaacagcagggagctaagttccctgaagtgtctctaagcatttcaggctcaatgagtcaaaactaaataaaactcagcttctgtgaaaacaaactcctgccagataaaactactaatggtggttaaccattagcaatcctgccccatatctctgatatttccagattgttacttttaaatatcagctgatgcaagctgaagtggggtactacacctcaaagagtaggacatcccttgattatttcatgtcattgtgtaagaagacaagataagggaatccaatcagagtaccaatgaggggaaagataggaagtcacagtaataggaaatcatattctgataaatctacaattctcaacaatattcaggggaactcatgctgtcattttacctcactaatagattatagattattattcaaagtcagaagttactttcactaagtattaattgaaccaggccacattattatcttttttttggaacacattagtatgaaatgtaaaatgggaattcatgacacatgaaagtttcattatttagccaagatagagtgctggatagggaatgggaggatttcctactaagtgattttatatctaaggaaaaagaaggatctgctacttttcctttcctgagtagaaatcagtgataggcagtctctttgaatgaaagggaaatactctataagatgaagggaaagaggagacacaataacgagagagaaatggtagaggttgtggccatgtggaagaggaaggattgcagtcaccacttttcccctaattttcttatgtatgtcctcaaataatgtgaaacaggatagtaacaatttctctggacaatgaaagcacagaagttacatgagagtgggtctgtctgcttgccagagaatatcaacatgagacaaaaaaaacagagccatcgaaggaatgagagcatgattctgcctgacagtctcaaaaagaaggggtagctgagtctcccaggggtatcatcaacacagagggatttctgccaaacataatctatatcagactgtgcagctcttttaaggaaacgtttggaggtctttcacaaaacagaatgcaacaagataagccaatgatggcaatcagcagagagaaaatagggaccaaaacacactgaccattaccttatgttgtaatgtcacaggatccttaagagtgtagatttgcctgagagaagcctctgtggctggcagcaccttttgctcgagtccaggtgcagagtggcaaagggtgtgtgggcgagtgagtgaggtgttcagccactgtcacagccaggcatgctggctgctgagttggggcaggcagttccaggcactgtgacaggttccagctccatgcgaggctgcagctacactaggtatattgcacatgggctgtgggcacctgcacctggacaaggggaaggggtgacaccagaagcttggagatgccaggaactgcagaacctcaaagagggtgtcacaggcctggcttggggagcccctacatctgagctccccaaagagccacagctcttctctccttgtcacccataatgtggcaagtgtgtatggggggttgtgtttcagccctgtttgtgttatagctcttttagtcctgctgttcactgggtcttgagctcttctcccatgtccaggaagaatgaggtaagcagacaactggagggcgagcaaggtgaagaggagcttcattgagaggtagaacagctctcaggagacccaaagtgggtagctcctattcaaagagttctcaagagactcaaggtggggagctactatctgcaggcaggttatccccacatctgtgcagccctcagcaaaaaggagacctggagttcatagctcctattctcagacaggttatcccatcatctatgcagccctcagggaagtggagacctgaagtgggaagctcctatccacaggcaggtcgtacaattgtctacccaagtctagtggagattggggctattacgggcttcagaggggaaaaagtacatgctgattggtccatgggcggccatggtgggaccagacaaaacactataagttctcactctggtccctggaactggcagcctggtccccaggattcaggtcatccctggcttgaaggtggagcttcacctggacccgcccctttccacccaggagcctatctgcgtcttgccaccatcaaactgccgtccacaatgcccacagctccctggctgttggtgccaaggggcacctgcaggcccacgtggagctgccctcagtgcccccatggccttcccatgctcttcgacaaccaatcaatgtctagggagggccagtgaggcagggggatggtgtgttagcactttcccaagtgcgcacacagccggctgggttgtgacagcacctgggcttagcctcaactttgttccgaaatcggaggggtgttgagagctgggagaggccaggttagtggaatcaggcacttctgatcctatagggggaggtgagcttcacaggtccccatgaggcagaattgcccaggtctgcagccgcctattgctgcagttgtgcccaagagggtgggaatcctgctcctcaaactcagaagcaggtggggctaccccctgttcccaggtccgggatccagccccagccacgcctcccctactgcacctggcctcatggcagtggcctgtgcagacaggccgcctctgccatcagtaatgtctcaattttgctcagacttggatgccaatccaaggtaaaggagggagagggaagaaccttcaagaagcaagacaatcctcatatgaagattaaatttacattgactaagttgtgaactggatatagattttttaacaccctaaattttaacaaacaaaaatagcaaaaagtcacaaaatttgactgaaatatcagcagtgggatgggacaaattgctctaaatagattgggggtgaagagcaaactgttttatttcttttattctagggaaaacatggttttctgaaatattgcaccctaaatattcctcttattggtccagtgtgtgcatcttaagagcagttgctttcattcaggcctccaaaacctcatgtcatccacaagtttgcaccatttaacctcagagtttacaatttgttttatgggtaatgaagaatataaataaaatatgtttgttttattagccttttaaaaaggctcatgatttgttattcattattttttatttatttatttttttttgagatggagttttgctctgtcgcccaggctggagtgcagtggagcgatctcggctcactgcaagctccacctcccgggttcacgccaattctcctgcctcagcctcccgagtagctgggactacaggcgcccaccaccgtgcctggctaattttttgtatttttagtagagacagggtttcaccgtgttagccaggatggtctcgatctcctgacctcgtgatccgcccgcctcgacctcccaaagtgctgggattacaggcgtgagccactgagcccagcctgttattcattattttatgtcgttaagaaaataaaagtataaattaaaaatctttatttatctcaatttcgtgttgaatgtactttaaactgtctgtgtacagaacacccattaaatgcatctacttgttttggaattctgtgaatatttgagacaccaagaataaggtttatatcaatacacagagtgtttaagtaaagtctaattccagatatatttaacccagttagaaaaaaaactgtctatagaggtgcatgatttcaattatatttattctgcttgttcatttatttaatttataaaatttgacttatttaacttaatttttaaacagttttaattttaatttgcaattataaaatgttgcaaaatcaggacaaagaattctcacatgccatatgctcagctcccccatatgttaacatcttacatagcaagagtacaattttcaaaactgggaagttagaactgatgtgaagctgtaagtgattaatccacacatgggatgctcattttgtcattgtctctttctactgtcttgtcttctgtgtctgaattcatttaattgttatatcttcttagcttcatttattctggaatattccacagtccttttattctttcatgatgttgacacttctgaacagcactggccagttattttgtacaatgtccctctgtttttatttaattattcctcatgataaacttcaggttatacatttttgtgccttttatttttagatattttatgatgtgttatttcattatttcatatttaactaccttgaagctcacttacaagactaataatttattgcattttgccatttcatttaaatttgcttgagtgaaaaaatagtataaaggaaaagttctttttttcaaattgtgaacaattgtttcacttttttctttttttatattcattgtgtacatgtgctggtttgttacataggtatattgtgtgatgctgaggtttgggatgtgattgatccaattcctgtgctcaagcaatcctcccacctcagcctcctgagttgctacaactacaggtgtgcaccacaacatccacaaaatgattttattttgcatatttttagagatggggcctccctttgttgtccaggctggtttcaaattcctggactcaagcaattttcctgcctaagcatcctaattaactgagttgataggtgtgagccactgcactccgttaagaataaacttcttaataactgggattttaagggaattctatttgttcattattaacttttccactctgtggaatattatagctgtatttctattttactatattttcattgtttctgaattgtatgttacttcttgctgttgtaagtttgagacagaacctcaatgttactataaaaaacacataggaatgttcaggtaatgtgatctttccattgatctattcattatattaattgataatttataaaataaatctatgcattgtaattgaattagtaaagaattttaaatccattttagactaccaaaatgtgttttcagaaaagaaaaatagttcagtttttcaaaatatgtttttgtttgtttggtccaaggaaagagggacatcaggaaggatgggaaaagaagaagccacaaagccctatttccttcctataaagtcttggtaggaaaaaaagggtccactaccacttgtagctaggagcaggaaaccagactgaattgggagccagtgacaaccagaagcacggaccacactgcaatcattttcaaggaagatagagtagcaatgaggcaatattatgtcctcagagaggcagtggcagcactgacaagcaaacttgacaattgtcatccaaagccaatgcctgtgggtacagcattgcaatctctatggtcaaaagtgttgtggccccactggaaagtcctggagtatgtttgctgtgaccgttgatgttttgccatctcttcttcctgttttatcatccatgcccatttctgcaggtttctttgcatttctgcattggtaaatgctttttttaatgcttaagtcagatttctcatgtgctcaaccataaatgctggttaatacccctagtaagtgacatgactagaaatttgatgtttttctcagttggttttaaatatgttttatacactgcttaatttgcatggtgctgtatattgtcttgacatccatctatacagttgtgagtttttaatattagcagattacatttaacatattatcactgtatagtatatctgcacacacacacattccaaaacaaaagttttaaatatatgcattaaaacttaccatgtaattaagttttataatttaaagcaggagtccccattccctgggctgcagaccagtattggtttgtaacctgttaagaaccgggctacacagcatgaggtgagtggtaggtgagctctgcctcctgtcaaatcagaggcagcattaaattctcataggagcccaaaccctattgtcaactgtgcatgtgagagattggatggcctgctccttatgacaatctaatgcctgatgatttaaggtggaacagtttcattctgaaacacctccctcccctatcccatgaaaaattgtctttcatgaaactggtccctggtgcccaaaatgttgggtactggtgatttaaaatactttgggagattacacactaatctcaaaaagccagtcaattgctagaatattttgtatatattaatttagaataaagtagaaatcagtctctattttatcattctgctattctgcaacctctttcccctgttttttaaatgggtattccttgcattggtcatttttatatttatcaaaccaaatctcaggacatttatatttataaaattaaatcatttttaaagatgaccactggctgtcattgtctatatacaaaattctatatgaagacctttggtgaccatgcatctctgcatcctggctcttggcaagttttctttcccaaatgggacttttacttggcctggcagttatcactatcttactcttgaaatggtacctccttgaaggttgctttttggaacccagcccttatgctatcaggactctgcagcaacgagaagaagaggccactgaaagagaatccagcctctctggtcaacagcagtagcttaaccctccgtcaagcctacggttggatacgattgccctgaagtcccatctaagtccacatggaacagaacagtccagtaagcccacatgaggctgacaaacagtaagtcatcactctaaatcatcaagaagtgggatggttgttacacaactgaaacaagtcctaagcaaatgcttgttgtttagaaatcaacaggaaaaagataaccatataaattgtgtttttattttcagcttccctttttactttcatggctacccccaggtattatagcatctttttcaatatatttttcctatttacatatattttctccagtgacactttaattttttctaaaagggtctactatactacactttttaaactaatgtcaattaccaaagactttcactgcctctttcttcttttaagattttaaaatttgaaacgttatattctttaaagcagcacaaactaacaagccaacaacttgagaaaatatattatgtatattttaatttttataatataatcattatattacatgatgacaaagtaaatcaatttttctcacccttgtcttcatattcctcttctgtctatctaatcacaaagacaatcaaatatcaattcagtgtttaatgcagaggaaaaaatttatgtaagaggttataactgacaaaatgaaactatacaatcttttgaaacatagcataaagttttaaatattagattcattaatatgaaaattgattctgtctttttattatattgaccctttaggcttaataagaccaaccaccacccccaaaattaaaataaaacctggctctacttccagtataagtaccaatagctgaagctcgtggcattactaagtaattgtacttacggctatatgatctattatgcttctcattgtgtgaaactctgcctacttaaagctatattttatttttcttccatcgtgaagatcagatctagagatgatccagagaacagctttagttaacaagaaggactcttattttttccacccatgaccaggcaattttttttacttgttctttctgtacgctgtgtaacctcacatcaaagcatgtttccaactctgctaagtgacactttattgtatctaaatctgaatagggcttactctctgcccttatttgtaacccttacctgaccttttccatgttagcttgcagttgcattatcaccaccacgatgacagctccattttgtttttttagctgtcattttcccaacattccattagttcttcagattgccttgtgcttccaacgaatcattacaacatatttattgattagacttctctccagatacaaggtgtttaaacatgagttatcaagataaaacaatacatattttatgtttattttgatacaaaaaaatctattttccaaattaagtaatactctcacatgaatttactattacctattcagccaaatattccagcaagtcaacttataggttacagaaacttttgaaagaagtccattaagtaatttaaaggtatttgctaactgaagttttctatttttattacctaagaatagggtcggcctgtacaattataaataaatcatgcatctttaagcttactgaatttttaaaaacttttcataatttaaaagttatatgatccattatatgtttattttgtcattatttatgctacataatatctgtgtacaaatcacaaaattatattgaacccaacagaacttatgtaagataggaaggggatatattgccaggtaattttggaactccagaaattgtctttgagtgtggaaacaggagtcctaaagccacccacataccaccacatgttagtttctttcaatttctctgcatcatgtttagtaccttgtaaataatattttgtatgaacaatgcaccaagtgaaatagacgaattgagctgcagagagactgataaaaccaagaggcaaggattctcaaaggagagtatctcagagaagagtggtggaaaaaggtagaaatctggagatctacataagatcgccttcaggtactcaactgactattgattcttgcatgaatgtatagacactatctaacatatggaaaaaaagattttttataggaaaaaagaaagattttaaagtaagattttgtataatttaaactttcaatcattgacatttatgacaaagattttaatatatttgcagaaaaagtcactcttgaacatctctttcatttgtgctatcaatttgcctcaatgttttgactgcaggtaccataatatttcaacattatatctggaaatttttttgatactcacttctttctaaatctagctatcattataattatttgaatagtaggaatcataatcaccataatttattgagttacaaaattcaagaatgactgattataacaggtttaaattttaccacagtttacatcacatgtaccagtagaatatatatattctactgtagatattctactacatatattctaccagtagaatatatatatatacattatgtatagaatatatatacacacgcattatatataatgcttatatatcacataatacctacatgtatgaatagatgactagaagtgataagaatatatgtccttgtctgatcttaggttaataacattcactttttcatcacatagatggcctctatcttatttaggacactcccttgcactcctaccttatagaaaattttgaacaggcataggtgttggatttagtcaaatgatttgtccaagtatattgaaatgatataccagatttatccttaagtattgcgtattttgagatattttgatacatttttaaattcactaattcttactcaatatttaatcagttgtttatcttatccatggagcactctcatcacacattgaagttttcatctttataagattaatttggaagatatatacatatgtgtgtgtttatatgtatgtgtatacatatatcccaattataatttatatgattatacttatacaattataaatagtattacatttataactaaaatcaaaatggttattataaatattccatgtgtttaaaaagttatgaaatatttataatagctattttgatttccttatctgattttaagatatctatttcagttctggtttgattttgatttatttcttcatgacacgttggtgttttcaactttttgcatgcctaataaattttgactggatgttagatactgtgagttttactttgtttgttgttggacaattttatattccttaaacgcgaagttttgttcagggatgcaattaattcacacagaaatagttggatcctttgtgtgttggctttaagatatttttttcttcaggtctggagcagagcttagactagttctaattatctgcaactactaaggtaagagtctttgtgtacttcactctatgccccatgaatctggagactttccattttggctagtggaaatgtacactatttctgaccctgtatgaacacaaagcatttttagttctaatccttctgactatttctttccatatgttagagagtgtctgtacattcgtgcaagaatcaatagtcagttgagtacctgaaggagatcttacacagatctccagatttctctctttgtccaccactcttctctgagatactctcccttgagaattcttgcctcttggttttatcagtctgtctgcagctcaattcaggcaatcttccaggctcagtcttgactctctctccttgtatccaagtcaagaaactcttctaccagtagacactgctgtctgttacctgacatatagtatcttgtaactcattttttctatatattttgtacaattttagttgtttcacatagtaagataaatccagtacaagttcatcttgtccaaaagtggaattctctgcatttatataaaataaaagatgagtatgatatactatctaagaatatcaactggcacattttctttctgaaaacatttctttaaaaatatctgtttctagataaaattagttaataacattggacttctttcttacttccttatttaacaaattgcatctgttcatagtagacttctgtcatgtttgggagtgagagtgtcagagggtgagctacagcttcatgaagatgagagccaaactactccaagaggggaaaggaaatatgaattggcattaaagaaagcagaataaaacaaccttataaaatatttaaaaggcttctgggtttataaaatttggagtagagatgagaatctctgtaaaaatgaaacacataaaagacagtagcttttggagaagtaaagaaaattaaaatagtatttaatattcacgctaaaatcaagtacaggattccatataagtattgagctactaaacggtagaatgtttaattttcacaggtttattccatactgtaacagtataaaaagtattccattcatcttttcctagaaaaatagggatttgaaaaaaatattttattatagttaagcaagacattggaagacatgatagatattttgataattttttaaacttttatttcaggttcgtggatacatgtgaaaatttgttccataggtaaactcatgtcatgggtgtttgtggtacatattacttcattgcccaggaatacctgggcgatttcatcatccgaaattaagaccagcactcaatagttatcttttctgttcctctccctcctaccaccctcaagcagacctcagtgtctgatgtatcctcctttgtgttcaaaagttctcatcatttagctcccacttataagtgagaacatgcaacatctgattttctgttcctgcattagtttgcccgctaatggcctccagctccatctgtgttcccacaaaagacataatctcattccttctttggctgcataatattccatggtgtatatataccacattttctttatccattctgtcactgatgggcattttggttgattccatgtctttgctattgtgaatagtgcttcagtaaacatttgcatgcatgtatctttatggtggaatgatttatacgcctctgggtatatacccagtaatgagattgctttttcatttttttaaatatctaaacaatagtgctttcttgataaaaggttagtttaaatggatacaaaattgctgtgtaaaataagtgctttcaaaatacatttctataggtagagactatctcatagtaaaagagcagttatctattatcaaatgtatctatttagatttgggtagtaaagccaaaggggatcagaagtgtagcagtgtgggtcctccctccctgcatagctgttacaaggaggcagcgtgcctgaagtactttcactcatgtatgtggggctttgtcactagcaaacttgtttttcttttttgcagattttccagcaaagttattaaatgtcaaactcaaataatggactctgcatggatgtactctgaagtcatggaacactttttcttagttaccttcacacaagaagccataacatatagcttttggctatttacaattaagcaacaatgaagggcaaagttagcaagaacaccagattattttctgtagcacatcttcataactattattatttaactgcctcattttatgttttttctagcccccacaaaaaacaaaaaaccctgtctcatcctcagattaagcattttctccatctccctacacaaccattgtttcctttcatctgtcactttctggggttggatttcccaacttccgtagaaatgataaaaaaggcaaccgctggagtgcaccacagggagacacaagaggaaaggtgacactaaggctacagtgcacagaaaacagaccaggtgtggcttcaactgtgcgcacctgcccactagcctatgctacagatttgaaatgtctttcactttgacatgacacacagtttatattacacaaaatgaatgaaatgacaatggctaaaaataaatgagacagcctgcatacaaaaaagtgattactgctactttcctcccatcagaaaatgactcaaaaagagagtatttaaaggaaacccaaatcaggagaacccggtaggcatcagaggttcagggcaccaaggccttagggcaggaacacttttcaacgcaatccgggcttcaagggcacgcccaccaacagaccccaatttccacaggggaggcagatcttctatacctacagttacagaaaatacactaaagtgcagtataaaatataaaaagttggattctgaatagaccaactgctaattttccttaaaaaaatttttaatttggttgagtaaaaatagtttagtgaatctcattttgtaggtaagaatcctatttgcaatacgaaaacgagctcatgactattgtgcctgtcattgcaaaagctgacactctcaccctgaaggaacggcagcggctgaagaaaaggattctggatgaaattgaagaacataacatcaaaatctatcacttacctgatgcagaatcagatgaaaatgaagattttaaagagcagactagacttctcaaggctagcatcccgtccatccagagattggatccaactgtccaggaagcatccttgaaaattctggggatataactctcatatacaaacacacttatatactcatcaaaacaaagaacaaaatattaatatacaaataaataatcatatacataaatacatattcagattagtagtaagtggcaagaagggaaaataatagggtttggaagctaatggttagagtggacggtgacaataactacagcaaccagatatctgagtcgaaaataatgacaatgagtcagtatgaaaaattccagccaaacattctaggccaacagcaaccattgggacttccagcaatgatgaacatgttcaatatatgtgatatccaatatgctagtcattaggaacatgtgccacctggcactagaattatggctgtttaactgagaaatgagagtttaattgtctttgattgatttaaattcaaaataccccaagtagctagtgtctaatctattggaacagcacagctctaggcccaagaacaatagctcttcgtgtgggaattatttagccacatttgaggaaaagaagagagatcagtgttagtagcttacaggaagcatggttgaaattgtaccaacatgggagtttggaaaggaacaggaaacatgcagagtgatctaagccatgttgagtagtaaggtttcaatcaaattaaggtagccattgatgtttttaaaattaattttattaaggtggaaggtacataaaataatgttaatttctgtctcatgatagtatatattttcaagaagcagaaaccactctgactagtttaagcagaaatggtagaaatatatggagatgccgacttgccatgaggctaatgaagcttgttttagaggctttcatttgtactggttttaaggcttaagagaggacgttgcattatattctcttggttaaaaatttccaaatgaagatattttatctgcatattaatactctttcccctttcctctcttccttctcctccatcatatttggagatttacttatggaaaaactgaatttaacatacatttatttagccttggtgggatacatttatatggatcatttccaagtaatgttaaactcttgctaactctttcagtttggaaacagcattgaggaatagtcctaatcaccaacatttgaaaatcctaactcaccctatgaaagttcaaggccagcatttacatcaagatataaacaagtactatggctcctgtcactgggagaatgtctgcaacagaggattaaataatagttgaagtatatagacacagaagtatttcaatcattgtgtgcaaaagtctaagtgacgatgtgttcctcatcaatgtctaaacagaacagaagttcttcatgtcagaaatattaagcatcaaataaaattagatatgttatgtgtgtgtacatgtgtgtaaacacatatgtaaatttgtgtgtgtgatgaatatattgtcatatatacacacacatatggtatatatgtaatataaatctattgtagataaaaattgtgcccaatagagtttatcagaatttcagaatcttgttttgaaaggcagaaaatgataacagtgttacaaacaatggatgtggctttatgcatataaatcatgttttatgcatataactctcaaaattaaaaagaatagtcaagcaatcatgctagaggcaggaataaattatatctattgtctctgcataaaatgatattacaaagttattgtcatatgaagaagtgatcaaagttagtggttccaaaaaaagaaaatgcttagaagtatataaaacacatatttttaagttatattaatttttctatactttctgatattgttttatagttttgttttttgtttgttttttagacgaagtttcgctcttgttgcccaggctggagtgcagtggagcgatcttggctcaccgcaaccttcacctcccgtgttcaagaaattctcctgcctcagcctcctgagtagctgggattacaggcacccaccaccacgcccagctagttttttgtatatttagtagagatgggttttcaccatgttgaccaggctggtcttgaacttctgatctcaggtgatccacccgcctcaacctcccttgttttatggtttttaaaatttatattttgtcattttttctccttctaatatttaccttcatttctacttctatatacaaacttttgtattttatcctttgtagtcgactttcaaatagttctcatgaaacctatatccacccatgaataaatataagttactttaatatctttgagactgagagaacagtctgtattgtcttggctttaaggaatgactcccagaaaaaaagaccacaagaataaccaaaggaaaggtagttactacatgtgctacaatgggggaatagataatcaagaagcttctgttgtaactgtcatgtcacagcacacaccatcatggatgcaatctagggatcaaaaagctactgctctcaaccctgaaactgcttctctagacccatgatactcatcatctgaccctggaactctaccaaagaaaaatccatgtctccgtgatccgtctgggtggtaagaaatagctgaaacagaatgacaatgtcctctgcctgaactctgcttttcaaatagcacatctcattgccagaatccaattctcatgcagaatagtctataagacagagtgggaaatgttgtttttagcttttcagcttccatggtacaaaaggacactaaaaattcacactgctggccagtctcatgttagcctatttctggagcatctccttcaatacaatgcttcaacatcttttaaaataacaacagccatcctttgacatcatgccttcctccaactataatcttattgttctggtgtattttatagaaaagcgctttgaaaaaagttttctggactgttccacttccacatgccccagatattcctcatgttcctccaatttggctttgatatttctcactttatttaaaatgattttgccagaaatgagtcaagttttgtgttacaaatttagtgtcaaattattgctgtgattttctcaaattttctgtaagatttcatacagttgattactcctttctctcaattcatctgtttttctatgatatcacatgtccttagtttttctcctactgcattattgtctctagtttttgtcctatctgttttagttccattttttggctttttaaatacacatacacaaacacacacacacgtacacacacacacccatattctctcatacaaactttctgcttttttgtggtaaatccatttcattgggtatactttgtcttatatcttagattacatttttccattgaatattttatttaataatttgaatattcttcatttgtaggagaggctttttgtactagtctatttcggctgggtggcttaagcaatagaaatgtattttctcgcaggtttctttttgttttctacagcaaagtttcattagctgtgaaaattgaggagataaagacaggcagttttattcctatggcaaactaattttttgtttcttttgtgattagtaagtcattacaccctactcacttctctacctagcaatgagtaccttcaatcaaagaacaatgtgatagaagatgttttctccctctttaagattctcataccatatttaccttgaagtgtgttagcattccacattcctaaatccagctgtagggttgattcatatgcatatcaactgcccctaaatttattctatactctttgtcgtctcagatgaatctatgtttgatatgtgattccattgacttgttgcaaatgagaactgatataatgccagggaaaatgggcataatatacttaccaccatcttagatatttcattcttcatacttgttgtgacaattagtggttagataggttatgactcctagttctataactgggatgactatctgtccttggagctttcagtaacaagaacctgcttttttactattctattcatgtcaaatgaagctgtaccattttgagtacatcgtagaccctgaaatatacatatgttagaacttggtgttcttccaaatttttcatataattgagtttgacttatttccacaattgttctaaagtttccctctgcctttcagatggtttggttatttttgattctgctagagattctatctactcactttaagttattttcttaacatacataaatactgacaattttgatcattatctgaagcgcgatttatcttaagaagaaaaagaaaagagaaaaactcaatttatcaaagactctaaccagtggatcttatcatatactatttatacatttgtttaaaaatgaaaattaaaatattcccctctcatttattcctttgtccatttcaatgcgaattttcaaagggagaagaaatcacatacatggttgaaatgccgtcttcaacgaaaatcagaaacttcatgtgcaatgataacgtaagatatattttgagagttgatttatggaattaatatgtacaataaatatgataaattttcacctatctgggtgagttaagcaagactatgcatgaaaaatcaaaaggtgttactcaactaattacaagttgaaagtagaaatcagagataaccacagcaaaatgggctataaatcaattacagggctcaattgaggggggaatctccataggaaggggagatattcctgaattatgcataaggttgacggttgttggctttattttgcattctgggttcctattagtgcactgtttacaggtatattatgatagaattgaagaatcttagatagaatctcctgaattcatgcacctttttgatgccacggcatggcaattatgacagtggaactaggaaagatttagcttgtcaccaagaaaaaaaaaaaaaggaatgtgatatatgcattgaaataaatgtcctgaacatgctgagcattttatattttcctactccaattggccttcttgtagatgtgggccatgtcataaataaggtggtgttctaatatattttgcatgccttctgacaatcccatggagaccttatagaaaaatgattctgtgacaagagtttttttcctccttacttgaattagaatcatcagcaatatttaacttcataaagtctgttatactcactaaaaatagttttcacttcattgaggaaagcatttttcatattgcaaaaatataagataatttttcatccctcaacaaatggaagactgtgatgtttaatcacttgaaatcacatagattacttaaaggatgcttctatacatatcaaaatatggaagcaatgtggactccttccaagataaggaatatttagaaagaaactttctatctttgccatatatatgtgtgtgtgtgtacatatatacatactatatataattcaggagattgtaaatttgctatcaaaattatagatattttattatttttaaaagtagttatatatttatcagatgaaataaccaaatttttatttttattgataccaccagagggtttatgattcttttaccccaaaaaaaatctaattagtgactgagtcttatccattataattataatcatttccccattctctactttgtactttactgttatctcttcatgcttgaatgtttatttagcagttttaaaaatgaattatatcattcctgtacagcctaaactctcttctaggataacttctttcttcttcttcaagagccattctctttccatattgcgattcatttttcatactgtgataagtcaatactcctaaaataaaccttctatcatgccacatctcggctcaaaaatgtttagttatttcctattgcctacaggataaattgcactctgagcctgacactcaaagctttcaaaaatgaagactatatgatcttctcagagtccctaaactctaaaatgttaattcactcaggctaaaagtttcaatcacttaactcagaacatactttttagtcttcccactttcacatatctacagttgccaccacttttctcttagccagtataaatctgaaccatgtttcaggaaccagctcagatttcttctccccacagtacatggtaaggtgttctctctatcttccaacactctatagtaattaattctcataaattttgaaccaagcaataatttgctgaattgagctgtttcattgccattttaaataacattcagaatatctaatttgctctaaacattttacataagttaagtctcatctttctaataccttcagtgaactttacaggcacttaggtattctaaaacacctatttttatgtaatacattcaaaagcaatgcggctaacaaattattttactacagagaagtaaatcacatggccatactataaaacataaaatgaggcacctacgctattataggctttgtagtaatcatagaatgcatatttatccagcttatgcaatatattcaatagtgctgtatcaccttgccaaataatcagaattaagcttaccactgttaaaattcaacctcttattgtcaaaggatgagtttatttttctattttcatgctcatcatatattttgatgaagctagattgttcctggacaataaagaagcagaaatctttattgctcttaggtcctgtacctctgcctcaagtacttggaatcctaagccaaactctgtgatatttggttttcctactttcttatttttatagaaggcaagccatagctcaggggatgagagtaagactgtggatatagctggaactcattattaatcagacatctatattaaccacagccattaagctaccgtcctagaacttaaataaatagaagaaaagctcctgcaaatgtacactgttattattgattttcttgatattttaagatttttgttataaaacataagccttgatgagaaccatatgaagaatttattttcttgaaccagaagcagcttatcctttccccaggatatacctaaaaaagaacaaaccagaatttactccttaaacccttggagctgagttcatttaaaatagccacccgaggatttggacttttcatcttgacttctcccaccttaccaatcttcagccttgtgagagtaagacaacaattggagaaaaagagctcaagggaagatagtaactacttaaccaggggggtttagctgccatcctagatatgttgaaaactctgatcccaggcaccaaagcccatttaatgtccttaattttgtcatgttaccatagttccaaccttatatcatataattataagttatattatctatttatgagagttttctagttagagtcctgagtctgtttcatgcattagtaaaattaatcagagattattgaatatccaccatatactataaattgatagattttgagaacacaaagtaaaaaaaaatactgaagtgcatatatttcttattctaaataaagggaaaatatacaacacatattatataatttttattttatattctactgctatgaataaactaccacaataataagaaatatgaaagtccagataaatgaatgagctaatattcttgtggcagaataatatttgccatcatcattatgtaataataataagaaaaataagaataagaagaggaagaagaagaggaggaagaaggaggggaggaaaaagaaaaggaagaaatagtaataacaaaattctaccaataaaaagtaattataaaaaatcaaattgaggacgggtgcggtggctcatgcctgtaatcccagcactttgggaggccgaggctggtggatcaccaggtcaggaatttgagaccagcctgaccaacatggtgaaaccccgtctctactaaaaatacaaaaattagccgggcgaagtggcgcgcacctgtaatctctgctactcaggaggctgaagcaggagaatcgcttgaaccttggaggcggaggttgctgtgagcagagatcgtgccactgcactccagcctgggcgacagaaggagacgccatctcaaaaaataactaaataaatacataaaaatgaaaaataaaaaaatcagattgagatattctttcagtagttagcactgagagacaataaaaaataaaataatgaaagagaaaatggggcagagtaatatataaagaaatcatagaaacaaattatcccaatggaagaaagacttaaatggtttaaggtcaagatcacaacaaccaacagacaaaaattaacctaatccacatcttgacacataatagttaaattttaaagtgccaaaagtagggaatatatactgcaaaactttctataaaaacgaaaataaaaatgttttaaaagattagaattcagttgatagcacatttaacaattgtcttttaattctgaaaaacaatatcttttattccagggtttgccttacagccaaaactatcattcatattcgcaactatcacaaattgatgctgaaatattggctttgtaatggagggattaggttcacaaattaaaatcacaaattgatcttagtttcactctatggatgctaccaaatatcattataattttgtgtatgtgatgcaacaaaaagtgcacaaatcacccatcagtttgaaggaaatgaaagagatagaactatgttaaacagtgccaaaaagaatgcaaaactttccaaaaaattatctatttccatcagtaaaaaacaggacagaaagggaagataaaaggactgttagataatagaaaaggattgtgcaatggaaaaccaaagagaatgttgggtcttgtttggattttcattccttttttgggacacgtagttttttctgttgtcccaggctggagtgcagtggtgcagtcataactcactgcagcgctgagatcctttctcctcagcctctcaagtagctgggactagaggtgcacaccaccacacgcaggtaattttattttgttttttttagtagagattaggtctcactgtgttgccctgttgtccacgctgttctcaaacttctgagctcaagcagtcttcccttcttggccttacaaagtgctgagattacaggcatggggcaccacacctggcctggattttaattttaaaaatcggatttcaagggacacttcaaagccaatttgggaaatttgaatgtgaactgcataatacataatattaagtagttattcctaaaattattagatgtgataatagccaggtgaccatataattttcaatattactatcaattaaagtgacataataatagcagaaattacatgacgtccatgatttatattaaaatactgtagataattaagaactttaaatttgtgtaaatgggatggtgggatgggtaagaaatgtataaataaagcaagattactaaacttttgataattgttgaagctgggaaataagtagcttggctttatcgtattacatctctatgtttctgttttttttttttttttttttttttttttttttttttttttttttttttttttgagacagagtcttgctctgttgtccaggctggagtgcagtggcatgatctcggctcactacatcctccgcctcccaggttcaagtgattcttctgcctcagcctcctgaatagctgggactacaagcttgtgccacaccacaccaggctaatttttgtatttttagtagagagggggtttcaccatgctggccgggctgctcttgagctcctgacctcgtgatccacccacctcggcactgttttaaaagtgattctcagcaactacaacttttttacattttaagaaattgttaaaatccgtcacctttgaaacccctgaaagtaaccactattgtaggatacattgctgagaaaagtttagtaaactcaggggcaagaaataagatacaagaaatgatgaaaaaataatttagtaaattcataattgaagaaaaattggttttctggataaaaatgaaacaaggtgagttgtgtacaatttaaaaattctcacctacaattgttacaattttgtagaggtgaaaattaagattagagaaacgctgtcttgaaagtgaatgtaatgatcaaaggaatagatgtataatgcacaactttcataaatagaagtggtcatcaaatggaataaaaataaaataaataattgaataacagaaaaaaataaaaactgaatggttcagaatgtgtacagagaggaagaatataaaacttaaaccatgatatggaaaagaaaaaataagaaaacacaatgaatagaaacatttcacaaactacaatgaagatcaacaggatgaattcaccaattaaatatagagtcatcgttaaaatcaatgtcaatttatagtatatgtacctaaaatgaaaccacacaaataatgtgtaagtagtgacacaagacatgtacaaatagcttctagttctgcttaccttaggcaatgaacataagaaaaaataatctattttttattatttgagagatagtaattcatcgcatttttaaagcctctgattcactaagaatttaattctatgctggtttcctaggatggagaggccactgtgtttgtttgattggccaccttgaactgacagtgcttaaatcctttatgaaggacatcttatttcattcaaatagcattttgaggtttactgctttccagatttcctctctattctctttctcacctctcctctcattctcactatccatactcttctcttttctccaccccagtccttctctctctcatctctttcatttcttaacatcaccaaaaatctacaagataccaatcaacacagtagtccaataatttgatcaaaatcacataaatcttttttattttaaagtacagcctgattcacagccttaatcttctccctcttacagtatgcagggaggatgttctgcaataataatataaagacaattgtttctcaagttggacatatcattgctcttcatttgtcattgtaaatccaaattggcaaattgtagtgtgtaatatagactacccagcttcttggaaatcgtgaagaacttttctgtattcaaggtaattcaagggcttcctctcttctgagtagtactaaaaaacatttatttaaatatactatccaatcacattctagaatacataattacatgacacatttccttcaagcctacttattattcaaggtaaaaattttcttaggaaatcatgagactgggcatgtatcttaagcatatttgtttcaagttctatgtctgattttttaattatttaaacaatattttctccttctgttcttgatttctcatttaatcttttagtttaaatatcatttgtttttacatcattgtaatatacataaagcctgtttttttctttaacaaagaagaaattagcaatgcaataaaccaaattctaagaaagacccttagtttataattcttctacagttaacatcaccccaaggatctataactaacgttaattaatattaagctatatctaggtctaactgttctaataataatagttaatacttattgggagcacattttatgccaggcaccttgccaagcactttacatgtattaatctaatttaatcatcatattacttttaggtattattagtatccttctttccaagatgtgaaaatggagcagagagattaactaatttacttcaggtcacctaagaagatttatgttatcttagtaatataaatcagcatactatttagtatatccaagtgtaacaaatataatatacactaatgttaggaggacaactctaacccttatcatatataattttgggagataattttaccataaaaagaaatagaatcatgaatgtgcatttaaagatcaaattaaaagacatttctcagactaatgctctttgaagtaattttgttattctttagttaaaaattctaattataaaactaagacatctaatattaagttcaacaatctagaaaataaaaaagcaattacatcaaaaatgaatatatacaatgcctttttcaaaagcagaataaatatataccatagaaattatttttgtactaaggaaagaataaaataaatttcatggtatgccacagaatcaaacaaattgtttcagtctgctgaagattgtattgcttaaggtgaaatattctattttttgagaatctacattagaattttgtcataaagtacaagaaaacagagttcagtcaaagtctaatttactaagcttctatttcccctaaaatttaatgattatttgtttacatcaaaattctaagcagctacaaaagtattataatatgaaatcaaggagagttttatcctttcttaatctaaaactaaactcttaccttagaaaaaccgatctgtaactgttaattctgtgttttaaaaaaatgtgttaagaaaggaagtaacagagaattatggaattaaaatcttcttttaatatttggaatgtaaacaacaatttggcatgttgaaatgagcttacaattccaaaataataagaatggcaatgtgttggtaggtcagaaagcagcagctaccatttggactaaattgaaaaatgaatattgaccatttactaggaagacaatgaaagcataatataattttagtgttctcctttcttttatgaaaatcaatggatgattaagtttgtgcagtttcaaaatttaggatggatattaagtttcataacatttaaaatccaaaaattatgtaacttgtatttttatcactgaagagtcatttttaatattggaagttaattaaatttgctgttccaaaccattaagtgtaatatcaataacaatttctgttctcagaagtataacgttgaaagtctagataatgaaagaaaataaaagacagtaacctttttcaaaaccagaaaaaatatatagttgtcaccagtgtctttacatttgtacttcaaaactttgccaaaagagggcaaaccaagtctatagaccatttaaaataattttcaatgaattattgtcaggttaccaaagaaaaagcttttcattcagagatggtgcttgatgccccagattgccttagtataatgaggaagaaaataaattacaaatgtttgttgactttgtatgctaaagctggatgtaatatctctataaatatataaactgtgattaatcattcaaattatttgccttcataattactgggcaaaataatgtttgaaaatattcataaacttggaagattgagagaatgacatattttactaacaagctgaaattcagtctctatcagtgtgagcaaaaaattgggaaagtatgtgttttagcctttttgaatcaagaatggtcatattgcttgattgctccttgtttgtgcttgttgttatggaaatatattaaaatactttaggaagagaaatatatttattgaatatggataattcatttcatttagtattctattttgccgtatgactcagtgtgacaagaataaattaaccctaataaattaatcaatatcaatgttttcatccaggtatacaagtaaagtaaagtttttaaatatatacaaatttggggaatgagaatcaaagtaataacttgaacaatcagaaatctgagattatgaatgatgtctttgtataaaccagtattttctttaccaaaccatgaataattcttataactcagacttatctattcactgagaacattctgaattcaaaggagtatattttaacaatagttttattatgtaaaattcacatattatgttatgccccctttaaaacggtacaattcaatgctttgtagtgtgtccacagatacgtgcagctaacaccacagtcaattttaaaacattttcatcaccacaatgaaagcctgttacactttacctatcattcctctaaaccaggggtccccaacccccaggccacagactggtactggtccataacctgttaggaactaggccacacagcaggagctgacgaactagcatcaccgcctgagttccagcgcctgtcaaatcagcagcggcattaggtgcgcaacaggagcacaaaccctactgtaaactgtgtgagtaggaagctaggttgtgtgctacttatgggaatctagctaatgctgcatgatctgaggtggaagtttcaaacagaaaccattccctccctctccaccccgctgtccatggaaaaattgccttccacgaaaccggtcctctgtaccccaaaaagtttggggattgctgctctaaaccctcaatactcctaaggaacacagtaagcaaccacttatctactttctgtctctacggatatccttcttctgaactttatttccaagatggcatatagtatgctatattttgtgactggcttttttcatttagcataatatttttaaggtttattgatgtggcatgtttcagtacttcattcctttttgtggttgagtaatattccatttatggatttttttttttccctcttgacgcccaggctggagtgcaatgcacgatctcggttcactgaaacctccgcctcccgggttcaagtgattctcctgcctcagtctcctgagtaactgggattacaagggcctgccaccacacgcagctacttttttttgtttgtttttagtagagaccgggtttcatcatgttggccaggctggtcttgaactcctgacctcaggtgatccactcgcctcagtctcccaaagtgttgggattacaggcatgaactacagcacccagccccatttatggatttaccatgtgtttgtttatctttttctctgttgatgaacatttgagttgtttccaaatattgtctattatgtataattcttgtataaatacttgggtacaaatttttttgtgtgtatatatattcgttttttttcagtatatacctaaaagtggaattgccgggttatatggtaactctagatttactcatttaaggagctgccagactattttccaaattgacagcaccattttactgtccactgacaatgtgtgagggttctgatatctccatgtccacaccaacattttcatctcacttcttaatttcagccattctagtgtttggtaagtggtgacacatgtttttgatttatatttccctgatgactaacaactagagcatattttcatgagattattatatttgcatattttccttagagaaatgtctattcagaatctttgcccattttttagttaggaaattgtctttttattacagagttctaagtgtttgtcatacatttgaaatacaatttgtctgtcagatatatgattggcaaatattttctaccattttgtggtttggtttttcactttcttgatggtgtcctttgaattacaaaaatttttaattttgatgaaatccaatttacctatattgttctttcttttgaagctcatgtttttgtttccatatttaagaattctttgccaggtccatggttatgaaaataccatatcttttcttctacgactcttagacttttagttattacgtttaggttgttgatttattttgagttaattttttttatatggagtgacttaggatccaactttattttgcatttgactacacagtttccagttgtcccaactggagcaactcaaccgtttgttcaaagcctattctttttcccattgaattgtcttggcactcttgtcaaaattcacttaaccatatatgtattggtttatttctgcacttttgtttctatttcattgatctacatgcctatccttgattataagctccagtaggcactgccagtgtcaacaagaaaacatgatagcaatccttctattctactgataattcatttatgatagccaaaatcttgttccatctacatgcctacactgatttgattactgtttctctgtagcaagttttgaaattggaaagtgtttttttcaagattattttgttttttcttcaatttattttcaactttagaatcagcttatcagtttctaaaaagagatcatttaaaattctatataggaatgacattgaatctgcagatcagttttgggaatattgccttcttaaaaatgttaagcctttattccattgacatgagatgttttttccaattacataaatcttttagtttatttcaacaatctttcatagcttttacagttaaatattgtacttattaagttaaatatattggtaagaatttcactcttttgatgctattatgaaccaaactgttttcttaatttcatttttcagtcatccctggaaaatatatggaaataccaatggttttgcatatcaatcttatagtttgcaacattactaagaatttattagttctaatatttttaatggattctaaatattagttctaatattgtagtaaattctatgtatattaagcttgtattttgtaatctttctgaactaaattattagttctaatgtttttaatggatttcatatacaagaccacaccctgtgagaaaaaagacagcttttcttctttctttccaatatggatgccttttttttttcttcttcttgactgattgctctggctagagctcccggtataatgttcaatagaagtggcaagcacagacatcctttacttgtttctgattttaggggtaaacatctagtctttcaccattaaatgtaatacaaactgggagttttgtgtaaatgtcctttatcagattgaatgtattccttctattcattgtttgttgagggtttttaatcataaaagtatgttggatattgtcaaataatttttctgcatcaattgaaatgatggtgtaaagtttataaacctgtttatatgatgttttacaataatacataaattctacttagtcatggtatattttttaaatactgctggattcagtttgctagtattttacatacatcaagtttaatattgtttgtagtacaacactcaaagaagtaccagtaggtaggcattctaaatttgtagttattttattcattcctagacacctactaactaagagtgctcattatctctcttttagaatattaatatcatctcccgtctataaattcccttagcataaattttctgtgttaatcgtttttctttctaaaatgtaaatctggtgcatgtggtttaaaatggtaaaaaagcattctaagaaacaccttttgtagaatactaccaactttttaataaaaaaactatggcatttcagatatgagataaaattcactgaaaataaaataaaattagcctcagagaaacctattaattggcttaggtagtcattttcaattcagcaaaatggtgctaatttaaattaggttaataatttaaatttaatgcaaataccatcaacatgaaaaatgatgtagttctgcttggttcctctagcatcttttgattataagctccagtagacacttccagtgtcaacaagaaaacatgatagcaatccttctactctactgataattcatttatgatagccaaatatattcattttttgtacctgttagtacttcctccaaaagcatctgaaaactgtaactcatggaaaatactgtcaatcaataagaccaatatatgcctagtcaagattgcgaagaggtaggccaaataagtaaactgctggcatcatggatgaaaaatagaagagttctagttataatgcatggtttcttgtttcttaattggttcagtttccatagaaagaagaagtacattataccatattaagtctgaaaactatgagagatacagtagataagtatctgttagacaatagaagtttgtatgtgaaaaaaaacaaaaacaaaaacaaaaatggttactcagctacagtattcaagtattcagctgaaaatagtttagggtcatattttcaaaaattgaaaaaaaaaatgttcctactagataaactatttttccaaaataaaaatataaaaaaggaccacaaaaaaagaatagcagaatcagaaatacaaatgggtaatataattaactttaaaaattaaaatcaaatttgatcactttaaatataaaaaaattgcaatgtatcaaaataaatacaagaaaaataaatagaactacctaaatgcaacaaaatggaaaatacataaaacattataattctgattttcattgatcatactgtgaaccatgtacagagaaacatacactctattgctagagagtttatcttttttagaaagcaattaaaaaacaagttttaaaaggctttaaaacgttcagatatttatttcactagtatgtaaaagatagaaaaatgaattaaatattagatgaaaaacagatgaaaacaatgattatatctgggtggggacattatgggtaatttgatgctgttcttgaaactttcttgtacaataatacttttttttttaagtgagaggattatgttatattgtgggaaaaaaatacaataaaaagcaattcttatttagataaatccttgcaagttttcggaataacattgcaaattacatttcctacgataagctgccaagaaaatgtatttattagtttgacattgtacttctctgtctcactaaatgtgaaagaagtgtcaatagaactctgaatatacacagcaaatttaagaattttatccaaatgaagttactctttgtgtgtatattagacagtattgcctagaagttaagcttatggttaaaggaaattagaataaatcacccaaaaatatgcttatttagcataaggattattttaagctgaaggcagttgataaacaggacactttgttttctatccctttcaaaagcctcaaggcagagtataaccttttctttgtgaagatgttcctccttcccttttccataccaggaggaggcaaacaaccattatcattggagaaataaatttggcaccgccttgagtctacaccagaaaatgctactaagataacacttatcttctattagtttctgcatagcctctttatactcagttgtcttctcagaaattgatattatagtaataccacataaggttattgtgaaaataaataatgttttcagcatattacttactacactttgggcatttaattaattttaaagtttatcattttatttgaaaaaatagaaaaaaatattccatatcaataacctgaaaaatatactattctttaaaaaaagctattatttaacatattgaaaagttaattaatgttagatcttaagaatgagaaaaatgcattataacatatcagtaatactccttgaaaccaatttttaggtgtttaataaatatgaaatatgtaaaatgtttaaatgaataataaattatttattaaaagcacagttataatctaccaagtggaaaatgttcttgtaagatccttcaaatatttaaaaataattttgtagaaatcatttggttgcctggaaaaggcccattttcttttttctctcttaaatgactctgtacatatacccacatctaaagaaggatgtttattagttagtcaacccatatatcttgtacttatttattaacctttttttggattagaagtagacaggtgacataatgtggctcaatcagagtgcaagattttttaattccatgtttggggaagtggtttcgcctctcttcctaggtgtaaacaaggaagcatccaagcccagaagctaactacggctagctgtcaatactgatgattcagagcaaatagataaaataattcctttccttgttgatatcattgagctgctattgtatctggagtctaaaatacctctgaacttcctggtgtataagatgtttctactttaagccagattaagaagaggttttctctggaaaaacattcataattataaatattttatgattataatattttttacaactgtaggtaatcaaatattattaaaat

SEQ ID NO: 850 - DNA, 92901 bp, Homo sapiens
gtttaaaagtgttggcatgttcatatttgctctgttcatagagaaattcccaagtggttcccttcagttggggagtgatcataccccaacaccaggtgaccaaggcaacacctcctttaggataacttacacgtttttaggactataaaattagggtagtgaaattaaaattatcttcaacatttggtcgtgtcggtgttttggattttagcttgtcaagtaggtatatgtgatagttcattgtcttaatttgtaattccctacgacataatttcattcacttatttcctgtgtatatatattgtcttaggtgagatgtcttttgagatcttttgaccactgttttatgttttttttaaattgggttgcttactttttattattattgagtcttaagggttctttgtaaattctgtttaatagtcatttgtcagatgtgttttgcaaatgtgttcttccaggttcatctttttattaagtgttttacagaacaggatttttaaattttgtgacatccaatttgttaattctttctttcattgctgtaaacataatatttgtaatagatattatttatagagcagtttaagttctaagaaaaattgggcagaaggtatacagacttcccatatactccctgccccccacatacatagccttctccattatcaacatcctttaccatggtggtacatttggtataattgataaagctacattgacacattgttatcacctagactctatattttatatcatggttcactcttgctattgtacattctatgggtgtggacagatgtctaatatatgtatccactattataatagcactgatttttttcactgccctgaaaaatgtctatgctatgcctcttcatcactccttccctccaaccctagaaaccactgacctttttactgtctccacagtttttttccaaaatattgtatatttggaatcataccttcagattgacttctttcacttagtcatttaagcactgcatttaaattttctccttttttttttttttttttttttttttttttttttgagatggagcctcacaccgtcacctggcctggagtgcagtggcacaatctcagctcacagcaacctctgcctcctgggttcatgtgattctcctgactcaacctcctgagtagctgggattacaggtgcccaccaccactcccagataattttttctatttttagtggagacagggttcaccatgttggccaggctggtcttgaactcctgaccttttgattcacctgccttggccttccaaagtgctgggttacaggcctgaagcgccgtgcctggcccttccatgtctttttatggcttaatagctcatttcttcttagcactgaatactattttattgtgtggatgtactatagtttatttatacattcaactaccaaagacattttggttgcttccatatttcacatttctggataaacttactgtaaacatatgagtgcaggtttttttgtgacataagctttcaactcattttggtaaatacaaaggagagtgattgctgcattgcatgtaagagtatgtttagttttgtaaaaaacttccaaactgtctcacaaagtaactgtactattttgccttggtagagaattctcaaaacaagagttcctaataataagagttcataataagagttcctgttgttcctcccctgtgccagcattttgtcttgtcagtattttggtttggcatcctaaataagtgtatagtaatctcctattgttttaatttgcaattatttaatgacattatgatgttcaaaatcttttcattgttattcaattctttttttctcattttaaattagactatttgtttttggaaattgagttgaagttccttatatattttgaatattagtctcttagatacatattatgtgaatattttctgcttttgtgctatgtattagtctgttctcatgctgctaataaagacatacccaagattgagtaatttattaaaaaataaagaggtttaatggactcacagttctatgtggctgggaaagactcacaatcatagtggaaggtgaaaagcatgtcttacatggtggcagacaaggaagaatgaaaaccaagtgaaagttgtttccctttataaaaccaccagatattatgggacttattcactaccaagagaacacaatgagggaaactgcccccgtgattcaattatctttcaccaagtccctcccacaacacataggaattactggagctacaattcaagatgagatttgggtggcgacacagccaaatcatatcatgctggttatctcttactgcgttgattgattcctttattgtgtagaagcttttagtttggtgtcatcccacttgtcttatttgtctttggttgcttgtgcttttgttgttgtacctatgaaatcatttccaagaccaatgtgatgaatcttttcctgtttttttttctactataagttttacagttctagttctttgtctttaaatctctaattaaatttgaattgatttttaaactatgctgtacaatgagtctgtttttgtcatttggcttatggatattcagttttcccagtatcattgtttaaatgactctcttttccttagggtgtatttttgtaattcttgttgaagatgagttgaccatatctgcctggatttatttgcagaatctctattctgttccattgaactatatgtctggatttatgctagggtcatactactaaaattagtatagttttgtaaaatattttgaagtcaagaagtgtggtatctgcagctttgttctttctaaaaagattactctcattattctgggttattatgaggtctgcatggatttcagaatattttcctttgtttctgtataaaaagccactgaaattttgatagagattgaattgaatctgttgatccctttgttgcatgaactgttaacactgccaggtcttccagtctatgaacaaagtgtaccttttcatttatttgtgtcttctttgattttgttcatcaataatttgtagttttaaagcacaagtctttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaattccagtaaacttcagattctgtaaacaaaataaatgcattgtttgtttacttggtcttcaaatattattcatatggagcatagtatatgacagaacaaagtggaaatacagaggtgagatgggttaaattgtgtttctaaaggatgtgttgaatttctcacccccagtacctttaagtgagatgttatttggaaatacgccctttgcaggtataatcaagttaaaatgaggtcatactgcaatagagtgggcctttaatcccataatactggtgttttgtttatttgttttttctttgcaaaagcaagtttattaagaaagtaaagaaacaaaagaatggctactccataggcagagcagccaagactggcattcttataagaggaaaagaggcaaagagacacatatacacgaatagagacagccatgggaagatagaggcagacatgagagtgatgctgccatagaagcaaggtacttctggggtttccagaagctgcagaggcaagaaaggatcctccccagaggcttaggaggagcatagtcctgctcacaccttgattttggacttgccacctctagaactgcaagacaatacatttctgttgttttcagccacccagtttgtggtgctttgttatggcagcctagaaaactaatacagagattagaatataagataaagacaaccctggccttccaagagcttgcaacctgggtgaaaggtgtacacagaaaagaaactcacattacaaggctgaattaaccaaatgctgaatattggtaacaagtggcatgtagcagggtaaacaaggaagtttgaggacacagaattcaagtcctcctaacagaaccggagaaaaaccatggaggaggccacatctgcactgtcctgagtgctgagcaggatttcaggagagagaaggcagagatgctggacaggccagcacaggtggatgagtgtgcatggacactctgagcagggctagttcctgagctggttgcggcagagcatggggcactgaaaggcagacactggcccagaaactctttctgtaaagcttctagtaagcctcatgagccaccctggaccacatcttcatcaagtcccagatgtctacatgcccatttggtttcttttcagctcatatagtttcctaattattctagttaatagtccactaacttaaattcccagtttctatctctctggataatattcaggtatcaataagactaaacgtgtaatccattagaaatgaagatttatctgagcagtcacaggcaacatggaagagtaggaccctaggggacaggcaggaatgtctctctccaccctaagagggtaagcacttacccaaagcttcagcataagatgaaaacagatggttttcacactttcaaaaacacacaaaccagtgaaaaaaatattttcaaccatgtactttatattcctcttggaattcacagttggagtcagtttcatatttcttaaaataggcctcacaattctccagtctgattatcttggatctaagaaaatgaaacaagttattaggatacagattattaaaaaagtaaagaggttactcactttttaggtcttcatcatgaaaagataaagaaaaagacaatcagaaagactcattcatttgggaaataaacatcttccccaaagacaaaagccagagaaacctgagtgtatatatatattttttcaagggagtggttgagaaaaaagggaggagggctaacaaaatagtatttataaaacactggaatgataatccaaaaatctaatttctaggccctattgtgtaactgattggctttgtgaccttaagtaagttctcttccccgagatcttgataacccatttctttaagtcactatatatatattcagatagacagatgatagatagatatagatagatagatagatagatagatagatagatagatagatagatgatagatagatagatgacagacagatagatagatagatagatagatagatagatagatagatattaggccagtgcaaaagtaattgcagtttttgtattgttggaattagccattgaattggaattcattcttaaataaatgtggttatgttatacattattttaatgcacatttcttgatttttttttgctgatgacttattacttgctgtttattttatgtttattttagactatggaaaatgatgttggacaaaaagcaaaactgagtgattttcttattcgagtcaaaatgggtcataaagcagcggtgacaactcacaacatcaacaaagcatttggcacaggaactgctaatgaacataaagggaagtggtggttcaagaagttgttcaaaggagatgagagccttgaagatgaggagcagtcatggaggctgatcctcttacaactacaggagaaattgctgaagaactcaacatcaaccattctatgattgtttggcatttgaaggaaattggaaaggtgaaaaagctcgataagtgggggcctcatgagctgaccaaaaatcaaaataatcgtcatttgaagtgtcttcttctcttattctacacaacaacgagcaattttttgatcagattgtgtcgtgtaatggaaagtggattttatacaacagtcagcaacaaccagctaagtggttagactgagaagaagctccaaagcacttccaaaagccaaacttgcaccaaaaaaggtcatggtcactgtttggtcttgccagtgtgatccacgacagctttctgaatcccagcgaaaccattacatctgagaagtatgcccagcaaattgatgagatgcactgaaaactgcaatgcctgcagccggcattggtcaacagaaagggcccgattcttttccaggacaaccctcgacagcaagtcccataaccaacgcttgaaaagttgaacgaatttggctacaaagttttgcctcatccaccatattcacctgacctcttgccaaccgacgaccactgatttcaagcatattgacaccttttggagggaaaatccttctgcagcaagcaggatgcagataatgctttccaagggtttgtcgaaacctgaagcacagatctttatgctacaggaataaacaaactaatttttcattgtcaaaaatatgttgattgtaatggttcctactgtgattaataaagatgtgtttgacaggaacagaaaatcaaacaccgcatgttctaactcataactgggagttgaacaatgagaacacatggacacaagaaggggaacatcacacacagaggcctacggggggtggggggcaaggggagggaaagcattgggacaaatacgtaatgcatgcagggcttgaaacctagatgatgggttgattggtgcagcaaaccaccatggcgcatgtattcctatgtaacaaacctgcatgttctgcacatgtatcccagaacttaaagtataatactaatactgctactactaataataaaaagatgtgtttgagcccattcataatgatttaaaattcatgatctgaaactgcaattacttttgcaccaataatatatatattacataatatatttatgcatatgttatttatatatataatcaaaactaagttcattaaatacatataaaaataaacttatatgacagcaataccctatgaaggcactaaaagggaagaaatgtccagagaaatatttatttatttaccaaacggggtggtaggtttttcttttgttagtgtaaatctgaaaagttatttctcctcccttacataacacagacttccaagttagtcaagttagtcatttaaaaacatttatttatttaaacttttattttagtttcaagagtacatgtacagatttgttacagaggtaaattgcatgttttgggggtttggagtagagattatctcatctctcaggtaatcagcacagtacccagtaggtatttttttgattctcaccttcctgccaccctccatcctcagatagtccctggtgtctgttgttcccttgtctgagtccatgtgtactcaatgtgtagctcccatttataagtgagaatatgtggtattttgttttctattcttgtgttagtttgcttgggataatggactccagctccatccatgctgctgtaaagaacacaacctcactcttttttatggctgcatagtgctccatgtatatgtaccacattttctctatgcagtctattgttgatgggcatttaggttgcctccatatcttttttattgtgaacagtgctatgatgaacatacacgtgcatgtgtctttatggcagaacaatttatattcctttgggtatacacccaatatgggattactgggttgaatgtcaattctgctataagttctttgaaaaaatgctaaaatgctttctacaattactgacctaagttacattcccaccagcagtatgtaaatgttctcttttctctgcaaccttgccatcatgctattttttgactttttaatagcagccattctgacttcggtaagatgctgtcttatcatggttttaatttgcctttctctaataattagtgatgttgtgcattgtttcatatgcttgttggccaaatgtctgtcttttttttaagtgtctgttcatgttcattgcccattttttaatgcagttgtttgttttctgcttgttaatttcttttttttcatagaataaattttagtctttatttatttatttatttttatttttattttttttattatactttaagttttcaggtacatgtgcacaacgtgcaggtttgtaacatatgtatacatgtgccatgtcggtgtgctgcacccactaactcatcatttaacattaggtatagctcctaatgctacccctcctgcctccccctaccccacaacaggcccggtggctgatgatccccttcctttgtccatgtgttctcattgttcaattcccacctatgagtgagaacatgaggtgttcgtttttttgtccttgtgatagtttgccgagaatgatggtttccagcttcatccacgtccctacaaaggacatgaactcatcattttttatggctgcatagtattccatggtgtatatgtgccacattttcttaatccagtctatcattgttggacatttgagttggttccaagtctttgctgttgtgaatagtgctgcaataaacatacatgtgcatatgtctttatagcagcatgtttcataatcctttgggtatacacccagtaatgggatggctgggtcaagtggtatttctagttctagatccctgaggaatcgccacactgacttccacaatggttgaactagtctacagtcccaccaacagtgtaaaattgttcctatttttccaaatcctctccagcacatgttgcttccagattctttaatgattgccattctaactggtgtgagatggtatctcatagtggttttgatttgcatttctctgatggccagtgatgatgagcattttttcatatgtcttttggctacataaatgtcttcttttgaggagtgtctgttcatatccttcgcccactttttgatggggttgtttgtttttttcttgtaaatttgtttgagttcattgtagattctggatattagccctttgtcagatgagtaggttgcaaaaattttctcccattttgcaggttgcctgttcactctgatggtagtttttttttgctgtgcagaagctctttagtttaattagatcccatttgtcaattttggcttttgttgccattgcttttggtgttttagacttgaagtccttgcccatgcctatgtcctgaatggtattgcctaggttttcttcaagggtttttatggtattaggtctaacatttaagtctttaatccatcttgaattaatttttgtataaggtataaggaaaggatccagtttcagctttctacatatggctagccagttttcccagcaccatttattaaatagggaatcctttccccatttcttgtttttgtcaggtttgtgaaagatcagatagttgtagatatgtggtgttatttctgagggctctgttctgttccattgatctatatctctgttttggtaccagtaccatgctgttttggttactgtagccttgtagtatagtttgaagtcaggtagcatgatgcttccagcgttgttctttggcttaggattgacttggcaatgcaggctcttttttggctccatatgaactttcaagtagttttttccaattctgtgaagaaagtcattggtagcttgatggggatggcattgaatctatcaattaccttgggcagtatggccattttcacgatattgattcttcctacccatgaggatgcaatgttcttccatttgtttgtatcctcttttatttcattgagcagtggtttgtagttctccttgaagaggtccttcacgtcccttgtaagttggatccctaggtattttattctctttgaagcaattgtgaatgggagttcactcatgatttggctctctgtttgtctgttattggtgtataagaatgcttgtgatttttgcacattgattttgtatcctgacacttttctgaagttgcctatcagcttaaggagattttgggctgagacgatggggttttctagatatacgatcatgtcatccacaaacaggacaatttggcttcctgttttcctaattgaataccctttatatccttctcctgcctaattgccctggtcagaacttccaacactatattgagtaagagtggtgagagagggcatccctgtcttgtgccagttttcaaagggaatgcttccagtttttgtccattcagtattatattggctgtgggtttgtcatagatagctcttactattttgagatacgccccatcaataactaatttattgagagtttttagcatgaaggttgttgaattttgtcaaaggccttttctgcatatattgagataatcatatggtttttgtggttggttctgtttatatgctgaattatgtttattgatttgtgtatgttgaatcagctttgcattctagggatgaaggccacttgatcatgttggataagctttttaatgtgctgctggattcggtttgccagtattttattgaggatttgtgtgttgatgttcatcagagatattggtctaaaattctctatttttgttgtgtctctgccaggctttggtatcaggataatgctggcctcataaaatgagttagggaggattccctctctttctattgattggaatagtttcagaaggaatggtatcagctcctccttgtaactctggtagaattcggctgtgaatccatctggttctggactttctttggttggtaagctattagttgttgcctcaatttcagagcctgttattggtctattcagagattcaacttcttcctggtttagtcttgggagggtgtgtgtgtcgaggaatttatccatttcttctagattttctagtttatttgtgtagaggtgtttatagtattctctgatggcagtttgtgtttctgtgggatcggtggtgatatctcctttatcactttttattgcgtctattttatttttctctcttttcttctttattagtcttgatggcggtctatcaattttgttgatcttttcaaaaaacctgctcctggattcattgattttttgaagggttttttgtgtctctatttccttcagttctgctctgatcttagttatttcttgccttctgctagcttttgaatgtgtttgctcttgcttctctagttcttttaattgtgatgtgagagtgtcaattttagatcttttctgctttctcttgcgggcatttagtgctataaatttccctctacacactgctttgaaggtgtcccagagattctggtatgttgtgtcttttgtctcattggtttcaaataacatctttatttctgcctccatttcgttatgtacccactagtcattcaggagcaggttgttcagtttccatgtagttgagtggttttgagtgagtttcttaatcctgatttctagtttgtttgcactgtggtctgagagacagtttgttataatttctgttcttttacctttgctgaggagagctttacttccaactatgtggccaattttggaacaggtgtggtgtggtgctgagaagaatgtatattctgttgatttggggtggagagttctgtagatgtctattaggtccactaggtgcagagctgatctcagttcctggatatcctttttaaatttttgccttgttggtctgtctaatgttgacagtggggtgttaaagtctcccattattattgtgtgggagtctaagtctctttctacatctctaaggacttgctttatgaatctgggtgctccagtattgggtgcctacatatttaggatagttagctcttcttgttgaattgatctctttaccattatgtaatggccttcttcgtttcttttgatctttgttggtttaaattctgttttatcagagactaggattgcaacccctgccttttttttgttttccatttgcctcgtagatcttcctccatccctttattttgagcctatgtgtgtctgtgcacgtgagatggttttcctgaatatagcacactgatgggtcttgactctttatccaatttgccagtctgtgtcttttaattggagcatttagcccatttacatttaaggttaatattgttatgtgtataaattctggagaatagatctttgtcagatgcataatttgaaaatattttctcccattctgtaggttgggtgctgatagttggtaagttgcaaatattttatctcattctgtaagttatctgtttatagtttcttttattgtgtagacactgtttagtttaattagatttcatttgtcgatgtttgtttttgttgccattgctttgtcgcatcatgaaatctttgccagggcctatgttcataatagtgtttcctaggtttttctcaaggatttttttatagttttagattttatattttagtatttaatccatcttgatgtgattttttatatggtataaggaaggggtctagtgtctatcctctgcatattgttacccagttaccccagcacaatttgttgaatagggaatcctttccccattgcttatttttgtagaatttgtcaaagattggatggttgttggtgtgtggctttatttctgcacactctattctgttccaatggtctatgtgtctgtttttgcaacagtacccgttttggttactgtagctttgtagcatagtttgaagtcaggtaatgtgatgcctccagctttgtacgttttgctaatgattgctttgtccactgaggttctcttttcattgcatatgaactttggaataacttttgctaatgccaggaagaatatcattggtgtttgattggaatagcattgaaactgtaaattgctttgagatgtatggccattttaacaagactgattcttcctatccatgagtatggaaagtttttccatttgtttgtatcatctctgatttctttgagcattgttttgtaattattttataaaggtcttttgcctccctgtttagctgtatttctcagtactttattccttttgtggctaatgtgaatggtattccattctttatggctctcagcttggatggtattggtgtatagaaatgctattttttttttaagatggagtctggctctgttgctagggtagagtgcagtgccatgatcttggctcactgcaaccatcacctcctggctttaagtgattctcctgcttcagcctcccaggtagttgggactacaggcatgaaccatcatgcctagctgatttttgtatttttagtagagatggggtttcaccatgttggccaagatggtctcaatctcttgacctcgtgatctgccccccgtcagccttccaaactgctgggattacaggcgtgagccactgtgcctggccagaaatgctattgatttttgtacattggttttgtatcctgaaactttgctaaagttatttatcacacctaggagcttttcgacaaagactggaattttatagttatagaatcatatagtctgaagagagatagtttggctttcttttttttttctaattggatgccttttatttctcttctctgattgctctgctaggatttccagtactacattgaataagtgtggtgagagtgtcatctttgtcttgttccacttctcaaggggattgctttcagtttttgcccattcagaatgatgttgtctgtgtgtttgtcatagatgactcatattattttgtggtatgttccttcaatgactagttttttgaaggttttttcacatgagggaatgttgaattttactgaaagccttctgcatctattgagataattatgcggtttatgctttttgttctgtttatatgatgaatcaccttcattgatttgtgtatgttgaactaaccttgcatcccagggataaagcaaacttgatcacgatagattagttttttgaagagctgatgggttcaatttgctagtattttgtggaagatttctgcatctatgtttatcaaggatattgacatgaagttttgtttttctattgtgcctctgccatgttctggtatcaggatgatgctaacctcatagaatgagtgacggaggaatccatcctcctcagttgttaggaatagtttcagtagaaattataccaactcttctttacacaacttgtagaattcaaatgtgaatccatctggtcctgggctttttctggttggatgactttttattactgattcaatttcagaactcattattggcctgttcagtgattcaatttctacctggttcaatcttgggaggctgtatgttttccagaatttatcaatttgttctaggtgtattagtttgtttgtatagaggtgttcatagtagtagtctttgagggtttttttttttgtatttctgtgggttcagttgtaatgtcccctttgtcatgtctgattgttcttatgtggatcttctctcttcctttattagtttagctagcaagcagacttcaattttatttagtctttcaaagaaccaatttctggtatcgtttttctttatatatttttatgtatctcaatttcattcagttcagctctgattttggttatttcttgtcttctgtaggcattggggttggtttgctcttgtttgtctagttcatcttggtgtgatgttaagttgttaatttaagatttcgctgtcgttttttgacatgcactcttaatgctataaactttccttttaacgttactttagctgtgtcccagagattttggtatgttgtatatttttcttcccattagtttcaaggagtttcttgatttgttcctaaatttcattgtttacccagaagtcatttaggagtcagttaatttccatgtagttgtattgttttaagtgatcttcttaatattgatttctattgacattgtgttgtggtctgaaagtgtgtttggtatgattcctttttttattttaattaatttgctgagaattgttttatggaagattgtgtggttgattttagagtatgtgccatgggcacatgagaagaatgtatattctgttgttgggaggaggatttagtaggtatgtgttaggttgatttggtcatgttgagttcaggtcccaaatgtcttggttagttttctgccttgatgatctgtctaatactgtcagtggtatgctgaagtctcccattattattatgtggttatttgatctcttcatagttctctaagaacttgttgtatgaatctgggttctcctgtattgggtgcatatatatatttagaatagttactttttcttgttgaattgaaccctttactattatagaatgcccttccttgactttttttttttcttgatgcagagttttgctcttgtcatccaagctggagtgcagtggcaccatctcggctcactgcaacctccgcaatgaggcagggttcaagcgattctcctgcctcagcctcccgagtagctgggattgattacaggcatgtgccaccatgcctagctaatttttgtatttttgttagagatggggtttcaccatgttgactaggcaggtcttcaactcctgacctcaggtgatcggcccaccttggcctcccaaagtgccttctttgccttttttgattattgttggtgtaaagtttctttagtctgaaattagaatagcaactcttgattttttctttttaaagttcgttttgtctgaaattagaatggcaacccctggttgtttttttttttttctattttctgtttgattggtaggtttttctccatccctttgctttgagcctatgggtgtcattgcaagtgagatagcagcataccatcagagactacttctttattcattatgccactctgggtcttttaattgaggcatttagcacatttacaatgaagtttaatatcgatatgtgtggattttatcccaccgtcatgatgttagctggttattatgtagacttgactatgcagttgctttatagggtcaattgtctatctacttaagtgggttttttttgttttgttttgttttgttttttttggtagtggccagaaatagtctttcatttccttatttagcattcttttaaggacctcttgtgaggcaggtcttgttgtagtaatacatttccttatcatttgcttgtctgagaaggaatttatttctcctttgcttatgaagcttagtttggctggatataacattcttggctggagtttcttgcctttaagaaaactaaatacaggcttccattctcttctggcttgtaaagtttctgccaaaaggtctgctgttagcctgatggggttccctttttaggtgacctgcttcttctctctaactgtctttaatatattttgtttcatgtcgaccttggagaatctgatgagtgtgtactggggatgatcatcttgtatagtatctcacaggggttctaatatggtttagctatgtccccacccaaatctcattttgaattgtagttcccataatccccatgtgttgtgagagggacctggtgggaggtaattaaatcatgggggagggttattcccatactgttatcataacagtgaataagtctcatgagatctgatggttttataaatgggagttcccctgcacaagctcccttgcctgccaccatgtaagacgtggctttgctccttcctcatctttcaccatgattgtgaggcctccccagccatgtggaaatgtgagtccattaaacctctttttctttatgtattacccagtttgaggtatgtctttattagcagcatgagaacaaactaatacagtttttttgcatttcctgaatttaaatgttagactttctggagaggttggggaaattttcttggatgatatcctcaaatatgttttccaagttgcttgctttctctccctttctttcagggacaccagtgatttgtagatttcacctctctacatagttccacatttctcagaggttttgctcacttttttgttattttttctttatttttgtctggctgagttaattcagagaaccagtctttgggctctgagattgtttcctcaacttggtctattttgctgttaatacttgcaattctattatgaaattcttgtagtgtgtttctcacctctattagatcagttttgtgctttcttaaaatgaccatttcatcttttagctcctgtattttttttttttttttttttgtatttcttaaattccttggattgggtttcaaccttctcctgaatcttaataatcttccttcctatctaaattctgaattctatgcctgccatttcagcctggttaagaaccatttctggggaagtaatgtggtcatttggaggtaagaagacactgtggctttttgagttccaagagttcttgtgctagtttttgttttttgttgttgttgttttgttttgttttgttttgttttttcagctgtgtggactgatgttccttaaaccttttaaattgccgtcatttggatgggatattttgcattatcttcttggaagctttcaagggtttgattgtggtataagaagggtataagtcagctgactggctttgattctggaagatttcagggagctcagctcaacactccttggctgtgtgctctaacactgagggctgctaccagccttgttctctggtccctcaagactaggaatctgctgcactggagggaccaagatgttcctggtctgctggccccaatactctgattagggggtgttggccaaagtgcttcactgaggtagtgacagcaggatccttgcctgctagtgtatgtcagtagccatgatggtgattgagttgcctatacatcatcagcagggtcagaacattagtgggtgtgaggctttggcagtggcaccagcatatacacactcacactggtggtggtggcagtgcagtggggatggtatgctagtaggtgtaggagtgctggcatccatgcacactgattggcttttgggtctctataatatgcactctaatttaacatttgccacccccctcaggtttttacttatttatttacttattttttaactttaagtttaggtgtatacatgtaaatttgttacataagcaaactcgtgttatgaggatttgttgtgtaggttattttatcacccatgctttgagcccagtacctattagttatttttcctaatcctttccctcctcccagcttccaccttcaagtaggcccagtgtgtgctgttcccctctatgtatccatgtgttctcatcacttagcttccacttataagtaagaacatgcagtatttggtttcctgtttctacaatagtttactaggaataatgacctctagctccatccatgtccttgcaaaggccatgatctttttctttcttatggctgcatagtattccatgatgtatatatcacatcttctttagccagtctattgttgataggcatttaggttgactctatatctttgctattgtgaatagtgctgcaatgaacatatgtgtgcatgtatatttataatagaacaatttatattcctttgggtttatacccagtaatgggattgctgggtcaaatagtatttctatctttaggtcttagaggaattgtcaacctgtctttcacaatgactgaaccaatttactcacccaccaacagtgtacaagtgtttcttttctcccacaaccttgtcagcatctgttattttttgactttttttttttttagatgtagtctcaatctgtcccccaggctggagttcagtggtgccatctcagctctctgcaagctccacctcccaggttcacgccattctcctgccttagccttccgagtagttgggactacaggtgcttgctaccacacctggctaatttttcgtatttttttttttttttagtagagaggggatttcaccatgttaaccaggatggtctccatctcctgacctcgtgatccacctgcctcagcctcccaaagtcctgggattacaggcgtgagccactgcacctggccttgactttttaataattccattctgaccagtgttaggtggtatcttattgtggttttgatttgcatttgtctaatgatcagtgaagttgagctttttttcacatgattcttggccacatgtatgtcttgttttgaaaaagtgtctgttcatgtcctttgcccacttttttatgggattttttaaatgttcgtatgtacatttttttatgtttcttatagatgctggatattagacctttgtcagatacatagtttgcaaaaatttctctctcacattctctgtaggttgtctgtttactctgttgataatttcttttgctgtacaaaaccactttaatttaattagttcccatttgtcaatttttgcttttgttgcaattgcttttagcatattcatcattgaatgtttatagcagcacaattgacaattgcgaaattgttgaaccaacccaaaagcccatcaatcatggaatactacacagtcacaaaaaggaattaattaacaacatttgctgtgacctggatgagactggagactattattctaagtgatgtaactcagaaatagaaaaccaaacattgtgtgctctcactgatatgtgggaactgagctatgaggatgcaaaggcatatgaatgatacaatggactcttgggacttggggtaaagagtagggggagggggaggaataaaagactacaaatatggtgcagtttatacatgggtgatggctgcaccaaaatctcacaaatcaacactaaagaacttactcatgtaagtaaataccaccttaccccaataacttatggaaaaaaataaaataaaacaagaaacaaaacaaattgattaaaaacagcaagatggaagacttcaacacaatcatataaataattattttaagtgtgatctaaatatatcagttacaaagcagagatataaatatgtgattaaaagtaagggtatagatggccaggcttggtggctcactcttgtaatcccagcactttgggaggccaaggagggcagatcatgatgtcaggagatccagaccatcctggctaacatggtgaaaccctgtctctactaaaaatacaaaaagttagccaggcatggtggcacgcacctgtagtcccaataaatatagataactggtttttgacaaaagaggaaaatgtaatctgatagagaagaggctgaggcaggagaatcacttgaacccaggaggcagaggttgcagtgagccaagactgcaccactgccactgcactctagcctgggtgacagagtgagactccatctcaaaaaaaaaaaaaaaaaggaactgtatagagaaagatataccacaaaaacattaactgaaagaaagctaaagaaatattaaattctaacaaagtggctttcagaaaatgaaaactataagcagtaaagaacattacataatgataaagggatcaattctctgagaaagcatgactaccctaatatacgtgctcctaaaaacagagtttcaaaatacatgaaccccacattgatagatctgatagataaatagacaaatcaaaaattacagttgaagacttcaatgcccttctctcagtaattgatagaaagtagaaaataattcagtaaatccgaagattatttcaacagcattactaagtaacttgacccaactgacatctataaaacatttcatatcaacaacagcagaatgtacattctttatgagtgaacatggaacatacaccaaaatgtactatattctcagtgatttaacaagccttaacaagtcataccataaactttcaacctcaatagacttaaactagaaattaataacacaaaaatatctgaaagtgttctaatatttagaaattaaacaatatccataaataattcatgggtgaaagtgaaaatttctagaaagaatttttaaaaatatttgaaactaaatgaaaactcatcatcccaaattagcagcatgcaacaatagcagcactttgaggaacatttatagtactgaaggtatacattttaaaaatgaaaaatcccaataacacaagcttctacctaagaaaattagagaagaagttcaagcctaaaccaagtagagtgaagaaaataataatattagaatagaaataagttaaactgaaaacagaaaaacaatacaggaaataaaatcaaaagctagttctttgaaaagcacaatgaaactcataaacttcatttcagcttaatagagaaagagacaatgtgagaaagagataaagaagacacacattaccaatatcagaaataaagaggggacattactcttcttcatactccagacagcaacaggataataagtttgatatcatgaacaactctgtctgataaattctacaacttaggtaaaatagaaaaatttgaaagccatgtacaacgaaaactcagtaaaaaagaaatttataaccttactagccctatatatattttagaaattgaattagtggttaaaaccttttaaaaatgctgtcccagaaggcttcactgctgaattctatcaaacacttaaggaagcaaaaataccaattctatacgttctctttaagtgaaaaagaaatatttccgaattcattttgtgagatatcaccctaataacaaaatagataaaaatgctgcaataaatgaaatctaaataccattattttttatgtatatagatgtaaaacctttaacaaaatgttagaaaatcgcatccagcaatcaaaacaaatatgctacaaccaagttgggtttatccaagcaatacaaggctgggtaaacaattggaaaacaatcaatgtagtttaccatgttaaaagacagaataagaaaagccgtatggtcatatcaataaatgcagaaacaatttttaagaaaattcaacatattttaaagctaaaagctctaagtaaactaggaacaaaaatcaacttccttagtcaaataaagaatgcccatgaataaccaatagctaacataataattaatgatgaaaaactaacttatattatctaagatgtagaacatggcgagaatgtcttttttcactgcttattatttaacactgtgtggaagggcctcgctagtgcaataggcaaaaataattaaatttataaagtttaaaaaagaagaaagaaaacgatctttattttcagccaacatgattgtgttaacgttacagagaatctacaaaaatctcttggaactaataaatgaatttagcaaattcataggatacatagtccacatacaaaatcaactgcattcttacatatgagcaatgaaaaattgaaatctaaaattaaaaaaagtgtaacacctatttgcatataaatttaataaaatatgtgcaaggtctgtgtgcagaaaactataaaacactgacgaaataaattaaagatgatctaagcaaactcagagatataccacggtcattgattagaagattcagtattgttaagacaccgatttctccaatgaattttagatttaatgcaatcacaataaaaattccagcaagctttttgttttaatagatatcaacaagttgattctgaaattcacacaaaaaggcaaaggaactggaagagctaacataattccagaaaacaacattggagggtccagatgaccaaatttccagacttattaaaagttatagtaatcaaggcagtgtgttattggtgacaatgtagatacataaatcaaaatacaggacccagaaataggacaataaatatagataactgacttttgacaaaagagagaatgtaatttgatagagaaaggataagctttttatcaaataatattagaaaagctgaatgttcatatgcaaaaatgagcctagatccatgcctcacagcatatactatatagattaaaatgtgttaaagacctaaaagtactctaaacttgcctttaaagaacttgggaagatatacttagatgctttctgttaagggggaagagaatccctggagtaggagagtgttttgagtaaacaaatacagctagaaaaatgaatgggcacaaatgtctgcaagaaaagccaagaggaacataagggaccccatggagaaaatgctaacatctgaaaacaatatgaaaacactgactaaatcaagggtgggggaagacatataacaaacagagagaaaaaaaaatgttgaaaaagaaagtttaattggcttgtaagaaatagactgatcataagcagaacttccagaatcctttggtaatagtactttaggggcaaagcaaacttacaggttgaattaattttttaataccttggtctatgaccttagggtattattatacttttattattttaatgttctaatcattaaataagacacagataaattaatgcacagaataatgaataattataaagagagatcccatataactccccctcaaggcaagaaatggcatttctgttatttcagttgcatcctctttctctccctatttgtaatctgtatcctagaagcatcacttccttgccttgtaactattttatgccctaggttcttcatctctgaaatgcaaatggtagtgatatctatcctgtagtgttgttacaaagataaataaggtaaatgtcaatttgttcattatgacatagagtaaatgtttactaaatatttgctcttattagtggtgctcacataacaaagcaaaagcaaggactagctttgaatatagatgtaaaaaaggaaaagcttattgaaaatgacatgaccaatgcaaaattacagaatgttcaacggtattgttgacaaatattaaaatgaatattttgtaaactcaaaaaagttatacttttcctgacaagtcaccttaaaggtaaataaagtatgtaagaacacatacttcttccccagagaacatgatgaaagcactgcatgggaattgatggaagtaattttcttacataagaaccagaactagagtttccctctcagattatagagaatggaaaaagaaactcaaattgcataaacggcagatctcagtcataaaaatctttgtattaaataggattcaagttacatgctctggtaacgtgggtctaagaggatgctaattggtgagttgattacatgggggacatataaataattaactgtaagtaagtaagaaatgccttgggaagaaataaaaatgtaactttagaatatagcctttacctaaaattttgcctggcatttgagcttgaacaccttcagaaatcacttggttctctttggactatgatttgagtagtttttgaaaacaaggcaagtactcctcttgccttcaaacttttttttatggggtggcctcccatcatttatttgatttggtgatatgacaggtaatagttactaacatggtatgaattttgtgtttgcttgtgcataagttggggaaaatagaaagtgaaatatcagtagcattcaacatgctgaagatgtcaagtcagatgttgcaaagaaacaatttaaatagttagggaatgactactttcaatgaagagaggacagaatcgactataaaggaaaaaggaagagattctgaataaattcagagcatatgtgagtcaattatttttttctctcttagcattgccctcataaacatgtgatatttgttgaaaatatattttttactcctgtgttaagaaatcatattaagcagttgctaatttttaaacaagctgtactgcaaattctatagactaagacatttttggattaaatgaacactaagcttaaggaggacctgattgtccactggggatgagatgacatattctagaaaaataagataaatgtcaacagataatagcacctactttcttggagaactgcatgtgagaaaagggacatgctgttacaactcttgagagatagcctgaaaaactttgacaaaaaagaaagtaattctgaaaatgatattgtgagaagagttcttagatagaattgaggctagtgtcctcattttgcagaaaggaaacatatgcgccaagaatataaggtcataaatctaagtggcagtgttagggtatacactcaaatcacttttcccccagcaatttttcttacggggacaatagctgaaaatgcagtattgctattcatgtttgggagaacaaaatatatcttgcttcctgcagaaatatgtgagctgtacttttgttgctttctagagctggcttatataaggatcctgaactgattcagtttgtgtttttaataaatactttggcctaatttatagttctatatttcaacttagacattttccatttaagtatcactgtctaaaatggagcgatgactgaaattcaagaagtgtcctactttgcctgagaaattcagacatgtatgcaaacttcagagttgggacagtcaggattaatgttcagtttatcccgtgtgagttttcttactttcacatggacatatggtgagagggttataaattcagactttggagtcagagaactcagattttaagccttagtttgctatataccatttgtgttactatgtacaatttcctaaagctctagaatcctaatgtaattttcatgtgttttccttgtgatatattgatattagcacaacgatatcatcccttgtacactattttattcttttaaatgtcctttatcatctattattaaggttgagcttcagcatcaatctctaagtacacagaggaagacatatttccttacatttaaagtgaagataaagcattttaaaacaagttataaaatttgcaagattacatttgaagttagtggctgaattaagacaagtaacggggattgcctccaaattataaagcatgattagatttttactggtaaattaaaaaaaagcactaacattgtagtagttaaacatggtggttctatgtctgtaaaaaagttgaacccagaagaaaaattgccaggtagagaatttagtcatcagctgtagctgacaaaaccaagacaacaattatagggattcaaattacgttgttagtaaacttacagtaaatgaagacagattgatgcactggttttgtctgagaacattctgtgccttactttacttacaggcttaattttatgtaagagtcttaatatgcttgttggggttaagaagtgtatttcaggtgggttttaaataacatacataaatttgtgaaaatggaaatgtataagaagcaattttaagaataattcaaactagtagtgtattcaatattataattttcttcttcaaataaaatgaaattgcctttcttatttattggcaaagattagtgtgattatggagaagatcataacctttttctcaaaaaagtgcctttaatctaattctagttcttgaaattccactatgaaaatgaatgtcttcttgaaatttcaatttctattacaatgaaattattcattgtattggtaacaatgttaacttggtaacatggagagatgaggaagaaatttaagggggtttaagaagtcaagaatgaaattagggctgaaaatgtatattataaatggacagtcattctgaggacatctggtaagaattaattaaaatattttgatgtaatattatttttagaaagcaatgaaacacattggataattcagtgtcatctttgcagcaacattcaagactaacaacttaagatatgtttgttcaccacctacaacgttggttttagtttatgcaatcaaatcccatttgttgatatcaatattgctaatgcttagtgctatggttaattcaatgaattttctacattatttaaaaaataatatttgtatgacttgtttccttaataaattttgaatcccagagagtaaaagcagtatcctttgcaaggaattattttgtattacaatattgtatattacattagactttggaaataaacattccctatgatagaattttaatattgttgattgaacaatagaattcatacctactagggcagggattgatcacagtgtgctagagagctaatggaaatcatctagtatatatatacatggagagtcttattagaaagccattttaattgaataccagatatttactctctgaaccacttgaatgaggtaaattaaatctagctagttcctcaaataaaatatgatcattgtacttcttaacaaagacttgtaagcttataaattatgtcatttcaggtgacttatatgttctatctacactggaccatggaaaaaagcaataatagcactttgtttattctcttggggttttcccaaaataagaacattgaagtcctctgctttgtattatttttgttttgctacattgctatttggatgggaaacttactcataatgatttctatcacgtgcacccagctcattcaccaacccatgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaagtgtggtgttgtcaaatactcctgaaaagaaatcaacttttctgaattgtttctgcttttcatgccgtggttccctgatgaatgagaaaaattcactctcatcttgctcttgtccttaatgtttggagagaaaagtgggcaaacaggaagcatatcccttctgtggttttatacttctacattgacatctctttaacaaattgaacattattcttatccatactctcctccgcctttcttaatcattacgattgtgcttatgtgacatgaaataaccagaaaatttcttaaaaataaaggattacatggcgttgtgttgaaaaaataaaacagattatgtgttttttgtgccttaaagttctgagaagatcaatgaaatattactctcagcttttacatttttactcaagtctaaacacagaaaatgcatgtattgcctgtgtacagctcacgaatttttgcaaactgagcatgattgtgaaatcagcaactgaattaagagacagaaattatcagcacatcagaggtcctccttattcctctttatgattaatacctcccaaagttaaccacaatatttattcctaaaataaatagttttcggctgggcacggtgcctcatgcctgtaataccagcactctgggaggctgaggtgggtggatcatgaggtcaggaattcgagaccagcctggccaagatggtgaaaccccgtcactactaaaaatacaaaaattagctgggcgcaggggcgagcacctgtaatcccagctactcgagaggctgaggcaggagaatcgcttgaactcgggaagcggaggttgcagtgagccgagatcatgccacggcactctagcctgggtgacagaacaagattccgtctgaaataataataataataatgataataataataataataataatgtttttatcttttcttgtactttgaagagtaagagtgatttacattttgttgctgcgtgtgtgtcttcttagtgtttcatttgtgagtcatttctcatgttggtaagttttctgactgttttcattgatgtatacggtatcttatcatatgaatatataatgattgatttatccattcccttgttgccagacatttgcgtggtttcccatttcgggttactatgtatagtgcggctttgaacattttgacacatgtcttttttggtgaatgtatgtcttttattatttcattatactttataatgtaattaaaacaattttaagaaaatagtaagtactatatttgtattaatattctttcataatgtattactgatataaaatgaaagatatttattgaaaaaataattatccatagaaaaacactaagtgaaataaaacatttagaaataaataagtgaaacatcttgcacttctaggatccacacaatggggtatgggataagctgattaatgcaaaattgtctgtcaatcataggaaaaaaggaagaaagctcttagaatggtaatttacacaatgaagcttagaaaaacttccaggaatgcagcattagattatgatagcaagattaagacacaggaatcaccactgaaaaatgttgtcaaatagaatattcattgtagcatatgaagtcacttgccatattaaatgaaactaggaaaattctgtgtttagcttctaagaaggaataaaaaatatacttcactgtactcccaataagggcagtgatgccaaatgaagaaggcatgctatgagtttatactaatactggattgtcacgtgcacactcaaacacacacatgtgtgtgcaggcacataatgcagaaaataaagtcttttcaggaatttatacttaaggcatagttgaaataaatctgctcatatagaaaaccaaaaattaaaagaagaaaaaatttgctcaaaagcaaatgatcacacaataaaaatgacggaatataggtagacattaggttggaaacagctacatcagagcacagcatacaaagactgggtttattgtaattaatggacacaaaatataatataaatctttattgtataaaatagaaaatgattttaaagtcaaattacaacattggtttaaaatttttctaggctgttagaaaacaaacaaaataacttcaagaaataaataaaatgttatttttattagaaactcagtggataaaacatagtagtgtatcctaattaatcagtgaattccaaatagcaacaaaattactcagaacaaagaagagagagacaaagatatggaaaaagttaaagggatattaagagaccttagaaatggaataaatgggggcaacatatatctaccaaacttcaggatttataaaatagtgagaaaataaaattaaagagataataattgacaatttctagaactatgagaaatatttagaaaaaaattacaacaaagtgaaagagttgctctcaaaaagagccctacaaaatattatttctaattaataataatttaaaacacagggtaggatgcagcgactcacacctgtaatcccagcactttgggaggccgaggcgaacagatcacctgcgatcaggaatttgagaccaacctgaccaacatggagaaaccctgtctctactaaaaatgcaaaattcgctcgtgtggtggcacatgcctgtaatcctagctactcagcaagctgaggcaggagaatcgcttgaacctgggaggtagagtttgcagtgagcagagatcatgccattgcactccagtctgggcaacaagagcgaaactccgtctaaaaaataaataaataaataaataaaaattaaaacacagactagaagccagaagaaaataaaattacattttaaaagtgccaaatgtaaaatattatccttgaagtctatattttttcaagaaaagtgaagtggggagtcttcagtagaataaaacaaaagaaaccgcaatttaaaaatggccaagagttcactatacagacacactcacttaaagtagttgtaaatattaatttttattaagaggaaagatgttccaagaaggaaaattaaaaatccaggaaggaataatgaatcaggaaaatactaaccttatttgtaaactgagatattgtgttaaaaatattaatcatgtctaatatataagatgaaaaatagaggagagaacaaaaaacttagaccacaacatagtggaagttgaaaagaagtattgtttggtaggaaagaaaagacactgattaaattcagacttggtaatattaatgtacagatatgattttttcagtaattactaaaatagcaggagtgggagagaaaaagagacaaagaaatgtattattattattttttgagacagagtctcgctctatcaccaggctggagtgcagtggcacgatcttggcacgctgcaacctccgcctccagggttcaagcgattctcctgcctcagcctcctgagtagctgggactacaggtgcataccaccacgcccagctaatttttgtatttttagtagagacagggtttcaccatattggccaagttggttttgaactcctggccttgtgatctgcctgcctcggcctcccaaaatcctgggattacaggcgtgacccactgcacccagccaggaatgtatttttaaaaaggaacaataccattccaaataaaaggcaagaaaatgggaaggaaacagaaaaattgggcaaaagcaaaaataaaagcaaaaaaagatcatagaagccaattaaaatatataagtaaaacaaaattaacacaatgtagtaaattcttcagcaggataatgaaaattatcataatggtttaaaatacagtttgtcaaatgtgctttcacaaaagatgtacctaaacggtcgattacacatacacatgaaagtgaaactgaaggcatgaaaaggataaagcaggcaaatatgttagcatttgaagcaatattgattattgtgtcttaaataattaaatattaattgaatttgcaagatagaaatatttacaaactctaactttgcatagatggagaaggatagagagaatttgatccaaaaccataagcagcattaatagacatatatagaacagtatagtcaacaactaaattgaagggatttatcatattttgtagttaattcttccacagaataattaattataattaacctgtcacaaattaactcttcatcagcattgaataatccacatcacaatctagatctgggttttaaactctttacgaaaattatcttaaaatagatcataggcctaaacgtaaaatataaaactataaaattcttacaaggtaacgttacagataatctagatgaccatgagtttggtgatgactttttagatataacctcagaagtatcatccttgaaagaaagagttgatgatctagatttcgtaaaataaacatttctttgctgtgacaggtaatatcaaaagaatgaaaagacaagccacaaacttgcagaaaaactggcaaaaaatatctgataaaagactgttatccaaaatatacaaagaaatcttaaaacaaacaataagaaaacaaacaatgtggaatcaacctaaatgcccatcaatgatagattggataaagaaaatgtgattatatatatatatgtatacatatatatatatgattttacatatatacatatatatatacatgtgattttatatatatgtatacatatatatataccctgaaatactatgcagccatataaaagaatgagattatgtctttgtcttttgcgggaacatggatggagctggatgccattatccttagcaaactaatattgcatgttctcacttataactgggagctatatgatgagatcacatggacacatagagggaaacaacacatactgaggccttttggagagtagagtgtgggaggtgggagaggagcagaaaacataactgttgggtactaggcttagtacatggatgacaaaataatctgtggagcaaatctccatgacaagagtatacctatataaaaataataaagagaaaaataggaagaaaagaaccagactaaagaaataggctgaagtccttaacagacatctcaccaaagaggatatacagatgacatggaagcctatggaaagatacgacatatcgcaggtgaccagaagaatatgaattaaagcaacaatgatataccactgcatatctattaaaatgaccaaatccataatactggcaatgccaaatgctggtgagtgtgtagagcaaagggaacactcattcattgttgttcgaatgaaaaatggcacagccaccatagacgagagtttagcagtttctcaagtactaaacatacttttaccataagatacagcaattataccacttggtatttacccaaaggagtgaaaaacttatgtccatgcaaaaccctggcattcaggtgtttatgttaggtttctctgcatcaccaaacttggaagcaaccaagatgtctttcagtaggtctatgcataaataaactgtggtatattcagacaattaaatatcgttcagcactaaaaagaaagaagctattaacccatgaaaagacatggaggagacttaaatgcatattattaagtgaaataagccaatctgaaaatactaataatgtatgactacaattatatggcattttggaaaaggtaaagttatcgagatagtaaaactgtgtttggggtgtgggaaggataaataggtggggtgcaggcaattttagggaaatgaaactattctgtatgatataagagtgcagaaatgtctttatacatagtccaaaacccacagaatatacaataccaagaatgaatccaacagaatctcattataaaaccctgttgtgtaacaagaataaaccctatggactttcagtgataatgatgtatccatgtagattcaccagttgtaaagaatgaaatgctctggttggacaatgttaataataaaggaagttatgcatgagtagggccagaggctatatcggaaatatttatgccttctgttcaattttgctgtgtgagaaactagaagtgccctaaagatagtctatttttagaaaaagacagaaaagaggatagaattttatagtacacaaaaacatttcttgattaggtcaaagttaataaagaaaattgagaagaaagttatagaggagacaaagtaaactgcagcaatagaaacttaaattcaaaaatctcaataacgttacatataattatactgcatttaaaagacaaaagttgttagagtaaacgttataggatgtttttcagcaaacactcttctgcaaaggaaaataatgaactaatgatacacaaaacaacatgataaatctcaaaacagtctagacacaaatgaataaatgcttcaatcagtcataataagtttacaattggaaaactaaaattgaatcataaaaaccagaaaagtagttgtatctgggggaatgaactgaaaaggtgcatgacaaaacttctgagttgttgagttttctacatcttgaatttgttagtggttacatgaatatatacatgtgtcaaaaatcatcaaagcatatacttcaaaacattgcacttccttgtatgtaaatttaatctagagaaaacaatgtattacaaaaaagtgttcatatctattggtctcaagaaaaatatggctttcaaatcccacttataagtgagaacatgccttatttggttttctgttcctgtgttagtttgctaaggatgatggccttcagctccatccatgccccgtcaaagaacatgatctcattcttttttatggctgcagagtattccattgtgtatatgtatcacattttgtttatccagtctatcattgatggatatttaggttgattccatgtctttgttattgtgaacagtgtttcaatgaacatatgtgtgcatgtgtctttataatagaatgatttatattcctctgggtagatacccagtaatgggattgttggatggaatgggatttctgcctttagatctctgaggactcaccacattgtcctccacaacggatgaactaatttacactcccatcaatgggattatctttaagaatgctacggcaagtgaaagaagcaagttacaaaaaactacatattgtattattatttttatgtaaaaaaaagtccagagatgccaatctgtagtaatagaaagtagattagtgtttgcctagagctgggggtgatggtgtgagagaggaatgaggagtgattgctaatgagaatggggtttctttttgaggggacaaagatgttgtaaacttagattgtgttgatggttgcccaaccctgcttatgaaacatcaattaattaaactgtacactttaaattgatgaactacatagtatatgaatcatatcgcaataaagctattataataaatgaatgttaaatctattgaccgttgctgtgtatgtactattcttatatcttttattaatttactatcattttcctatcacatgacatgtagctgtcttttttaatccaagtgataattctcatcagatatccttcctttgcacacatttctgttataaaatatgaacattaatattccattatttatatattatatttagcatttgttccaaaacatatttttaaacatctcctagatctcaaagtacattttgcaaagtaggaatagaagatatactgactcgccccactactcatctaaataactgagcagcagaatagggatctccaaagatgttcacatcttagtcctcagaacttatcaatatattttgttacatgataaggtgattaagattgtagataaaaattaagtttgctagtcagttgaccttaaaacaaagatgttatcgtgcactatccatgtgggctcaacgtattcacaaggtttatttaaaatgggaaagtgaagcagaataagttaaatttgaagatgctacactgcctgctttggagatgaaggaaaggggccataaggaagctggtagattctagaagctggaacagaatgagttttcccctacagacttcggaaggattcatcctttccaatgccttgattttagcccagtgagcctcattttggacttctcacctgcagaactgtgaaatactgactttgtattgatttaagccactaagtttgtggtaattcattgcagcagcaacaggaaactaacacactagcttaatcatgatgaatgtttccacaaacctgggcataattgctcttttacttcctactctttatttttcactcatttcttctgctaactccagatagtgaaaatataagtaggatctcttggacattttggatgttgtttgaaataaagaaaaaggtaagataaggtaagaagagtaaagtaaaaaagtcaagcatggggaaagaaactaatagaaataggaagagaaaaagcaagattattattagttttcgtgagtcaaccttaagaatttacaatataaaagtaaatgaattaaattcaacaccatacttattccaagcataggccaaacatgaaccttatcccagctatttctccataaatcagcatagaatcaattaagaagaaaagcaatgttcccaaatagcacaatcgaatatactattttctattacaatatagctttcaagaaagaacaattacaattcaataaataacataaaacagatatcttaatatgttatatcaaatatggactatttaatgcatatagtaaagcatattaattcaaaaacaaggtttagaatgataaaattattacttctcttggctgaattgctttggattagggctatagtcgttaatatgagaattgatcggtttttgtatttagcaacaatttttaaaatttaattttaaaaaattgaacagacactagaattaaagttcattggtagggctgcaatttgattttgactatggaggaagactttggggaaaagctgtctccaaggtcatttatcattttgcatcttcctctttaaatagacctgtaagaatagagaaaacagcatttattgtcaaagaccctgtgaaatggcaggtatcattaggtgagaaaaccaggaacaacaaagactcatttctaccagcctttcagtttggggggtcaggtattttccggtactaattattcacaaaggaattccctaggcatcactgttactttaccttgggaagctgcacccaaattaactcaagaagagatagaaacataaagtgaactcaagctctggaaaatactggtgagatttttttttcttttcaaacgaatacagaatatttgtggaaaaagataattaaattgttagattttgaacatttataaaataatggaaaaatattgttctctgaaatacagagagaatgaaattattaaaatcatgatagtaagatagtaacatgtacctaaacatgactgtgaggaagggtaggatggacacaaataagaaaatgtcaataatttcaaaggaaagtgagtcattatgcccaacatgcccagataaaggaggaaggcatccttgtgatggatattggcttaaggagagaaacagcaagatgttactgcatcagttggagtcaagagaggccatgattcagaaggttaacagcctttactaggatgcacattctgataaatggaactttagatctcaatcctgcaattaagataaatgaatacctgaataaaatagattggtgaatgaaaaaaaaaattcctctagaaccttgtgatatggacggtaggggaaaaaatcctcaggcttgtgtgcaaaagcccagtttcttctagatgagagcaaagcaacataaataattgttgctcaaaactgctatgttgtgagcttccttaagttgaggggctctcttagtggaggatggtatttttcttttaattcagcaggataactgaagaggaatgagcatgtaaaagcaggggatgtgcttgagactgtatctaaatcatattactattactcttacaatcattattttgtaatgcacaagagatagcacacctgtaatgactactgtgccaactctaacatgaatacctgaagaaacacaatcctatagattcccaaaagctggaagtattaggcacgacttcactgcataaggatagctgagagcacagagtttagtaggagttgtcagcattcagctggatggatcttgagaggatctacaggtctctgctagaccacctgtaattggagggatcatttacacctgcggttgattagcgaaagaatcctaaaagctcctttaatcaaaactattacagatacccttttccatccatgtaccaatgaccccattgtagtgcctgaaatttcaccaatgaatattcatccatttagataaatgtcattttcctaaacccattaaaattgtcattcagtgatgatctcttccagaaatataaatcgaccaaattgggagaatgaatatggccagaataaaacttgaaagattagaaagatgtatgaagcaatgttgacattaagggacagtcttctcttttttacacccattttcttcgtttcagttaatagaaaaatgtttaaaaatacaaagcaaagtcagtcctggaaaatcctaaagtattctgagtttgcacatggagaaattacataagacttcactccctctcctttcaaatcaaacaggtcttgctttgtctctagaagtttcttttattgctttaccttatttctgccttcctatcagggttttatgaatatttcatactgacagaagtgatttaagttcacggctgaaataactattaatgtgatatgtaacagtgaaattgaaactgtcatttcacaaatgggataagagaatttctgttaagttaaataatttaccttgggggttacagtagtatcattttagaatcaattttgtgtaattttgctcctctttctattacctcacactacatcttgactatcagggctcgagaccacactggtggaggtgcatacatcatgtgcacaaagatagagtttcatgagaagaacttgcaaaggcaagagtggttaaacttgcagagaaattgcagaatatttgtgagttgatgtgataatcaggcatggcagtattcaaaaggtgaaatgtgggcgtatgttttcacttatgggtcaaaaataaagcaatcatttccagatatttgccagtagataacatagatgttaccatatcccaaaatacagaagttgtttcaaaactcagtgtcgtataaaaaataaaaactaaataaagtttagaaacagctaaataaacattaataaaaggtgagagaagagaggcatgtggtaacatatatatgagattgaggggatttactttatctctctggattttgctttctcacctgaagtgaacgaatgtgatcttatcttgaggtaagatgatcaaaatagatgcatttcaatttcttcaagtatgcatgccaatcagcattttttcctcttttgatctactgtgattttccgttggttctgcgttagaaataaaataaatacagtcctttttatgttttctttttttcaggtaatttaattgtctcctaagaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatagttggacttaataatttaagctagatgaccttaaaatttctcagccttggttaactcatctgtgcaatcaagacaataacaacctcatgggatttggagtggaaaaatgagacaataacacattcaaaagagtaaggtattatttttcattattatagcatttttatactatttcataattagataacttcctgaaatatctatgacacagaaatattattaaacttagaatcacaaaagtgcagaagagcaattcctcttggctttcctttgaggacagatttctattaccctaccttgctattcactggttttatcatcatccctgaaagcagaaactcaccatatgtataaagtggaggaaataaattttaaaaaatttagaatttccaaaagtgtgggaagtgttttcatatttttgggcttaaattgtgaggtttcgggcagtacagtatcactcatatatttccttctaaataaacaatcctctaccctgctgcctaggctatgtatagagtagtggggaattgataaggttgtaatgtgtgctgactgctgacatctggggagcagcaagaggaaagggcctcatagttcacactgtagatttcacttatccttgtgcatgcgtgtttcatcactgtcctccacattaatactgggaattatttagctcagtctttcaaaagaataaacctccaatcttttgtgaagtaatatagaggaattcttacctgtctgtgtagaaaatggcctgtggaaataaaataattttcatgtaatacaatgtatgtttcactcctacattctgtagaatcgtatgctacaagcatttagcatctcaggagttttgcaagtgaactaacttgctagttttctctgtccttgctcagatggctataacttcccccacaatgctaagttaactacttagtaacactgttctctatttctcaaaaaatgtgtgaaaatctttcaccagctggtatttcctgtttgcttttttgtcattgtggattaacatataatttctattttgctcttattttagcaacaattcagatggcagaggaaatacatttttgtggatactttactatgtttcacagagattctattttttaaagtatgcatttattagcttttgtcataatacaatgacaaaagaagagaagaaaagaataaaatcaaaagttacataatattaccatacagatgtcttatttacatgaaaatataaaggaacacatgcatattgaactgtctgaaaactcaaacagttcaataacgtaaaaaatgaaagaaaaacataataatcactttcctatcttttcttacaaacacaccattgttctcagtttcttatgattccttccattaaaaataatcctatacctatattcacttataatttctattttattttatgtttgtagtcacataaaggaatagtataaacattgacacataactttttcctttagagaataatatactctgaccgtcgcttcacgacagcacttacaaatgaaaccccagggtctagtcagattggacgtagatgctctcaccatagcagttacactagagaccatgccagaaaacagtcctctcccagggaaggtcaaagcagccagcagtgtgagagggtgagatgaacgaggtaacatccggggttcgcaattgattgagcatgtggccagagactgggaggtagtaattgagaatgtccttaggattgcgaccagtcctgttttccaaactagacctaaagaaaaacacaactgagaaaacttccttagtgttgcaacaattcccagaaccatagctgatagagaacatcttcctcttccagcacccattttctcacccttgatttctttcacccttggccagaacttcagttggtttgggatgtctgccttgtggggtgactgaaagctttatctataagagtttgatccctagttgccttgttcttatttactgtagttgctgcaattgtccagttacagttatccctggtgtgcaagtgctaagagagattccactacattctctgcattctggatataatcatctctgtcctaatccattataacaacactagctactcataaaaaccagaatcaagtaccctagtaaaaatagtaactatttttttttttgcatgccggtccatttgtgtaaggagcacaaaatagtgttcctgctgtgttcctggaaaatatcttcttctctctagaaaccgggacttctgtcctcatgaatctgaagactaagaaagtgagtttctgggagtgtaaaaaatagaaaacactcactttcaccctttggatctcagaatgatgtatggcaggcaaatggggactccacaccgcatatcaggcatcggttcagcattcaatgcatactctgaatcctgaagacagcatcctgtctcctccagcgctgacttctagctagtcccttgattgagctcttaacaatcctttcccctcttctatgaagctagaagcttacgggtgatgggctatatggtaagatcagtgaattctgagatcatgagaaaattttatatctcctttgccctaaaaggtcctaggcaatctttaagggatattatatcaatgtatcaatctgtctgcaagttgtcaaatgttggtgtagatgaaggcactatggagatgggaggcaaatctatgtctacagtgtctattgtttctgattaggagcaattgctttcactttcagggtggaagaagttttgtataattaacccgctatcagtcacataaatattttcccagagataggcatcacattgagtgctcaggcatggattctgctactggcatgttggacactcagagggggcagacggcagatcagcatttatggtagggagctcgtgtctctgagcccaagcataaaacatccttgccagtatagacactctgtccatgtgcttattgtgccatcactggaatatccttaggctggatcatgtcagagcacagtccatcctcatcgtgtagatagttaaagcctgttctcttgtacatgctttcaagttagttccaacttcaataggtctattcacataactcttttccagatcgcttggtccagtcttctgaccttccagacacttgatcaacaaactaggcatttatcactgcttcaagtcaatgtatatttattacccaggactcttccccttctatacaaagttgaaagcaagaatattattcagggttttgtccactagcagaaattctctaggctacatacctttgaggccaccatttagggctgggatgtcattttaggttaatatcaatgtattgtggtgacttgtttgtgaacctgaacagaatcctttcctcctctgtcagatcatctcagagcattccctgtgaggccatatgtgtgacttgaggaagaggcattgatttaacagagatgagtcatatgagagtcagaactatccatttgttcctgaaccactcttttcttctgatctgctcaggccaagcttttaccagttcaggcttgtatttgttgaattcaaattgttttattccaagtattatattttattctatttatttcatatattaacataaaaccttgaaaaaatttgattattcattttttcccattcctttctctaaattagtgtcaagattatctttttgaaagcagccttcccatagaatataggaaaaaaaatttttcctgcttgtcagagggaatatttcaagacatgataaaaggtattagcatcctagacaatattattccctaaagtttcccttattttgcatattgaaaacaattccaatgttgtaataaatttaacttttggtttgtctatttagcctacaagaacagtaagttaatcttcctcatactcagtaattagatacaaatgaggatgtggaggtgcctcaaggacaccaaagatatgagggagaaagaggaaaaaaacaaacggatggtggagagggtgatagaaaacagaaaggcattggttaaagaagctgtggatcaccaagaaatacttctactcccaccagtgatttaaagttgcccctccctgcattggggaacaaatttttctagcttctgtaatacacttataatttatttgcaagtagtatgcaggaaaggaagtgtgatgtctcaaaacaagaggttctagtctgtgggatatagacatctccctccgagaaccctcatatttatagcaagtggcctgagaattaatatgtacaccaggaacttaatctcacttttttcaacttcatttctatttgttttattaactcaagttagtaaaataacacttaacaaaacacatttttattaatataattttattctaccaaatatgtattgaatgctttttatatactaggctctgtttatcattttataaaagtttgatcttttaatccacataaatattccatgaagtaggtaataaaactgaaagaaaactgaaactcacagaacttaagaagcttgcccaggttgcacacttatctaccctaagaaaatgttgaaaatgacaattaatggccggcattaaataatcaattgctatataagtaaattaataaataagacaaatgaaaacacaatggaagagagcttgggtaatagtttataactaacttttctgtaaaattacctatgcgatggttaaggatataaataaaatattctttctgaactacactaaaactaattatttagaagaatagcaatgtaagtgaggtcgggtcttgagatacatcaaatgctccagtagaaatctctttcactgatacgacttagcacttacaatcaacacgtcaaatgagatgttgaaaatgtcaggatgcgcctattatacagtgcaatatttttcataatatggtatggaatgtagtctcaataaggagaaaacgtgcaatctttggtggtcatttgctgtttttatgtacaatatctaaatacttttgcagatgcatcctgcctgcctcgtaagaacactaacgtcaagttgtggaaactctcttggtgggctctgaactctgattttcctctaagtagccgtaactttgacattttcagtatatctgtgtaatgtttggtttgggttaatttcttcccaagggtgttaatatgactctcgctagcttgattataaaacaagtctcctaggagttaatctttggattgaagcattattagcaaacaaatgcaaagtcaacacatttttctggactattgagagaaggcattttctttttcctaatagagttgctgagagtacagatacaggactcctgcttataatcttaccaagagtgaaaaaagtcaacacagaaggaagcagagccaacagataattagaaggaaccagttcttataataaaattttaacaacagaatgtacctattttcaaacaattttatcatatttgttttctgttattgctttttacatttatttaactactataacaaatacatgtaaatttactatccataccaaaacttaaactgttaccaaaaattaaatccatttttaacctcttttctatgctgtcccctgtcttacctgaaaggtagccaatatcctgattttgttaatgcataattctcttattgcttaaaaataaaatatatttgcctaagatggatatgttttttaaagatttatctggttttgaattttaaagaatttaacatactatatgtagagttttaggcatagattttactttttattcagcattaagttattaagttttgtattggttattaagcataacattagacagttaacaaaaatgaccctgaaatggaagcctgtgcacaatttgtaaggattaggctctgaaaattggaatgatcattctagttcttgataaccttacaagttgctggacataaaggagtcaatgtgaatagaatcactttttatagagtggagatgtgttatgattttttattcattttgtcttgaggtctctctcctgagagtgcccacagctccagccctgctcagaccaggaattcaaaggatgtagacatggatatttacaatgtgccttttgtggatacttctttgtcctggaggagagcccagtgcctaagtgtctgactaggatcgagaatttcctctcacaggaaaactgtactagcagatgtccttatggctcttgtctgacctgtgcccaatttattcttaccaggactgccactttctgtgacagccctgactggagagggtgggtgtgggtgattgtgtgtcagatgaaacacaatgaagaagtgaaaccaaaatgcatgaaacagaagaaaggtatgactcacaggtttcagagaggtgaagagtgcccacaggagtctgaccaaagtccagaggcagcagggggctcaacaaggggaagcaagaaagagaggatctgtgggtttatgcctttattaaagtccatgggcattatcctttaggttttcctgcgggggttgtgaattgtctaatttaaagaagactggtaagtaaagggaggactgatttgcataactctgacactgactattaggttttatcatagccagcaattgtgagtgtgttgggttgtgggtcagtaagtgagtaacaaacaggatatgtcacaaacagccaggccaaaggtggcagagtatgactgggttttagacaatttacgctgggcctaaaaataaatgccaaagaagcaaccgcattaaacaaatttatcacaagaaggagtgcaagctataaggcattacttccaaaatggtaaaatattacttaaaaatgtcagttatgaagaaattggaaacaatttaaataaacagttttgcctagatgcatattttctggtcaaaatggcaacttcctgggttcacatatgactcctgtgttggaaatggaatctagagatgagatttgactgaggtttctgccagtttgtatgttctagttactgtaagattgtggccattctgcaattcaggtacagatcacggtgcagaaacatgatttaatggttaatactgtgatctaaatttctgcttgtggagaagcatgtgtgtctggccccaggggtgttcttgcccctgagaacaccctattattgaagaaaatagatgggaattcactggattacatatcagattctccatcagtggagaactggcctcaagggatgcaactagaatgatgcatttgtgacccatcgcagctgctcaaatgggcaaaacacattcatacagccctggtcagtcactcagtggagatcatatattcatgatctacctactcagaaatggatcgcaaactttctccacattcatctaaaagggcagtcaactggaattcaaaaagaaacatgaaatgatttggtaaacgctgtacttagatacctttttagcaattgttcttaattggagactgttcttagttataaacgtcttggtaacccaggaaagttatttcttcattattaggcttacagatttttactgcttctgctttaaaactttctttgaaaacacttgaaatcctagttctacgaatctgaccaagatttaataactgaatgacttttccccgatttatatctggaaagcttatttccacagtcgggaacatcaacttgaaataaattcacctggttttggacttgaagaagttatttcatgtgaattaattttgggtgtgataagatctttcgttatgactcagatgaccttagaatgtttttacaactccccacttttaaatggctataaaaactaagctctaaaattcgtattatttggttaaatatttagcacatagattttagttattgcgtagaattatagcatacaaattaccttaaaattattagttaaattaatttcattaagtatatacatttttaaaagtatgtctcttatatagtatgtcagtaattcacactgaatacctgtttgctctaactttaagcaatatttattcctgaataagaaaattcaagttatgaactagggtttctactaaaattattacttaagatagaacacattactttacttgatctacttttgtaccctttgagcaaattttttaaaaattaaatgagccagactctaagaaatgaaaactggtaaataaaataatatgtgttgatttccaaagaatgctcatagtatccaagcaaaggagtacataacctatctggaaatagttactaggagagtctacgatgcatttttcccctaatttcactttcttttttctcctcctctctttctccctctcacctccccatatctcctcttacttttttttttctctctgcctttgtgtatgtgtatgtctatctctatagctatatatctgtatctctcactttcctttcatttctttcctcttctcttcctcctttctatttttgggctgaaggccctttaattcttttgtactattagtcttcaatctctgatttttaaaaaagtgttgctttgcttaaaatgtataatatataactaatattgtatcagattggtggttttaatttaataatgagttcaatttttatgtttctctatgtgtcaaaacataactactaaatttagttataagtgtatctaccaacaggaatggctatagagatggtgatggaactggtgatggtagtggtgatgctggtggtttagtggtattgacaatacactgacaacttattataaactccaatttcaaaaattacaacattattaccacttctattctttaaaattctattagagttagctacattgtcactagtccctagttttatgaaaagagaaaggaattgggaagttatttgcattaagagattgttttgaagtccttcagtgataaatcctagtggctagttgaatagtcacagagcttaatggtctatctaggtactgaagcattcatttggaaaaaaatattgcatatgtgtgtgtgtgtgtgtgtgtgtgtgtatatatatatatgtatgtatatatgtgtttatatatatttatccaaatagaattgagaaagaaagatcagccacagaatcaggttttctggaatttaaatcctagctatatcactcattaactctattactttgaggaagtgacaaactcactatgataaattctaattattgctattaacattgttttttaaaatgagcatatttataaatctacttagactaaaataattactgtattttatctagtaatatatgtttgctgaacaaaattctgatttattttattatatacaatgcatatctattagatagtaagaataaaaataataaaattgaaaaataagaaatgtaaatagaaaggaaaaatgtctttactacattattgctgagaatgaacattttgggagcaaaatttggcaatgcctattcaagttttaaaatgttcatattccttgattctgcaattatattgttaaaaattatcttacagtaatacaatttattcaatctgtgtatatatacatgcatgtatatatgcatatatatattcaaattgcatatatacacatgtgtatacatagatacatataaacatgtacatatacaaacaatgtgtgtgtgtatatatatatacacacacatgcacacataccatatacacaaacttatgaagattttcaatgcagcatagctaaaataacagaaaatataaataatatagatcttcatatagagacatgcagtgctatcaataatatttattaaaattagagtatatatgtgtatgtattgggacctattgatgtgtaattactaaattgcatatacaaaatcctaatttaatatttctaagtacaaatgcacatatgaaagaataagtcatccttaataaattgaaaagtgttccagaagtcaaaattagaacctggtgtatgtgactcacattccttgctctgtgttttacactgcacaaagtccctttgtccctcctctgggcctttgtacatctgctccacctgctgggagtagcccctggtcttactttatcttagccacagtctagctttaaggcttaaatcatttcttttctttcatttctttatgaaaacagttcagttatttctattcaacagttatttctattgtcattattttacctgccctttatttaagaaaataggtcacatttgacaattttttggattatctgttgtctacttaaattagtaggaaaagtgagggaactatgaagaattaattataattgcctctgtctttcctagaacagctctttaaaaaagaattccttactacctaccgtgcaagaacatgccatgaaggtggctgatggtgtgattcaagattgaactggaagttcaaggtacagtttaattattgatgtaggctgaattgtctaggaatacacagggtaaaagatgacagttagaaaatgtcatcattgagcttattggatagggaaatagcaaccagactctagaagagatttactttcacacatggaggatgggctggcaccagcattatctatgtcccactgctcactgcagtttccttccaattgataaatgatattgatgtccactgcaactttactattcccaggaactctgagatatgtggaagaagtagcaattcttaagcatttgcttatggaaataagagaaacatgtaataaacataaagtaatgatatatagaaaacacatcttgtgagtgggtggagaaatattcagactggtgaaagtggcggtaggcagtggggagaattggttgactgagggcatagacagaggcactaggcaagcctggactttacagacatgtgacatgatcaggaaaaccaacacgaatactgcactcccaccctttatgggtattacctccattagccttcacagcagttttgtgagccatcaggtgaaaatactggggcgctgtgaggcaaaggagttggtagcctgggcatcggagttagtcacatgcctgcaagaaactgtgaggcagctatgcaatttctctaagcctcagttgctgcttcagaaaatccagtcataatacttatttcatatggccgttcatgataatcaaatgagaaaaagatgtttagtcattgcccataatcagtaagtaatacaaacatggtagctatggcttctctttcactaattgtgctgttgcagaaattgaggactggggaggttgagattacaaagccagtatgtagcctggctaggacttagaggtaggtttgctgtgtctgaattcaggaacataccctttgaacagaagattaagtatggaaaaaaataacagggtatgagtctggcaggaagtaagtgggactgatggtggaataaatacagtgaagcacatgagaaatgaagtccaaacagtaagagaaaaggggctggtgatgagacctgaatgtcagttggaaaagttcaattctgttccgtatcaacacagggtcatactaggtcccaaacttaaggacagacagggcatatatattctagaatagcggctttcatttttctgaacatgaaatgaacaacccctctaaggaaatcctacccagagacataaacaattaatgcaaataacaactgagtgtttgtgtttgaagaggacagagccagtcctgctgatactcatctaggaaaccatccttatactgcagatgagaaaaccaggtttcggagatgccagcagcatgctcaaatacagattaagttagtgatgcaaagtggaataaaatctacttgtcatttattgactcccaagccagcgttcctttaacttcacaaggattgttgcaagaaagtactcagtcctggggctagggaggagaggatgagattaagtaatatatggcacttccacagtttcctgtggttgttctgcattcagtgtaagggatgggggtggagtgggctactgaaaagcaggagtgacttcttagcattaacagaggggcataatccaaatatcaatgtgaagctttgctttttgcaaaatttcttagatgtggcatccaggtctgctttatagtccctagtaatatgaggcattctttactgcaggtttttctcttggttgcagtagtaacttccctgaaatacaatctattcttctcttctcatgtggtgggatatactaggtatgaatcgaagccgtgtgagcaaaatgccagctccaccacaaaatagttatataatctcgtgcaagatatttaactcctaagggctttggtctctctttacgatgggagtagtataggtacctacctcatgtggtatcatgaggtttaaatgaaataatatggctaacatatctggcatagtgcccagcagcattgttagcctaaaagctaattgcttagttgttgtcattatgctctgaaatcctttgttccatttaggaaacagaggaaactgaaaggaatgactcaggctaattcaaggttcaagtcagttgtattggggatctggagttttgctgaaccatgatggtttataatcttcattactgaacaatgaagtcagggattatatagtaactacttttaggtatatgatgatcatttaaaatttagaagaaaagcacacaattggaaaagaatcaatatttttttaaaaagcacaagaataacctacttcatcacattatttttaagataagcaggataataattgtaatatacttagcatagtgattggtgaatgataaatctcacagcataattactagagaagctgtattgatatttgagggtactgattccggcatcagaatataaggtccaaattctagcttcactactgaagagctatgtgaccttgcttaaggttcctaaactgtatgagagtacgttcctgtttctgtaaaacaaagccaatcatagaattattctaatgcctggaataaggaattgcctccaaggtgaggtaggtgctaaaaaagttatctattaataataactattataaaggtaggacaaggaggaaaaaatctatttcacatagaaacacaatttagaaagggaggagaaaaggcttggggaagccttgcataaataaagtatttcccttttaaattatttatttagcacattcttagaagtcaaatgcctagatggagaatacatgggtaaaaacaaagaacaaattccctgaggtcctggaaatacaagaagccaaattagtcactaattataaatcatatcttgcttatttaggattctcaactctcagctggaactcatatcaacacctgagaaatggaaaatcaaaacaatgtgactgaattcattcttctgggtctcacagagaacctggagctgtggaaaatattttctgctgtgtttcttgtcatgtatgtagccacagtgctggaaaatctacttattgtggtaactattatcacaagtcagagtctgaggtcacctatgtatttttttcttaccttcttgtcccttttggatgtcatgttctcatctgtcgttgcccccaaggtgattgtagacaccctctccaagagcactaccatctctctcaaaggctgcctcacccagctgtttgtggagcatttctttggtggtgtggggatcatcctcctcactgtgatggcctatgaccgctacgtggccatctgtaagcccctgcactacacgatcatcatgagtccacgggtgtgctgcctaatggtaggaggggcttgggtggggggatttatgcacgcaatgatacaacttctcttcatgtatcaaatacccttctgtggtcctaatatcatagatcactttatatgtgatttgtttcagttgttgacacttgcctgcacggacacccacatcctgggcctcttagttaccctcaacagtgggatgatgtgtgtggccatctttcttatcttaattgcgtcctacacggtcatcctatgctccctgaagtcttacagctctaaagggcggcacaaagccctctctacctgcagctcccacctcacggtggttgtattgttctttgtcccctgtattttcttgtacatgaggcctgtggtcactcaccccatagacaaggcaatggctgtgtcagactcaatcatcacacccatgttaaatcccttgatctatacactgaggaatgcagaggtgaaaagtgccatgaagaaactctggatgaaatgggaggctttggctgggaaataactgcaatgctgagaacatcatgtatttcccaaaaggagaagtcattctttcagaaatgtgtaagagctaaaactgtccattcctcggtggctgtcaaaggaagctttttttgagacagagtctcactgtgtcacccaggctggagtgcggtggcactatcttggctctgcagtctccacctcctgggtgattattctgccttagcctccccagtagctgggactacaggcacgtgccatgacacccggctaatttttttatattcagtaggatggaatttcaccctgttgccaaagctggtcttgaactcccgagcgcaagtgattcccctgcctctacctcccaaagtgctgggattacagacatgagctctgtgcccggcagagaggaagcttttaaaattgtaaaactgggtttatgattcagattctgtgcaaattagatattatgatactttactgctttatacccttccctagcttcccattgtcttagaaacaaatatcaataatataatatatattcaataatttaatgagtgatgtgattagaagtttgaatcaataggtgaataaattgtataaggaaaatgactatttgaaaaagagatatttaaaagtatttcacaaagtaaataattaagtactacttatgggattttatttgtgtaggatacaccagaaacaaagaaggaaagatacagagtaagctaaaaatattttaaaaatctagttacactgaaggtgggggcatgggagatagtgatggagatagtgatagagaagtggtgtttaaagacaaccatatacagtcagccctctgcatccacgggttcaatatcaaccaatcacagatcaaaaatatttggggaaaaaaaacccaaaaccaaaaaaatgacaaaataacgataaaacataatacaaacttaaaaatacagtatagcaattatttatataacatttaccttgtattaggtactacaagtgatcatgggatgatttaaagtctacaacaagttgtacactgggcatatgcaaatactctgccattttatatatggggcttcaatatccacagatttcgttattcacggtggccctggaaccagacaccgaggggtcactgtactcccttgtaatgttctcctttgataagtaaggcaagtgcagtagtttatcatttgtgcaattaatattaaacatctttagaagataacatgaaataagcctgattttttcttttttaagaaaacatagtgcttaaaatttccagacaatggagttattggtctcccctattgctataagtaactgaaacctagacaaaatatataagacacctgtttttaatattaggcaatatagaactggggagtcccttagagaagggaaactaattaggggagtgctaggactgccgcaggcttctgctaggggaaacttctggaccatggtctaggcacggagaagccaacatgtcatcacagttgaaacagagatcatagcccagggtagcagaagaagctgtaatctgtggagcagagtactagagaggaaggagctacgcagtcttcacagggtccagtgcagcctgagatagttgctgaatactaagaatactaaggtgtgcctgtgtggagtgaaactcaagacagactaaagaacaacaccactcaacatacatgttccttgcaatttaggactttgcctgacctagtaacataggggcaagctgaaaacacatcatcattttgtaactgaaagacagacacctcagttgccctggcagaagacaaaagatattggagacttgagcatgtttattgactcagcctaaatgtgaaacacattatctccactcacatgtcttgcatttccaatatgaagacatatttcatatatctacagtggccaggcagataatttctaagatttttccacctaactgaaagggagcataaaatatagcagagcatatggaatatttcctgtgagttactgtctccagtataatgtgttggtgaagtgccaggttttaaatgtgtctttctcattccaaagtttgaactctttcaaccaattttattaagcaatatgacttgagaacctcaacttggttgtttcatagagatgatccctgcttttgaacaatggggaagattcaaaaaatactttaaaatgtttcagtttatttaaacacttttgatgtgacagacaaaggtggtagcagatgcaaataaaaccaaaaatagtgacttatatctatagagcacttatcatatcccaggcacttttctaagcactttataaacattacctcctttaatcctcattacaaatctataagttcactactgctatcaatcattttgccagagaagcatctgaatccagaaagattaagttacttgcttgataaatcgctaaaccaaattttaaacccagtttagctccaggcttgtaaactcatctgtaccgagaccttgggtacaataagtggaagagatagacaaattaattgaatttaataggtaaaatcgtgtactggagaaggggtatgagctaaaattaataaaaaatgatggcaataaaatcttgttttcaggttcattggcatataaactgtgggagaaaaacaatatccacttaagcagaatcagcctatggaggggagaatcaggaaaacaaaacaataaagaagatgctcacataagagaaattatggagaattctatttataattgacctgagatccacaagatataatgaaaaaggatttgggaaattaaagctatcctggaaaaagatagtttatattgctggagggtatttcaaatataaagttaaaacattttcttaaaaaaataggcagtccttagttaaacaaacattcatgtattttttttttcaaatcccagacactcatacaacacctggacttgctattgggcttttgacatggcatattctataagaatgtgggctataaagacagggcttccttttcactgctgcctaaaatagttctcagcaataatagggagtcagtaaattgaatttaattttgagtagggaatatttctgtggacgctgttggtgacaggtacctgtggcagagactgctaattgtccactaaagcccattcttccctcctctgcagcaatacaaaggtaaccacctgagcagtgcctaccttcctcagcccctatgcatctaggtgtagctctgtgactaagtttttgtcaattggatgtaatcagaggaatatgtgtaacttgcaggctgaaatccacaatgttggacgtgtgttcctcaagatcatagccccttcttgacacctaataccaggctggtggtgtcacagttatagataaccatgccatgtggctatgcttctcagattggtatgtatacatgaaatacccagggttaaattcagattacaattcatcaggtctagggaggggcccaagattgtgcaataattccagcatgtggctcacactttgaccctgaaggccctaggggtgatcaagcaagagtttgaaaggaacctgagtctctgaatgaaaaggaggatatgcgctgccagcctggaccatttacatgggactgttgcaagcaaaagagtaaaaaagaataaaatttctatatagcactaggtcattgtgtttttcatttatacaatgtagcattactccaagtagaagagaagtcagaatattcatgagaccattcttttctttcccttttttcttttattaacttttattttaagttcaagattatatttgcagatttgttacataggtaaacttgtgtcatgggggtttgctctacagattatttcatcacccaggtattaagcccagtacccaatagttattttttctacccctctccctcctccaaccctccaccctcaagtagacccctgtctattatacccttctttgtgttcatgagttctcatcatttagcttccacttataaatgagaacatacggtatttgattttcttttcctgcattagtttgctaggataatagcctccagctccatccatgtccctccaaaggacatgatcttgttattttgtatggctgcatttgagaaatgcaaatcaaaaccacaatgagattatctcccaccagtcagaatggctattatcaaaaagtaaaaaaacaacagatgctggtgaggttgtagaggaaaaggaacacttatacactgttggtgagagtgtcacttagttcaaccattgtggaagacagtgttgcaattccttaaagacctaaagacagaaatactatttgaccaggcaatcccattactgggtatatacccaaaagaatataaattgttccattataaagacacatgcacatgtacgttcattgcagcactcttctctttacaatcctgtattcctagaaggaggatagaaggaggaaattctgatatttcatgttacagacaaaagtgaaattccttactcaacattctgagtatttttccattgcgttaactatcaaaactcataccaataatgtttaaagttcatgaaaatgtatataatgggagaaagtttcaggaattacctgccagtgtttcatcttcttgttgcttcaccctggggcaactgtgggtaagggttaagtattcaatttgcagggaaacactgaattttttaattccaagagagagacagcctctcatggactgcttcattttgacaaaaaaaaaaaaaaagccccttcaatgtaagccagaatgtgagtttataatggactataattcatgcctgcttgcttcttatcctccaatcacaatatagcagtgcttaaagccatcaatatagcaattacacttgaacactgaaattatgtggttatgcctggttataaattgattgtaagatgactcagaacatacttatatatgttttgaaattatcatttaaatgaaaacttaaagtgaaacattcttagagaaattagcaatccctagtattatgatctccagttaaaactctttaaaatttcaagtattcaataacacagctaccacaaatagtaaatgaatttctattatgttcaaagcatgcgacatctggtttagaataaattcctaatcaaaatagacataagactgcatcaatccataggaacaacaattactgttttggtaccaggatagtaatgagtgtttcttaaagaataacatatttaattgtgtagtagttcagtgaaaaaaaattatgtatataaatatccaaatatttatagattaatccaaattcttattttttttttttttactggcagacttggtatttcatgactttaaaactaaaagcacagtttctgaagattaaatgaatttttctctattcatgttatttgaaaagagtataaggcaagtctttttactctattggtatggaacattgagactgaaatttgagaatattgttttaaaatattgaagtttttcccattgccaatccggcattacctccacaaatcataacttattaccatatgtgtacaggatgaaatattaagtgttatagtagttaaattgaaagcctaatactttgtaatgattccatagcagagagctgctacatcatacatttagttttataattatagtggtatgttttacaaagatccgagagtctattacctgtcataagctgagaagtatggtagttcctcccactgctatcttctctaatacatgccttcttccttattggagcaagcaataaactgagtaagatttagaaaatctagttttcaaacttctaaagtttattagttctttgatctaggaaattcactcagttttttgtaattggttccttctatgctgagaagaatatggttagattaggtgggtattttaattattaaatcatgctcatagctagacacacttattatttaatatttcttttcaagatcacttccattttatataaatttatattaaagaatgctgttaactatgacaatatatttaaagaaataagaaaaagttatcaaatgttataggactagtataactttttcataattttgaggataatacctgatgtctttgtgttaaaaaaggagactaaaaagtattaaagagatattgacagaaaatgatcaattttgactttcccttcataatgttatcaaagataccgagctaaattgaaacaggaattatactcttagtgtagtatacaatgtattctaaagctatatctgttaaccatcaaataatcttaaatatcactagtaatacagctacacaatttagaaaatgctgaacttattacatcatacatcttattgcactgaacagttttgcattattaataatttagtatctgtggagtccagatatggttgccatatctgatctaggagtaaggtaaaaagtccacatggatgctgtgtaattcctcaagaatgaagagaatagaatttggaaatgcatgctgtctgtagtacattcttccattgcctttgtgtatgtccagccctgatcatatacaaaataacatgcaaagctgaaaaataaatcatgcaacatataacaactgagtacgtcctgacgacagtttatcttacagttacattgtgtgataactctatcttttattgacttttggtgcctataatttattctagtacagccagaacacacattgtgaagaatgcaaatgacctatgcatttatgttttctttctttctttgcagcattaatattaatgactcttgagtttatcttaaaacattatcttttacagtaaagtttaaataataggtataaacaatatttccatttaaaaatgtaagtaactgacagaaaaactccaactttttgctgtattttcaactatattttgccttataacatagctagcaaagttattttctcaagttcaatatgcagtgcccaactcccaaggcccctgcacttgcatttcaaagaacattgcccactaatcatgcagctcagtttaggcaaattttttagatgtaaatgcattccttgatcatgtgtctgcacacggttcagggaagtgttacattctatgctgggagaagggaaaattacctaaaatgaaaaccctgttatgaataaggaacagaattaaaaattataaatgaaatttccatgtgcatttaattaatttttgttgattctaaatgttacaaataagaatagtgatatatattgttctgaagaactagtatttttttaaatcattatattttcaaacaataaagtatattcttacgttactaatgtgacacagtatttggaaaaatgtttcaaaaactattagagaaatcagttatgatttctaagaacaaatatagttaatatattgattctgaattaacttcagtgatttgtgtaactagattccacgatctgttgatagttttacatgattgtgattacattgtaaatgttttaatccaaattcatttttccctagatactttatttttgcatagcacacaacatatggaaagtcaaaggaacatataaaaattcatactcatgagcctttcctctatccagaacatacaaatatttgtttttgtgttcttattttgtaatgttgccatcttggtgggaaactttctgatccttatctctatttgatgtagtcctctttttaaccaaccaatgcactatttcttcaggctatatgaatatctactatacctcctgtgtcacacccaaaataattggtgatctagtagtgggaagaataaacatctcctatgataggagtctttcccatgcacttctttggaatcattgaaatcttcatccttacagtcatggcttttgatcactatgttgccatctgcaaacctccccgctacctaattatcatgaataggacaaaatacaatactctaatctcggttgcttggctgttggggctttccattctttgtttcagttttctatgaaaatctggttgcctttctgtggctccaacaaaattgatgactaatattaagatatttttcctttactgaaagtcgcttgtactgatacctgcatcactggtgtcctcgtggttgccaattctggaatgtttgccttggtaaccttgttctgtcgtttggctcttatgtcattatactattccccttaaaaaatcattcagtagagggaagatgcaaagccctctctacctgtggatctcatatcaccatggtaatctttttcttcgaaccttcaatctttgcctaccttagaccttctcacttttcctgaggacaaaatatctgctctgttttacactattattgctccaatgttcaaccacctaatctataacctgagaaatacagagatgaaaaaggccatgagaaaagtttggtaccaaatatcattttcagaagaaaaacagctgatttgtcctacttagtgtactaaagaactttatgcagcaggaaaagtgtacatgtctccaacgactgctgttaggttataaattttttccttttctagtttaaaattttactgtggtaaaatatgtataacataaatttaccattttaatcatttaagtgtacagttcagtggctttacattcattttgtggttcaaccatcatcaccatccagctccagaactttttcttctttccaaactaaacctctctgctctttaacactaactctccaatgccccttcccccagtttctggcaatgactaatctcctttttgtctctatacattttttattaatacataatagtggtacatatttatgacctacacgtgatatgttgatacatgcatacaatgtgtaatgatcaaagcagggtatttatgatttccgtcacctcaaacatttattatttctttgtgttgggagcattttaattcttctcctccagctattttgaaatatataataattaaattattgttacctgcagtcatcctactgtgacaccaaacactagaatgcatttatctgaatctttttcagtctttacgtaccaatatatatcaccatttccatttataaattccagttttgtgacttaccgggaaagattcggttgtgtccaaaattatatctaaaactctcttggacagtctcatccactcctaattttctacaagttgtttcatcacgaatgaatgatgtctttaatcaaattatttttctggatctattgagatggcaacatttagtttccttcttccctttaatctgttaaggtggtgaattatattgatttattttccagtgttaactcagctttagcttttctaggacaaacacaacacgaaacatacattgataccgaaactagacaaggacaatttaagaagaacaaatttcaaaccaatttgtctcatagacatagaagaaaatatcctaagacacattcttggataaaaaacaaggaatatataaaatgattctataccatgactgagtcaggttttaaatctttgaatccaattcattcacttataattgccagaaatggactgaagtgtatcagcaaaatcacaatttcacaagtgtatctgaaatttggaagagtatatatattttgaaattattctgggctagaggaatgctgtctatgtcatatagagtaagcaattctgaggctgatggtgtatttcaaaaataatctgcatctgaaatttgcacatggaaactcgaaaacctttctagcattctgtaagaatgaagtagactgaaagtggttttcagatattaaaaaaaatagtatttttattattgagctttacttccggagaagatagtcaactaaatcttacatgatgggcactctaatataaactatgtaatgaaaaagtacacagggaattttgcttaaaacgtggaaaataaaagatggtcaaatctgtcctctgtgagctgcaaaagccacttctccattatccttttaaagcatcactggggccaggcgcagtggctcatgcctgtaatcccagctactcgggaggctgaggcgggagaatcgcttgaacctgggaggcagtggttgcagtgagccgagatcgtgccactgcactccagcctcggtgacacagcgagactctgtctcaaaaaaaaaaaaaaaaaaaaaaaaaaaacagtaatacacacaaaagagaaggaaagggagagaaaattataaagaagtcaatttatagcaaatttatattgaaggagtatatacatcataattgggacaagtcaccaataaagaaatgaatatcgtgttaggttttaccacttctctaataccaagtgttagaaaacattgtagtaatgtctacagttttctagagaaaaagggttgagaatgataaactttatttctagtcttactgtctttaataagtgtaggaaataaaatgacatcttcacatttgtttggcttcataatatacactacctacatgtcgttttgaataaaaattctaaaaagtatttttactgataaacattcaccatctttgttcatatcatgcttgatgagtttaagtcattcctcatttttgtgtcatagcctacttatgtttacactgatccctcaaattctactataaatgttgaaacttttctaatgcaaccagcctctaagaaacctttaattcccactttgatggtgttagcaagtaaaaggaattacttattttatagttatatttcaaatttggccaatatactattggcacaggaatttcattaaaattttgcatttcatcactcagacagtaattccttaagcaatatattttctaccaagaacttaatgcacaaggaaatatttttttactattatttaaaaattgaggaataaaaaattcattatatgaaagtataaaatacatgcaataaacaaatttgcaaaaattcaaagatcaaatattatattaaaacattctaaaatattggatgtaattattattagaaagagaaaaagataaattttttatttgtatttttcaagagtagtactactctgataactagaaaagtagcttaaaaatgcatgtacagcatgaaccaattttgttttatcaatgtgcacacatataccttaataatgtttgcctcaaactagagggagaatatattttatacgcattttttaattcccttttttttaaaaaaaagccaacatagaaggataaatgtagattttttttcactggagaaaggagaattcatttgagcaaatgaatgagaaagtaagtctgcaaagttaccaatgcaaggaccccaaatcagagcttgaagagtatctgtagggccagagaaggggacgatcagaggggatctcatggaaagacctctgtgtgtttagaagagaaataattgtgggaatgctacatagactggaggagacatccagaataaaagtgtagtaatgtttgaaaaaagatgaccttaggagtgttggaaatagactagacaaaaatagaatacctagaatgactttcaaattaattctttggagtcaaatcaagccccataacctgccctaggcagctttaatgccttggatatggctttagaattgtctgacatgtttttcacttctacaaattattaaatatctcacataaagacttcagaagaaaaaagaagagacagagagaattacagtggaagtatccctgtaactgtcacatgaatcaagaagcagactactctcatgatctccaaagccactcgacatcctttctggcctcactccttcccttctccttacactcttagagcccatctcatcaggtcactgggaagattaaaccagagtgcttaggatatggtgcctaataaatactcaacatgcatttgccatggtttattctgctcacatagcacttggaagtcagctctaacattatatatagagttaaaagaggaaagaaaagaaagaaagaaatatgaaaatgatgtaagggcttgggaaaaaattaaaacatgttcttttaaaaaattaaaatatgttctatatttttccaaattcttttaatggaagttttacatatccacacaaaagaatactaaagtttgtttgtttatatttttctgaaattctacctagcacttgtaaacaaactaaaacctattatagttctctcagagaacacaatatatacattttttgagggaagatgaagaccattatctaccataaaagcctgagatgtccatctcccttcagtcaatttatggatattatggaaataataagtccttccgttaaaaaagttcttttttttttcatcagaaaactccctatataaagtgcaagagagttcagtcattggagcccccgagactatatgattgagattcctaaatcacatgcaaagataattgcagcttgcatactatttataatccagattctatcctagctgcagcaagcctgccaacttgaatctaaaggaaatggacttggtgagcttaccatttcagaaagtaaattcaaacaacttgcaaggaataaccaatgctctagaatgaaaggaacacagttttaaaatttatactttaagtatttagttaatcatatgagtctggacatctctagaaataattttagtgatgcatatatagattgtgttttgccttatttggatattcaaattattccacttaccttcaaactgttgctctgagcatacgaattcccattgtaacagctgtcagttatctctaaaatgatacactgttgtttccatgaattgctaatagactgagctaagtaaaatatggcattcaagaagctgaaatgaaataatctaaataacaggagaatgaacagaatttcaatgaggacagagagaaaacactggaaaggaaggaacaggaatggattcacaacaattgaagcagaacaattgaatcagagctactgatggttagtgtacaatcaaaacaattacaacatatgtggtaaattatttttcccttcctattatcctgcctaactgtgtggtctttgttgcatatatttttgtctcctttttatagaacacagactgactgtcagttaaatttaaatatagccatcctctcagaatttgatagatcattttttttttagcttagggcagcaatacattcaaatagttgcccaatgaggatgtaacatgatgtcctaaagggatagatagatagtgatagagaatgatgcttaactgggtagcaaatttcaaacaaaaaaaatacagtagtagaatttctggtagaatgtcaacaaagtattgatcaagaaaaagcgtgattcataggttacaaagagaacatatggacataaagatgggaacagtaaacactgggaagtactagagggggcaaggattgaaaaactacctattgagtactatgctcacgacctgggtgacaggatcattcatacctgaaagctctgcatcacaaagcgaacacacataacaaacctgcgcatgtaccattgaatctaaaataaaagtttttttaataaaaagaaatgagaagaccataactgaaaggacatgtaagatcactgcaataaccactaccataatcattattcctcattcttctaaagaaaaaaaaaaaagtccacccaagaattaaccagtcagataccctaggaaggtcactaaacaatcaaatggaaataactcaaaattgggtctgtgtgtacgttatcctatttactttgttccctgcccttgttgcctgtaattaatgtatggtaatgattttaattattgaataatttatttttataatattttaagtcattgaagttatttattttaataattcgacaagtatttgctgattgttgtgtaaatgaatggtagcctgtatttcataagagacaaacaaaaataaaagtcttggaaataattatttatggagtggcaaagatggacttattgacactttcatgcactttatctagttaattacctcaataaaactggaaataaattactcatcagcagtatactcattagtaatacaacaatctgagaaaaaagtattacataccccaaattacacagatcacggaggggtgagtagaattcaaatttaaatttgtacaagcacttcttaatatttcaagacagagcataaaacagtctctgtccttgagggatttaggatcatgaaaatcaaggatgcatagagtttactttggcatacattaaaaattgaaatgtttgcatcattgagaacctctattttaaacaataacagtatgaaatatttattaattacatgttatatattaagtctatattttatagacttagagagtttggtttaatttattatctcattttgtcatccgcatatcaaaattataagggcttttagctcaaggccaatagctctggaggttatctgatttgcacaaaagaataaaataattatgaaatgagtagagaattttatattaaatctgttctactgttttggttctacatcttttatgtatgagctcaggctctggattcaacaaaatctgatttcaagttctgatttgctgcatactagtttgataatctgtatatactttttcaggaaaaccttaattaatttttacatttctaaaatattattactcttggatgtccatcaaactgagcgtaatagcatagtcatctgcatagtgtttttttcttttcaaagttcaacatatatctttaaatttaaaactttgaactatctgatttatatgaggataaattatgtctcaaattttacagtgtggaaggaaatgaaatgaagagtacacatttagaattgatggctgcgtcaagaatagaaacgtgatgtcaactaaaactctaaaattaagaagctagaaatatagatggtagtagatatacagttaaccagatgtgcatgaggaagttgaagataaagggaggattgataacatgggaaataaagccttagctttggccttaagaatggagcaactggagagtcaaacaggtatttagaaatattgttagttcaaaggtcagacaatatctagttagtagaaaactttatttcatgtacataaatgaagatagaataattgtttgactttgccctgatactctaacaatcttaatttcttgagagacgttagttcatgtatgaaccacaatttttatttaggtttttgggaaaaacaagtcaggtgggttttttcgtctccatgcccatgattaaaataatggatttgtttatgtctattgatatgaaccaataaataatgaattgtcaaagccagtcacttaaatattattttaaaatgaaaatatcctctttataggtaaagaaattttcccacctgtaagtatattacatgccgacagtataattggaggcatataagaacaattacttttcaatggctaattctaaatcttggaattgcaccttaaataaattgagttgtttgaaggcctcatttttgttatatttttaaaattaatttggagaatggcacagttaacaacctctaaaagaagaggtgagcaggaaatttaacagttaatggacaaaaaagacagctacaagattatggcagaggatacagctcaaattttaagcaaaaatgataatactaatgatatttagggtcaaatttatagtaaagacaattagactatttggttaaaaattctgttattttaccaacagttttgagacttaaactaaattaccaggagctctggtcaaccccaactacattgcctagattttcatagaacaaatcctgttgatttaatatttgcagattcatgaggatgttcaaacttttttcactctatatttgactttagttaaaatttcttccatttagaactaggggatttgactaagggacctcaaagttttcttattgcttaaataattttataatcctaagatgttattttcttcatgggaataaaattaactggactgtactcttgatgactgttagagtattgatttggtaactctagcgtttaaataaaaaattcagatgttaatagtctctggttaataaagatttattttggcttcacaaccattttgtgataatgtccaggccaatttcctcatttataaatgagataactttaactcagagaaatgaagtgatttgtatccatattcacacactgtaatataattaggtaacagaatccaggttctactgaaaatgtgtctgcacataaaccttttctcataaacttccaaaaaactttgtagctggatttattcaatgtgaggacttttcatggattttgacaagaagcattagttggacaaaatagggaatagaaatacagattccaattcaagaaacagaaaaaattgacttacaaaatatacaaagtcaagagcaaaaccatccaggtaaagctgccttctgctcctctatgttagttttaactgctgctttattctgtggtttatttaagtctatgattctaactgaagtgcctacagaaataaacctatttctgttataaaggatcagcattttactgtcaaaataaaaaataaggaaagggaaagcaagcaatccaagtttactataaccaattgcatgagcttcttgctgagagttttttatttttcaccttgtgaatatatatatatatatatatatatatatatatatatatgtaattacgttaatccttaatttggttttctacatcactctaaaatgatttgaggtataacatattttccaccacatatttcacagttaaactttacatttgtaagaaaataaatattcatgacatactttcatctgtaaccaaatttgagtttataaggattcatgaccacattctttgtgagaagttaattgcatattgggaaatgtttggcaatgaataatgattctttaaccgtgtttaaaatggattgaatacatttatttaaacattttttaaattgactgattgaatgcattcattttatcaatgttataatgtcccaaaaatgacttctagaaatcatcatggtactaattagaaaaagaaaatatttttattaaatatcagttttcattgtctgaaattctgtaatcatatcccttaaacatagttgcataatattagtatt
